United States Patent 7,745,391 (HUMAN THROMBOSPONDIN POLYPEPTIDE) - sequence listing, part 70

SEQ ID NO: 248573 - DNA, 393 bp, Homo sapiens
actacttacttatacagaatatcaaagacctagtgaatggtgatatagggaaaaaatagactcttttctcaagatgaaactgaaattttttacttagacattgtagaatgaaattacttataacttggaaagaactgcagaactcagagaatcaagattttttctcatttatagtccatgagccatccacacatggataaaatccattcaatgtgcactgcagcataatgggttttaatgtaatagggcatgtaaaatgtattgacataatttgaattttcacattgcaacacacctttaagaaatttccacttgttgagttttgatgtaatatcaaataatggtcacaattattcgaaaaggctattaaaatattactgtgtttttcaacta

SEQ ID NO: 248574 - DNA, 558 bp, Homo sapiens
cagtaggcagctagatatatgagtctggggtccaggagagaggtccagactagaaatctaaatttaggagttgtggctatataggtggtatttataattatgggatgatttccagactcccccaagatgcagaaagctggaaagaatgttactcttaccctgaaacaagaataagttgtatgttctataaaataataaactcatagaggtggggtgtgggcatggctcacctgtggcagagcacagaaaataagcagggctgtgtactagcaggaaaattaatgaattgctaaagtccaagtgtaggcaagcgtgagcgtatagaatccttgggagctgcagacacaaagacagttcataccctcttgtaggtttttctccaaggacctccagcagttgcttaggagaaaaatggggctggggacacaagggagaccagagaatgccttggtaggtggtacaggcccacttggacctttttttcctttggaaaaaaaggctttaagccgctgggaaaaaggaaataaacccagttttccattgtgtctgggaaaagta

SEQ ID NO: 248575 - DNA, 750 bp, Homo sapiens
cagtaggcagctagatatatgagtctggggtccaggagagaggtccagactagaaatctaaatttaggagttgtggctatataggtggtatttataattatgggatgatttccagactcccccaagatgcagaaagctggaaagaatgttactcttaccctgaaacaagaataagttgtatgttctataaaataataaactcatagaggtggggtgtgggcatggctcacctgtggcagagcacagaaaataagcagggctgtgtactagcaggaaaattaatgaattgctaaagtccaagtgtaggcaagcgtgagcgtatagaatccttgggagctgcagacacaaagacagttcataccctcttgtaggtttttctccaaggacctccagcagttgcttaggagaaaaatggggctggggacacaagggagaccagagaatgccttggtaggtggtacaggcccacttggacctttttttcctttggaaaaaaaggctttaagccgctgggaaaaaggaaataaacccagttttccattgtgtctgggaaaagtaaaaagaaaaagaaaacccacaaaccctgagggaacggcaggaaactgttaagggcttagactattagagtttttctgccactgggagaaagccccaacccctgtaacccagggacatagggcctacctgagactgagactgggccaggacaacaaagaacctccctgttggtgctgtcaagtcaagcaacag

SEQ ID NO: 248576 - DNA, 619 bp, Homo sapiens
caggctccttgtgaactgctccactggtgtgggagaagccaaaggggcaaagctcaagacggtgtctccctggtgagggcagttacattggcataagttgtctagcataacttgtcatgccgaccccttttcaagatagcagcttcattcactgataatgtggcagtgttccccttcatcagtggaagacatgggatgtgttctaggggaatttatagtacttgacatgtatgagggaaattctactatcaattaagtacaagaggaaaatacgtgtcaggtagtttcagggcatagggcagggtaaaggttgaggaggaagcttggatagcttgacacagggcaggaaggagaaggctctggcagaggcctggcccccttgtttagaagcagctggaacgagtccttgctcctcagcagctgttggcctcaccttcaggaactgtaagcttgtccttgtggtggggatgggctcatgggggtgagggtaggagctgtggaccattattttccttttttttctttttaaaaataaaatttgttccaagttataccaagggaaaaaaaatttgttccaagttataccaagggaaaaaaaatgaattaagaaaaaaataaa

SEQ ID NO: 248577 - DNA, 659 bp, Homo sapiens
cagcatggcaccctggtggcaggggctgatactcagccgggccagggtgctctcctgttaaccataaccaagctcacaggacatgggatgagcccactgtgtgacacagggagcgggacacagtctgttaagtcttgcacagccatgctctgccacgcaggcaggcctttccttggcctccctctccctgttcgtgctcatgtgaacatccacctacgtggatagactgggctttggttcattattgctctgtgaattcctcgaacttccgcatctgcccaacctcccccaccccattgttttcattgtgtttcaccaaatggaaattctagagtaagcatgtgagtcctctcccaaacttgttcactgttgagagtgctaaaatgctaaccccagatgctaactgaggggtagggttaccttatctttagagcactgcgaattgtatgttaagtggaacttaatgaaaaaatagttaattgaccaacatgaatatcccctgaacagaatctcccctgaacagaatcctacaatgaaactaagggagataaataaagctgtttacctgaaagctctctctaatcaagatcctttgaaatttataaaacatggtcaatatttgcactggactttgtaaaaataaagcttgataagagaag

SEQ ID NO: 248578 - DNA, 357 bp, Homo sapiens
ctgagcatgggccgatgcttccaaagttcacactgggtgcacttgtgtggggacttccatgtgagtcatctccttgcaggctgccaaggtcctgtacagcagagacccaaaccctcttagcagtcttcagagtcagctatgtgtacaggaggcattaccatatcagtgactgtcagcaagcatgtgtgactgaaatggtatccagttcttacgtatttgttttgcaggcttcttggttcagcagacagaggccattgggaagttaagagaggctctcaaactttgagggtcataagacttcccctccctgcagggtgctgtttcctgaaggaaaatattcaattactattttcttta

SEQ ID NO: 248579 - DNA, 1095 bp, Homo sapiens
gagagacctgaagcagaggagctggatgaaatgcctggagggagaaatgtaagtttgcaatgattctcccagagagtttaattttgacctagaacccagaaaagtatcactctttagcagagaagtaagccttaaagtgtttacagaaaggcaaaaagcagatacctataatactttagttaataatcataattatcactgggtacagtggcttgcacctgtaatcctagaaatgcaggaggctgagacagaaggatcatcacttgaacccagaaattcaaagccacggtgatcatgccactgcactccagcgtgggcaacagagcaagatctcacctcaaaatatatacataaataaataattataataatcattgccagttattaaattcttcctaagtgcaatctctgttcttgcaaaatctcacttaacttttcattcgtctgacaaaaatgtatcatcatgtctctttggaacttacagctatagaagaatgtaattcaatgcaacaagttgtattgtataaactacagatagattaatgaggtaaatggtggtggtagcaggactgtatacttgtatattaccagctctgtataactgatacctcaagattcaatctcattgtattctacacagtcaatacagcatgcagtactctgaggacagtgccagaaataaaaataactactatttattgagctgcatattggctcttcagcttaatctttacaaaaatcaggaaaatatgtattagctttaggtttaaaaagttgaaaactgaggctgggggtgagggaaggacatgcccaaggcctcgtggatagaagatggcagaaacaggaagtgaacacaaggcaaagcttctaagtctgcatccttttcccctgcccagaccctgtttctaaaggcaggaatgggctgcctttagaattgaagagcttggtctaggcttgagcacaataagcgcagagggtatatgggggttgacccatttgtaacaatataatcaatgatgtgaaattaggagtatgaattaagtttaaagcatggatgacctgcatcccattcacacatgccttccctggaaacag

SEQ ID NO: 248580 - DNA, 826 bp, Homo sapiens
tacaatatcacctttcttatagattcgcatatacatggccaaaggaacaactccatgttttctaaaaggcctagagaacatacatcagctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgacctcattgctcgatttgtatctttgattccttttgtgcctaatacaccagatgaaaatgatggctctgatatatggatgacatcagagcactgcatcagtttagctatcggaaataaggaggagcatgccatccttctctgtaatttctttctgtattttggaaagaaggcactggtcctcttgggaacgtcagtgttagaagggcatgtggcttatgtagtaactcaagaaactaatgaatatttgctttggaatccatcaactggccaatgttataagcagtttgacccgttttgtcccttaaaaagtgtagattgtttgtttgatgatagaaatgtaag

SEQ ID NO: 248581 - DNA, 526 bp, Homo sapiens
gaaatactttacattttattgtagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgtaagttattattatttttaacatcttcattgtgattaaagggcatctgtgaagaatcacttttaccttttgtgtatttgggttcaatctagtgagttgtctgtcctcaaaatatttgtactgtttgtgagtcataaagctcccttagctggactctttaagctaaaatcaaaagttctaatttagattgcctattgctacaccgcttttccatcatgggtttctttctgcctgtgtgtcctgacacccaatatccaaggaggtaatagtgctctcagatctatttcaaaggctatctttatct

SEQ ID NO: 248582 - DNA, 744 bp, Homo sapiens
ttttgatgaaaagaagttttaaactgtaccagtcctttcctttatgctcaccaggacatgattatagcttctcaagcttatctaaaataaaagataacatatatatcaacatttttgatgaaatgatgactgaaaaacatgaggatcactgtctcaagagctgtagtggtcactcatatataagaaagaattggcttggatgcattgtcttccctttttctgctcttctgcaacaatctgagtttttagatcaaacagaggtcttgcagagagcacagatttttaaaaagaattgtaaggcaatgtttcccaaccgaagaatcgtaactactgtttttaatgatgaagggatacagttcttagtcacaagatatatcaaggcattaaatccacctcagcaacttctggatatatttcttcacaattctaatgcaacatttgtaagttattattatttttaacatcttcattgtgattaaagggcatctgtgaagaatcacttttaccttttgtgtatttgggttcaatctagtgagttgtctgtcctcaaaatatttgtactgtttgtgagtcataaagctcccttagctggactctttaagctaaaatcaaaagttctaatttagattgcctattgctacaccgcttttccatcatgggtttctttctgcctgtgtgtcctgacacccaatatccaaggaggtaatagtgctctcagatctatttcaaaggctatctttatct

SEQ ID NO: 248583 - DNA, 400 bp, Homo sapiens
gctaaagacaacattggtaggatacagatgctgtgtgaaaagccacatgctggaacaaggttctgaatctttcagctgatgtggccaccctggttgctgtgggacacctgtctcctcctgccgtccaaaagagcaagaagcactaaactctgtcttcggtcagcatgactctcagcccatatgagactgtccagttgcaggaaaacaagctcagggctcccactgattctacatgatgcacttacaaattcatggactattatgaagacaagttaagagattgtgtcctccaaactcatcatttttcagaaattgtatcacaatcctacaagataaatgcacaagataattcttcaaatcattgagagtgtaatctataatcttcctaaacaacgaacag

SEQ ID NO: 248584 - DNA, 530 bp, Homo sapiens
gctaaagacaacattggtaggatacagatgctgtgtgaaaagccacatgctggaacaaggttctgaatctttcagctgatgtggccaccctggttgctgtgggacacctgtctcctcctgccgtccaaaagagcaagaagcactaaactctgtcttcggtcagcatgactctcagcccatgtaagctcaccttggctgtaccccgaggagggagatcaaagtatatgttcctactgtcagctttactcacatccacatcttctccctgcatgtccttgggttggaaggaacagcttattttttgtcctacatcagtggttcttaaactttactgtaccaagaaagcttttaaaaaatgctgatgattggggcctgcagattctcagtcactgatctggatatgtcctgcatgtaagagtgttttgcaaatcgtttctaatgtgcaaccaggattacaaaacgttatcttgtatcctgagttctctctactcttggcataaaattaaaatctgttatatcttgaaaaaaaa

SEQ ID NO: 248585 - DNA, 472 bp, Homo sapiens
ctaactcagacatacatgctgcctccacaggtggccaccctggttgctgtgggacacctgtctcctcctgccgtccaaaagagcaagaagcactaaactctgtcttcggtcagcatgactctcagcccatgtaagctcaccttggctgtaccccgaggagggagatcaaagtatatgttcctactgtcagctttactcacatccacatcttctccctgcatgtccttgggttggaaggaacagcttattttttgtcctacatcagtggttcttaaactttactgtaccaagaaagcttttaaaaaatgctgatgattggggcctgcagattctcagtcactgatctggatatgtcctgcatgtaagagtgttttgcaaatcgtttctaatgtgcaaccaggattacaaaacgttatcttgtatcctgagttctctctactcttggcataaaattaaaatctgttatatcttg

SEQ ID NO: 248586 - DNA, 491 bp, Homo sapiens
tgcgagtttaaatgcatctgtatttagtgccgggtattagccggtgaggtgatgccctgcctcatctccgggtccttcacggggtttcgctcccctttccttccgctagtcccgacgaagattcaaaagggacccgacaacactaaggcgcgcaaaggcaccaccgtgacgctgactgcggagatcctgggagagcctgcgcccgacgtaggctggaccaaggacggggaggacatcgaggaggatgacagggtgttcttcgagatcggcagcaccaccacgacgctgaccattcgccgggccacgcctcaggacagcggcaagtacgaggtgtacgtggagaacagcctgggcatggaccagagcttcgctcgcgtggacgtggcctgaacggcacccccggaccttccgccctggcgccgagcccgggggtggtgggacccacagccctccaccagcttgcttaataaagctgctctctgaccctccgc

SEQ ID NO: 248587 - DNA, 636 bp, Homo sapiens
tgcgagtttaaatgcatctgtatttagtgccgggtattagccggtgaggtgatgccctgcctcatctccgggtccttcacggggtttcgctcccctttccttccgctagtcccgacgaagattcaaaagggacccgacaacactaaggcgcgcaaaggcaccaccgtgacgctgactgcggagatcctgggagagcctgcgcccgacgtaggctggaccaaggacggggaggacatcgaggaggatgacaggcgagggccgggacctgcggcacggccagggcctggggctggaacctgggtgggactgagcccagaaatctggctggagtgacgggggcggggactgggcagcgaggaacagagctggctaaggagccccgcccagtgcgcccgtgtactgaccacggctccgccctcctccccgccgcccttccgcagggtgttcttcgagatcggcagcaccaccacgacgctgaccattcgccgggccacgcctcaggacagcggcaagtacgaggtgtacgtggagaacagcctgggcatggaccagagcttcgctcgcgtggacgtggcctgaacggcacccccggaccttccgccctggcgccgagcccgggggtggtgggacccacag

SEQ ID NO: 248588 - DNA, 455 bp, Homo sapiens
acagtgtctgtttaacttgtaactgggaagtcattagttttttttgagaggaatttcagtggactgaggtggcggggtaggcagcagccagggtataatgatttggagtatgaattcaaggtagaaattacagtaaaaattgtagcctgcccttgcaagaaactaggctataaaagaagagagtgtaagaaggtcttcagaggctgctgctttgactgtcgggttaatgctttataaagtcctctttattaatgtgtttttctacttgcagagtagaacattctcagactctgcgattctttaattttcctgaagtggcactctttgctttttgttcatgatttaaccactataaaaatgcccagctacagcttgctgcaagaacataagtttggcttcttatcatggaattctttttgaggccattacctttgaagttgtttgatacgttaaca

SEQ ID NO: 248589 - DNA, 580 bp, Homo sapiens
ctgtctggtctttgcttgagttgtcaccttagccagcccgttctggcatgtcacccacgcccccaaaacttactctgagcttgttgggtgagctttaggagacatcgtgagctagagctgctgcagtggtgggcctagaaatgtcgctagctgatggtgtagcccctccagagggacatgctggacacaaccttccgtattctgcgcaggagagcatccctccaactccccaccatatgaatgaaatttttcatatgaatgaaaattttggctggagtgcagtggcatgatcttggctcactgcaacctccgcctcctgggttcaagtgattttccttcctcaggctcctgagtagctgggactacaggcgcgtgctaccacgcccggctagtttttgtattttttagtggagatggggtttcaccatgttggtcaggctgttctcaaactcctgacctcaggtgatccacccgcctcggcctcccaaagtgctgggattacaggcatgaacctgtaacagagcaagactccatctcaaacaaaacaaaaaacaaaacaaaacaccacatttttaaataa

SEQ ID NO: 248590 - DNA, 276 bp, Homo sapiens
agagagcagtagatgtcaaggttgaagattaatacccaggagagcatttaatataaacttagaaatgtaaatgtttcaacaagaagtgggtagtgaatgactattagatgaggtgagttggagttggtggctttgattgggttgggtggagagatgaaagttaaaagcctgattggatgtagcttaaagagaatgggagacaaggaagtggagacgagctgcagaaaatgtttaggaagttttactagttaagggagtaaaaattcaaaattctgg

SEQ ID NO: 248591 - DNA, 132 bp, Homo sapiens
atttcgacagaacaagaaaattaggttgactaggaaaatggtttttaacctttatccttagcataaatcaagaggctcatttttcagtctattcctatagaattcaattaaaggtcaggtttgtaatggaga

SEQ ID NO: 248592 - DNA, 472 bp, Homo sapiens
cttttaaccttctgccatgattttgaagcctccccagccacgtggaactgtaagtccattaaacctctttcttttgtaagttacccgctcttgggtatgcctttatcagcagtgtgaaaacggactaatacaatatgtttctatgaatgtggttcctattccctaatttggagtaagtgcccagtgtgctttgtttttgcccgagcttgtcttttgcttttcatccaagatctccaatcataaccagactgctgagacagtggataggggctggagagaagttgaggaacatagcagtcaaatacttgctcttcattttacgatcattgctatttttctttcagaacttaaaactatcaggctaaacataataataataacttgggcaactttacattcctatctaggacttaatttgaggaacattcatattttatcaggaaatcagcatttctcttttaaatatgtactt

SEQ ID NO: 248593 - DNA, 966 bp, Homo sapiens
caagactggggctgacttcagggtcaaagattcgcttgggcactctaccagtcatcagaattttcacagagacacccccccaacacacacacccgcagcatgcgctccttgaaagtgctaatagcttcaatatgaggctggcacttctgcatgactgttggtgttcagggccagcctagtcttggggagtaggccatctgtagcagctgcagaaatgtttttgcttattttgagcattctaagtttttcctagccatgaataacaacaatcgaataaatcatcccacagtgtgtaggatggtcgtttttttgtttttttttttcagcaagaacaacaaaaaatgacatatcatgtactatggataatacacataaaaaattccgccatatttataggcagcagttaactaactatatttagatatttgaaactgtcttaaatcagatgaatgataaaagcttcctggatttcagtggaaagcctaaatgactaaaccaaaaaaaaaaaaagttttattactatgaagtatagtgcatattctgaaataaaagatatgtgatatttataaaataaaaagagaaactttgtcaatagacagcatcatttaataaagcagggtcccagatttacagacctttgtttgagttctaaaatttactaggaaggagggtgcaggggtggaagccgttcattgtagctctttaaatttcctcacttttgaatggagatgataaaatgcccctcacagggtttttgagaggactaaaaatataaggtatggaaagtgtttagcattgtgcctatcacaaagttagtgcttgaatatattagctattgtcattaatactattgctattcttatttcttctacaactgttattgttgaaatgcgaagtcaaaatggtacatttttatcaactattaagtgctatcatgtttcaattaatacataatgttattgatta

SEQ ID NO: 248594 - DNA, 383 bp, Homo sapiens
tgcagtgatctgaggttgcatcgctgcactccagcctggcaacagagtgagactccgtctcaagaaaaaaaaatgtttttttgcttatttagttgtatgtcagttttacctcaattaaaaactaataacacttttaaaaataaattagtagtaatgtattgttgtgaaatccatgccttaaaatgaaacaacataaatcttgacttaaacaagagtagtagataaaaccactctgaggcagaatgatctgaatctcaccgctgtgaccctgttctcatttctttaccttcgtgacgttatgttatgtgtgcctttctttgaaaaatgagggctgtaatttctacagtgtaaacttattgtgagtattaaatatgtagaaaaca

SEQ ID NO: 248595 - DNA, 513 bp, Homo sapiens
acaaacaccagctggaaaaggcagcaacgtggggtctccctccccctcagccaaagtgaactgtgtcagcaggtgtctcccagctgctgagaatgagccaagggaccaagatggccgcctggctcctgcaagtggagagggtcttgctggggcctgaactggctgaggtcttgcagcaggaaggggacgctggacacttagccccctacagggagcccagagccaggcctgggtgaaggtgcctttgggaggaggtggaggagtgtaacgattgggacccagctggacaggtccctgtgagccggcctgggtccttggtgggtgggacatgtctacaaatagctcatcacgtctccaatccagaagtgctgtgtcgtttcaaaaatgagcggagccaacgcagccaccagccaggcctcggctacctgggcaaggctgccggctcatgaatattcacggctccgatggtgtctctgagcctcctaaccatctggaattaaaccaacgagcttc

SEQ ID NO: 248596 - DNA, 500 bp, Homo sapiens
ttttttcttttctttcctttttctcttttatttatttatttttatgcctaatgaacctggctagcaattccagtatatgttgaatagattggtcagagtaggtggtatcatctgaacactgtgtcctcaaaattcatatgttaaaacctaattcccaatgtgatggccttaagagggtgagcctttggagatgattaggtgattaggctccacctttatcatgagattaatactcttataaaagaggcctgaggaagcttgttctccctatctaccatgtgagaacagaggtagaagatgccaacatgaaggaaagaacaagccctcacctaacactgaatccgctgacaacttggccttggacttcccagcctccagactgtaaaataatttctgttgttaataagttactgagtctaaggtattttcttacaatagcccaagcagatgaaatggtcgaggaaaaggtatcaagtttttgccactaaattggagtcgac

SEQ ID NO: 248597 - DNA, 449 bp, Homo sapiens
caaaggcaagagagaggaaaaaaacaaggacactagaggaatttgaagcctctggaacttacagctacaacaataattaaacacaacccaactccaggccagattaacataaatcctcacaccaaaggcctgtttacttcagtacctattagaaatacataatattgattgggtgcaatgactcatgcctgtaatcccagcactttgggaggccgaggcgggaggatcacaaggtcaggagttcgagaccagcctgaccaacatggtgaaaccccgactctactaaaaatacaaaagttagctggccatggtggcatgtgcctgtaatcccagctactcaggaagctgaggcaggagaatcacttgaacccaggaggcggaggttgcagtgagccaagattgtgccactgcactccagcctgggcaacagagtgagactccatctcaaa

SEQ ID NO: 248598 - DNA, 246 bp, Homo sapiens
tctccaaccatttcccagggtcagatatgttcacatctgacaaacagatctgtttttctccatggagatgagccagattgtcctttgtctggaatgatagttcagtggggaccccaaagttaccattttgccatcataggtcacctgcaggtttcaaagaggatgtctgcagcaccatctgttgcttttaaatgagcaatatgttgtgtgttcccatgcactgaggtcaaagcaaagggggttaaa

SEQ ID NO: 248599 - DNA, 528 bp, Homo sapiens
ctttcctgttgtcaattcttctgtaactatgttatctactatgctgaccacagggtacatgtggctttccacattaatgaaaataaaagaaaataaaatatcctgttcctgggccacacaatctcatttccagggctcaatagccacatgtggctagtagctacttggcagaggagacacagaaagaacattttcatcatcacagaaattctactcttgtagagagtgctgctctagaagctttaggccactgaagttgtattcagcgacctgacatcagagagtttttgtagtcacttgagcagaggtaatgcaatccctggggaagacttccagtttcaattacattcaggttaacaaagcccattgttccaaccaaaataatagttgctcaacattccattctgatgattttttttatccaagcagtcaacatagtttcattaaataccacccactaattgtgtactagttaaatgaggaatgaatgtggctctgtctccagataaatgaatagagagagagaca

SEQ ID NO: 248600 - DNA, 305 bp, Homo sapiens
cagtcatctgtgggtagctacttggtgtgaagaattccttggctggggctgaggagagttctctacctcacctcaaccccagccgccttctcccatccctccctcttagaccaatcccttcctacaggatgttctttttttttttttttttgatttcctctaaaaaatttcaataaagaaaataaagcaggaggtagaaagcaggagaatcgcttgaacccgggaggcagaggttgcagtgagccgagatcgtaccattgcgctccagcctggtcaacaagagcaaaacttcatctcaaaaaaga

SEQ ID NO: 248601 - DNA, 409 bp, Homo sapiens
aaccataaaaagagaaagaaatcctatctcattggcaacatggatgaacttgggagacattatgctaagtaaaataagccagacacagaaagacaaatattgtgtggtttcacttacatgtggaatctataaatgttaaactcagagaagcagaaagtaaaatggtggttgccagtgactggaagtggaatggagagatgttagtcaaaagatacaaaacgtttagttatgtataatatcaatatgttgtgggagctgatcatagcagggcgagtggcggatgttttaattcatttgtggtaattgttacacaatatatgtgtatcaaataatcatgttgtttactttgaatatgttcaatctttatttgacaattacatattttatttttacttactttaaataaatt

SEQ ID NO: 248602 - DNA, 604 bp, Homo sapiens
ccttctgctaaatcacagcagtttggggagttttcttcccaataaaactggcttaatcctaaatgggtcctgacgtattcttcgttattttatgttttaaggcccaggaaaggcctaagctaaacttttggtgggcttttcttatatcccagcctttgtataagggccttggcttttaatatttaactactcagacagtactaaaacacttgttacagaggcctgcgttagtgagacctggcctgccacaatccccactgtcaatttgctcatgctttttatcatgcatgtatatgtatttattaatcacgagaatcgtagggagatgaagcattgtaatctttctggctgcttcctgctgagagagggttgtcgtcatggggcaccaaacacagcgctggagtggaagaggtggatttgttcccggtagcactttctgttctgggggcttcgaggcagcacctgctgaaacgtaataggatgcaacagccacacatagaagtaggttgctgctgttttcttcccaagtttagtcttcagtttacagggcttgaggaaagcatagcttagatttcagtgatttccaattaggaaaaaggaaaca

SEQ ID NO: 248603 - DNA, 495 bp, Homo sapiens
tcttgttatgttgcccaatctggtcttgaactcctggcctcaagtgatcctcccacctcagcttcccaaagtactgggattacaggtgtgaatcatagtgcccagctggagttttatattaagcacttgctgacattaataattatggaagaaatatttcgcctctctgagtttctgtgtcttcatcttttaaaaaatgaagctacttatctctaaattttggagtttgtaatgaagattaaataatttatctgtagtgtattaaatattagtttctgattccttttccttctatattacaggcctctttgcaatgagccactaagaaaacaaaggccatctatccaaggacaccgcctagtgtctttgtgtgactagcacagatacatatttggtttgctgttctagataggtaataacatcttgctgtttgttcttgatgtccttctatcacgcccccttcattccaccttgattgccttccatagctgcact

SEQ ID NO: 248604 - DNA, 713 bp, Homo sapiens
aaaaaaaaaaaattagcgaggcatggtggcaggcacctgtaatcccagctactcgtgaggctggggcaggagaatcacttgaacccaggaggcagaggttgcagtgagccaagatagcaccaccgcactccagcccaggtgacagagtgagactgtctcaaaaaaaagaaagcacgaggaaacattttcttcatatgttactatatttatgcattattttcccagagtaattcagctggttaaaacatgctgctactaaggtggaggtgcagattactacagataaagaatactccctgcctgtttccaatttagaataggctttttctaaaaagacattgaatgaatagggatagtagcagaatgaatgtaggaacttggctcaaattaagaattaaactagaaacaaaaggacagtcatttattagaggagatatagtatgtagccaaggaataatagcatcagaatagataccaaaagaggtaacaaaaacaggggtaaggtgtagaaccactctacaaactctgccaaaaactcacttctttgagttctgtttttattgagccactagtttctgcagtggcttgctgtctagcatattaactttattgtctcctgagaaataaaaaggttgaaattaagagctgttccttacaatcgcccaatggttctttgtttttcactgtatctaatatgtggcaaatggtagtta

SEQ ID NO: 248605 - DNA, 384 bp, Homo sapiens
ccaggcccaactattgatgctaaaagacagtccaatcaagaccagctgatattgtttctggaaagcactcaacacctttccagtatgttcctttatgtacatatgtgtgtgtgaccaagaaaaccagagggagcttctgttgcttacaagccagaacctgactgctacagtagggccatgtaataaccagatttacacttgaagatcactctggctgctctgtggagaaaggactaagagtgaaaatgaaagtgagggataagcagttagggggcactggagaagtctacatgaaagacaatgggtctggatgcagtagctcacacctgtaatcccagcattttgggaggctgaggcaggaggatcgcttgagcccatgagttc

SEQ ID NO: 248606 - DNA, 540 bp, Homo sapiens
ctccagcattcagaacatgtcctgcttagctaaaggttttttaatatgcgatttttctcctaggattatggcaaagggagaagaaaagggatactgaccattttaggaactcaaaatattgttctaaatgttttagaaatgtgtagtaatgagtttgttattcccgattacagtgtatcttctcatgtctttgaatgtgattgtgcttgctaatttagcttatatggtagaaatattagatatttactcacatcttgaaactgagtggatgtgttggtgttggtggcaagagagcttaaaggcaaatttgtggcccactaaaaaacatgtatatagtttaatatggaatgaacttttaaactaccacttaggtccattttatgttgccttctcaactatctttttcttttttttttcacttttgccttttatgctaagttgttgaatgttgtatatatttgtcaacaatatatatgctccccaaaacaaggcaggtaaataaaaataaattcatgagaatttaacactctaagcaaatgt

SEQ ID NO: 248607 - DNA, 337 bp, Homo sapiens
ctccatgttggtcaggctggtctcgaactcccgacctcaggtgatcctcccgcctcggcgtcccaaagtgctgggattgcaggtgtgagccaccatgcccagcccagatagacctttcttgatcacccaatttagtcaaaccatcaccctgttctgtctttttccaggtactgattattagctgaaagtgtcttttctgtttaattctttgtttactttattgtcccccctccaccccgtcccatgttcctcaagggcaggagcctctttgtttttccattgccctttctggcacctggaacagggagagcatgtagggccttggctaatggttgtt

SEQ ID NO: 248608 - DNA, 468 bp, Homo sapiens
ttatcaagttttcctttttttccttcaaagaaatatgtactacttttgcagccagagttctggggtttgcttgtttgtttttcagagatagggtcttacccaggttggagtgcagtggcacagtcatacctcactgtaacctcaaactgctggcctcaggcaatcctccagcctcagtctcccaaaccgccaccacgcctagtccagttttttgtttgtttgtttgtttgtttgtttgagatggagtctcactctgttgcccaggctggagtgcagtgagctgagatcacaccacactgcactccagcctgggtgacagatatataacatatatatatatatatataaaacattagactcagcgtttccagctctagaatttatgataaaatgattgtggatgtgtgaaaagatttagcctgaggaacatacatttctgccagagtatcttcagaacagtaaaaaaaa

SEQ ID NO: 248609 - DNA, 622 bp, Homo sapiens
cctcccctagagtttgagttcttggaggcctgatgacacccagcgtgttgcctagaggtggggatgagaccctggctggctgaactgccgctcaccgtgtgtttttggagacacatccctcctggtggcacaacagaaaaccacgactctaagtcacttgccccagccctctgacctctcttcagcccagaccagcccttctgccagttataaagcaccagccctgccaagagcaaagagaggcttgctggatcccgctgtctcttcatggagttcctgaatcacagaacctcccagtttgtctgtttgcctcccatgtatcaagaactcagaggttcagccaagcgcggtggctcacgcctgtaattccagcactttgggaggccaaggcgggcagatcacctgaggtcaggagttcgagaccagcctggccaacatggtggaaccccatctctactaaaaatacaaaaaaaacagcgaggtgtggtggcgggagcctgtaaccccactactcgggaggctgaggcgggagaatcacttgaacccaggaggcggaggttgcagtgagccgagatggcaccactgcactccagcctggatgacaagagcgagactccatcta

SEQ ID NO: 248610 - DNA, 536 bp, Homo sapiens
cctaccaaagactgtttagcaagtggctttttcagaaacatgtaggatcaacttgttccatcgtcctacgttagatagactggaataacagaacaaagagagcaaataagaggtttagcttgcagctcccctcgtgtacaaccagttccacttgagaatgtcatcttctatcatatattttcaaagaaaacttgatccatagtaaatggataattcccatgtgtaagtgtattaaatggagaagaagggaaaaaaagtaaatggatagttcccaatccagggtgcaaacaaaaaacatgtactaaaatatttttactgtggttctaccacccacgtttcctcaaagattctacctttggtgggggaggttgaatgaacattttgagctcaagatacctgcccacgtggttggaaacactaataactaataggattcaaactccaaaaaatgggaaggacctttgaattagaagccgtctgtttctataagcctgtctgcttgcctgaatattaaagagatttgaaattcccattta

SEQ ID NO: 248611 - DNA, 341 bp, Homo sapiens
caacgagagcgaaaactccatctcaaaaaaaaagaaaaaaaaaaaaagacataaaataaccaatgtataagtggacccatgagttcaaacacatgtgttcaagagtcaactgcattttttaagttttaattttttgttgttgttgttttgagacagagtttcactcttgtcaccaggctggagtgcaatggctcaagctcactgcaacctccacctcccgggtacaggctgaggcatgagaatcgcttggactcgccaggtgaaggttgcagtgagccaagatcacgccaccgaactctggcctgggcaacgagagcgaaaactccatctcaaaaaaaaaa

SEQ ID NO: 248612 - DNA, 496 bp, Homo sapiens
caattttattactaagtgtctttgtgttttaggatacacataagctgacagtgagggatggataaaaatatttcattcaaacagtaaccgaaagagagcaggatgaacatatttacatcaaacaaagtagactttagatacaaaactcacaagagacaaaaaaagatactataataataaaatatcaccagggaaatataacaattataacagtacagataccaaacattggagtatctaaatatatgaagcaaatattgacaagactcaagtgacaaatagcaactaaaataatagtagattttaataacccactttcaataatagataaaatattcaaatagaagatcaataaggcaataggggacttgaacaacactataaagcaaatggacctaacagcataaacagagtatttcaccccaatgctacagaatacttgtttttctcaagcacacataggacattctcaatgatggaccacaagttaggtcac

SEQ ID NO: 248613 - DNA, 1113 bp, Homo sapiens
gacctacgcacaggagaacatgcctctcgcaaaggagctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaaaaaaaaaaaaaaagtttggataggggaagaaggaaaggagaaaagattaattttgaagtaaggggtaaataagcaccctgccaaggggcaataccccactgggggtgaggagcgctggattcagagggcagctggatagcactggcccaggcagacaggagagatttcttgagatgagaaggattagagcctgggttcatgacaatgaggctttgccctgaagtcacttttgtatatgtagctactgacacttgcgctttatcaggtcccttttaaaagttgctcctgtttcattcagatttactattccagactgatttagattcttcaagatcaaaacagtgactcctatcatattttctgtttttcacttcgggtagaatgggataccagttcctattctcataggacttcacttacctttcttggcctcctatggtctattctcccctggaccaacttcaaaacctccttcctctgactttctaaagttattttcacattcctctacagtatttagggttcctctattgtaggaatctttaaatcattacaaaaatggggttatatatatatcacctagtagagatctgttaatcaaaataaataaacccgtgtgcttgctgagaagctcaactgcggaaatattgattgattgctacatagacctacccataataaataagctaagatattttacatagccaggagtgatgagcaaacaccactttttcatctgtgtttaaaatttatgtattatccattt

SEQ ID NO: 248614 - DNA, 370 bp, Homo sapiens
gtgcatagtaaactatggatttcaataggtactgccaaattgccttccaggaatttcctaccaatttacattcccacaaggagcgtatgagagttcatcaaaggccctgtgtattctgagttgtttggcttcagtgttatggggagtgggccttggaatctaatagatttggagtcagatcctggctcctccactcagtcttctgatgagcttttcaagcttccaaaacctctgaggccttgtctcctatccctgtacctctcagagttgttataagaattaaatgagacaagcatgtatagtggttatcttatttcctggcatatagttatattcaataaatgatcatttctgttattctgccagtggg

SEQ ID NO: 248615 - DNA, 940 bp, Homo sapiens
gaactagttatattgaaatagttacaaaactatttcaagtattataacaatatttgtgcatataatagcatattaaataataaaatcttttggtagatctaatatctctcacatttaagtagcaaatgactgaaaatgattttttttttgagatggagtctcccgctgttgccaggcagtgcagtggcatgatcttggctcactgcaatctccgcctcatgggttcaacctcctgcctcagcctccagagtagctgggattacaggcatctgccaccacacccagctaatttttgtatttttggtagagagagggtttccccatgttggccaggatggtctcgatctcctgacctcaggtgatccgcccgcctcggcctcccaaagtgctgggatttcaggcgtgagccaccgcacctggcccatatttcaggataccccaacacttttttagggttatgaaaatgttttagagctagagagaggcagtggttgcacgccattgtgagtgtactaagtagtaccgaattgtatactttaaaatggttcattttatatcatgtgaatttcatctcaaaaaaggaactgggggtggggagatctccccacagctgtgatagggtacaacagtatccggctggggcttctactggtgatggtcatggggatcgctcattccattgggatctgttacctacgctcaaaatgacagtgctaaatttctacccaattgagttcacaggtccctttgcctgaattctatccacagattccttggtggtccacagaccctggagtaagaatctctgccctaggggatgacaggactgtaaaaggaagggacctgggtccctgaatcacacgggggaagtcacctgctgaatcagaacgcctcaacagctagctagccaagaaataaacggagagcgtggcaacccaca

SEQ ID NO: 248616 - DNA, 367 bp, Homo sapiens
gttttttatcacaggatgaaagtatgggcatcataggacgaaagtaaagtaccattaagtatggacatattttcatgtgcttatttaccatctatatatcttctttgatgcagtgtctgttcacatcttttggccattttttaaaaagtgcatatacattgacatgcagagtggagtaatagatagtggagactcagaaaggtggaaggtaggaagggtgtgaggaatgaaataccacgtattgggcataatggacactattcgggtgatgagtacactagtagcccacacttcaccactatgcaataaatctgtatcacacaactgcatttgtaccccatacatctataaaaataaaaattaaaaa

SEQ ID NO: 248617 - DNA, 578 bp, Homo sapiens
ccacaacaggccttggtgtgtgatgttccccttcctgtgttctcattgttcaattcccacctatgagtgagaacatgcggtgtttgtttttttgtccctgcgatagtttgctgagaatgatggtttccagcttcatccatgtccctataaaggacatgaactcatcgttttttatggctgcatagtattccatggtgtctatgtgccacattttcttaatccagtctatcattgttggatatggggtaaaggattcctatttaataaatggtgctgggataatttacatttttaaaaagaaatgattcatgttagaaataatacatagggcagtgcatggtggctcacgcctgtaatttcagcactttgggaggttgaggtgggcggatcacaaggtcaggagttggagaccagcctgaccaacatggtcaaaccctgtctctactaaaaatacaaaaattagctgggtgtggtggcacgtgcctctaatcccacctactcaggaggctgaggcaggagagtctctcgaacccacgaagtggaggttacagtgagccatgattgcaccactgcactcc

SEQ ID NO: 248618 - DNA, 167 bp, Homo sapiens
aaaatttgaaaattcactgggcatggtggctcattcctgtagtctagctagtcaggaggctaaggcaagaggatcatttgagctcaggaggtgaaggttgcagtgagctgtgtctgcaccactgcacttgagcctaggtgataaagcaagacatcttctcatttaaa

SEQ ID NO: 248619 - DNA, 292 bp, Homo sapiens
aagatacgaaatcttcagaacattacatatataaattatatacactatttgattctagaagtttaatgtgttagaaaatattcatctcactcttccatgtttagcccatccttataggatttggggaagggaggttaacatgaatatggagaaaggaaattaggatttcggactgccagttttagcaaagaacaaaaccaactattgtcctcaaatcagccagacttgttattcaggaaaacagatgcatttttatgagaggccataatacaagttttattgctataataaa

SEQ ID NO: 248620 - DNA, 383 bp, Homo sapiens
gagattgtcccggcaggtacatgagtccaggagagaaatccaagcagggagaagaagaaaggaggagaagggaaggaagggaggagaagcagaggagcaggaaaggaggaaaggaaggaggagtaggagaaggaggaagaagaagaagaaaaaaagtcaatggcctattagaaaggattcttagataaaagcaagttttctttgcagtatttgtatgccttccgttgcttttggccataaggacagtgctctgctggtgaattcattttctagatgcagcaagagcaggtatgctatgcttatgtcagagcaggtgattgggtgagaaggataagcagaaagattttgaaactgactctcaggcttctctgtctttgctagct

SEQ ID NO: 248621 - DNA, 3796 bp, Homo sapiens
  misc_feature (18)..(18): n is a, c, g, or t
ctattgaagccacctgcncaggacaatgaaattcttcagttacattctggtttatcgccgatttctcttcgtggttttcactgtgttggttttactacctctgcccatcgtcctccacaccaaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacacgctatcctgactgtcgttgcctcaactttggatcatggtttacgttttccttcccagctgcccttatcattctactcttatcctggatctggcttcagtggcttttcctaggattcaattttaaggagatgttcaaatgtggcaaaaccaaaacagtccaacaaaaagcttgtgctgaggtgattaagcaagaataccaaaagcttgggccaataaggtatcaagaaattgtgaccttggtcctcttcattataatggctctgctatggtttagtcgagaccccggatttgttcctggttggtctgcacttttttcagagtaccctggttttgctacagattcaactgttgctttacttatagggctgctattctttcttatcccagctaagacactgactaaaactacacctacaggagaaattgttgcttttgattactctccactgattacttggaaagaattccagtcattcatgccctgggatatagccattcttgttggtggagggtttgccctggcagatggttgtgaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggccgaagccattcatgtgaaccctctttatattctgataccttctactctgtgtacttcatttgcattcctcctaccagtagcaaatccacccaatgctattgtcttttcatatggtcatctgaaagtcattgacatggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcccgtgaatacccgaaacctgctgttataactcagagtccatatttgttattgcagtgcaactaaagagcatctatgtgccttcatcaagaagcccatgttttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgctatgatttgcactattagtacagtatagttagaaaggaaagctgaacactataaaactattaacatattttcgtatatgagtaacaactttgcttaagtgtttatcttagttcagaaatacataatgtcatatgttaaaaataaagagatgtagaaatctaaatgaattatcactgtgtatacagacagaaaaatcacataactctggtgtgttaacattgcaatgaaaaaatgaaaaaaagaaggaaaaaagaataagaatgaaaactgctgacgtattacaaaacagaaaaataaatgatttaaaatcaaatcaaaaagaaaaaactaaacatttaaacaaaaatgggataagaatagtcttctagaagtgaggatgcgaaaaagaatgagtttccaattaccctgatgtgacaattacacattgtagacaggtagcaaaatatcacatacacccccaaaatatgtacaaatattatatatcaataaataaatttttaaagagtaagtgctattggcattccaaaattcagctaaaggaaaaatgatcaaaaacaaagtaaggtgcacagttagcaaaagatgcagatgttatatcacagcaattctcatgctaaaaatacaacaaaagacaaagcaaaaaataaacctttgcttttttttttttttttttttttttgagacggagtctcgctctgtcgcccaggctggagtgcagtggcgggatctcggctcactgcaagctccgcctcccaggttcacgccattctcctgcctcagccaaacctttgctatttttaatcttcgttggcactttccagctgttactgaccttgtcattttttattcaaataagattatttacaaacttattcttgaaactaaatatagtaaagagggtttttaaaataatatttaacatacgaattattaattggccatgttcattatttatctatgtttattaatgggccaatgcaaaaaatcattttttcaaagaaaaatttgtccatgtaaagcttaaattataatattgctgctttgtataactcttctatgtttattctattcatttgttcctttccctaccatattttacacatgtatttataatctgtagtatttattacatttctgcttttttctagtcattcaatttatcactgctgaattgcatcagatcatggatgcatttttattatgaaaaaataaaatgacttttcaaatt

SEQ ID NO: 248622 - DNA, 829 bp, Homo sapiens
  misc_feature (18)..(18): n is a, c, g, or t
ctattgaagccacctgcncaggacaatgaaattcttcagttacattctggtttatcgccgatttctcttcgtggttttcactgtgttggttttactacctctgcccatcgtcctccacaccaaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagggcactgtttaactactgaaatgaagctattctcctgactaaacataactgaaaaaccattcattaaatgaaatgaccggaaaagttattggttcttctttgaatttcgccacaggaagaggaagaatcaaaccaacaaagggt

SEQ ID NO: 248623 - DNA, 1069 bp, Homo sapiens
  misc_feature (18)..(18): n is a, c, g, or t
ctattgaagccacctgcncaggacaatgaaattcttcagttacattctggtttatcgccgatttctcttcgtggttttcactgtgttggttttactacctctgcccatcgtcctccacaccaaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagcactggaaacttgcagttcaagatggctccccatctccctctgtccattctgtatcgcagctagctgctcaaggaaaggagaaagtggaaggcatatgtacttagaaattattctattactttcctggatttaagagtattcagattttctatttcaacatcaaacaattgcatttttaaaaagaaatttatgtgttccatgtcaaatttagtagtgtgtggttgtttataatattttcttatatctacttaatttctatagtatttatagttatatgtctttatttctaacatttttcttgtgcttttaaagattatttaaagattatttttaaataatctttatttcatttaaataaaatattttatttaagtcttttttaa

SEQ ID NO: 248624 - DNA, 1107 bp, Homo sapiens
  misc_feature (18)..(18): n is a, c, g, or t
ctattgaagccacctgcncaggacaatgaaattcttcagttacattctggtttatcgccgatttctcttcgtggttttcactgtgttggttttactacctctgcccatcgtcctccacaccaaggaagcagaatgtgcctacacactctttgtggtcgccacattttggctcacagaagcattgcctctgtcggtaacagctttgctacctagtttaatgttacccatgtttgggatcatgccttctaagaaggtggcatctgcttatttcaaggattttcacttactgctaattggagttatctgtttagcaacatccatagaaaaatggaatttgcacaagagaattgctctgaaaatggtgatgatggttggtgtaaatcctgcatggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatgaaagtgttaatggacatgaaataaatgagaggaaagagaaaacaaaaccagttccaggatacaataatgatacagggaaaatttcaagcaaggtggagttggaaaagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacattccatccacacagaagaggagatcgtacaaggcatgtacaccaggaggcagaaatttgaggcatatcttggaactctgtctaccacatcctgaacatcacacagtttccactcttgttgccttcaatcctgagaatgcatccaggagccattctgttttatgtcaattactaattagatcatgtcacgttactaacttactacgttccaattagtccttattgcatttgtaataaaatccgcatactttcggactggctacaaggtta

SEQ ID NO: 248625 - DNA, 463 bp, Homo sapiens
gccgaagccattcatgtgaaccctctttatattctgataccttctactctgtgtacttcatttgcattcctcctaccagtagcaaatccacccaatgctattgtcttttcatatggtcatctgaaagtcattgacatggtgagttagctgaaaaaaatactatcaaatccaatacacatcttggtgtgtgccatgtcttgaattatcttcccttttatacaccaatcaaccaccaggaaaagcagggcctgaattctgtttatgaatgcagtgtgcatgactaatcacaaaattgtttttaagagtgattatcagaagtgaacatgccattaaaacttacggtcacaaacagagagatgttgaatgcatcattaatgctttggacgaaggaaaagagcactgaacatgctccacacgacagcataaacctacaagtcaacactaggatccaaactgatccagg

SEQ ID NO: 248626 - DNA, 437 bp, Homo sapiens
cctttctttctttctttctctctttctttctttctctttttctttcttgtctttctttcttgcattttagacagctaaaaaacacctcaagttgttatttgatgaggaatagcagttgaggccttactctctctttgtgggaatgatgtgccttgtgcttctttgaatatgttgtgtttgctttcaggtctttactttaggcaggagatacattcccaagaccattcacacaattgcagccagaggggtgaactgatggggagaatttgtggctgtgagactcttgttctttgaaaagatttgtgggtaggtggcaaattcctgtctatgccacagagttgtgtcacatccaggcccaggaaatgcctggttatgcattagttgtttggtagaagacattcctttgggctgtgtggtctattctctttgtgctaacc

SEQ ID NO: 248627 - DNA, 1467 bp, Homo sapiens
  misc_feature (22)..(22): n is a, c, g, or t
  misc_feature (28)..(28): n is a, c, g, or t
  misc_feature (39)..(39): n is a, c, g, or t
  misc_feature (72)..(74): n is a, c, g, or t
  misc_feature (85)..(85): n is a, c, g, or t
cgagtgggtccctgcctggagngctggntctcctcgcgntgctgcctgtgctcctcctgcagatcactgttnnnctcgtcttccnctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataa

SEQ ID NO: 248628 - DNA, 1917 bp, Homo sapiens
  misc_feature (22)..(22): n is a, c, g, or t
  misc_feature (28)..(28): n is a, c, g, or t
  misc_feature (39)..(39): n is a, c, g, or t
  misc_feature (72)..(74): n is a, c, g, or t
  misc_feature (85)..(85): n is a, c, g, or t
cgagtgggtccctgcctggagngctggntctcctcgcgntgctgcctgtgctcctcctgcagatcactgttnnnctcgtcttccnctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgcgccactgcactctagccggagtgacagagtaagactctgtctcaaaaataaataaataaataaataaataaataaataaataaataaataaataaataaaaaataa

SEQ ID NO: 248629 - DNA, 738 bp, Homo sapiens
atttctgcactgtaaaccttcacctacattttctagtggacctctacatctgttgtctgcaccaaacagcatccctacctttaggaaaactatctcccggtgtctcatggcaaagggcaaatgagtctctctgagccctggtttttgcagactcagcctcacaggacacaaacctgaaacgcagttgctcacaccctgtgtttacttttatttccagccacatctggaggccaaaattcataagtttgttgccaagccttacaacagtttactgagtttgtacgttaagggaagggggaaaaaatgctctcctgacttgtcgagtgtaaaatggatggaggaatcagtgggcaaaccctaaaccccaaccatgtttattaacatctgcggcctgccggcagacggggaaggcgtgagcgggctatgtttgtcttggaggttttagctcagagagctccatggtgtacgctctccatatatatacagccaggcatctttttaacccaccagagaccaggagagggaaacaagggctgttcagaagcggaggagcccaggtccgataggggaagagcagggatgggcacttggccgtgtttacaatcagggcagtgcagtgggtgggccgattcttgtgacgtacttgaggcttaaaaaacgatcataaatctaatgtctgtcaaacagggctggcattttcttttcctttcacaactacgttttgtatgaccaaaaaaa

SEQ ID NO: 248630 - DNA, 273 bp, Homo sapiens
caggtgatccgcccgcctcggcctcccacagtgctgggattacaggcgtgagccaccgtgcccggcaaaattcacagttaaatgtagtttattgagttgacaaatgcctctgtaatgtaacccacattccttgagaacatttccaaactttcagcaagttcccttgtgctgtttcccagttaatccctgccatatccccaatcactgtaggtaagttttgcttattcatgtaaaatggaattatgctgtgtgtacccttctgtatctagcttc

SEQ ID NO: 248631 - DNA, 391 bp, Homo sapiens
ctgaaattgtccgaatttggccagtgtattatattaagtgatagcaaatggagagaaaagaagaaaatgaatcttgacgagtgagctgccatcatttctgtggcagtctttaccaatactgttaaatttctacccattggatttttcaggcttctaattattggtatgtatattatatgtggtgtttgtgtagccactcaggattttaaatttgctttggtttggtttttttcatgttgaattaggtgggaatgtttgaaataaacaagaagataagggaagggctcttttctttccttttaagttccaggatacatatgcagaacgtgcaggtttgttacttagggatacgtgtgccaaagtggtttgccgcacctgttgacccttcctc

SEQ ID NO: 248632 - DNA, 364 bp, Homo sapiens
tctcttctttcagggtcactataaatgaattcctctattgatggccagtgatggtgggaatggggtggcccactaggcccctttgtcttttttgtcactgcctccataaatgtggtccttgcccctcctccttccaaagccatcttcctccacaggctgctgtttcctggtggtccctcataaggatgggcctccgcctggctcccactatggctcctcactagtattcccggaatgggaacaagcgtttgctgtgtccgagtcttggctgtattgcaacttcacgtgaaagccgaagggcctgtctgtatttggagcagacatagcaatgtagaagcaaaatatacatctcggggaatggagc

SEQ ID NO: 248633 - DNA, 727 bp, Homo sapiens
tatgcaatatgttggactagcatctcaaatatgaaaaaggcattgccaacagtgatataattttttttataacggtaagctttttaaagtataatcttattttaacctaaaatcttactatcagaaaatgcagtgtacattaaaatgttctgaaatgctttattcacatttattaaatggttgtactcactcagatatctacaaattggtttttcacttatgtaattatcttatagaatgttcaaaagtcatgcagaatgtgagataattttctattgaatatgattgttttatcattgcaagacatcaaacatccctgtttcctgccaaatgaatgtacaatagcaataaatgtaaagatgtgttttttggaaaagacacatttttgagttataaaacaaggattttaaaacttgaattgttacagtgagtatgtcttaatataggctacagtcactttagataaaaaattacctcacatctattttcaatattacttaaagatgttcatttagtggcaaatatttttttttttgcctagaggcagatattttgccacatggctatttatgaaactgtatttaaatgcatgtacacatataaaagctgccactgtggctgtaaactattacaagttatcaagattaaaaaataaacaaaaaatatttcagtttttctatgaaatgtctttactcgagtccaaatttagaggtttaaaatgcttcaa

SEQ ID NO: 248634 - DNA, 371 bp, Homo sapiens
tcctacactcagatcatggatggatgtctcaggtcttcccaggcacatttgatgttatgtaccagccatatgcatgtgtgtgtcatttatttttcactctacacaagtagtacctaatatggtgaggttgttatgattacagactctggaggcaaagttcctgggtataaatctgaactctgtcactcccaagctaagtggctttgggcaagtgatttcacctccatgtgcctcagtttgctagtctgtacaatgggatggtaatagcacctacctcatggacttgagaagtcagcaacttcatacctctaaagcccttagagctagcagtgtgtggcactcaataaaatgttgactaatgatgattctca

SEQ ID NO: 248635 - DNA, 377 bp, Homo sapiens
cagattgaaaataaatatggaaattactgaataaacttatcagacagtgataaggtaattcagtagagaatgattagattgctactttattctgagtttcactagagaagaaatatttaaactgagatctgaataacaagaaagaaaattcttcggggaaggagcattccatagggagaaaacatccatggaaaagaccttaagcctgggataaacctgatatgctcaaaacaaaataaaacatacacacaaaatgtcagaatgaatgatgcaatatattggatgaagaggaatgtgatcatatcattgtcatcctaatgacgacccctttgagagtgaaaggagatgatgctctgtataataataaccaggccaca

SEQ ID NO: 248636 - DNA, 445 bp, Homo sapiens
aaaaggtgaattaacttccacaagttcacataattggacgtgaagccaaggctacaaagcccagggttcatgacttccagtccagtgttctgcccactttatcagaatgcttccaataccacatcagccacccatggccaaggcccactcttcatacatcacagggaacaaaacctaaaatcttacactgtactattcaagccattaaaaatactttcactgcttctccaaattcacttctctttacccagtgctataatccctcttccttaagtcattctctttgtcacattcttaccaacatatctccgctactagattggtacacataccataccctggacagtcatttacttttatacacattacagccctgagaacaaactgcaagacccataaagagtcaaataggtttgcattttcaattctaaattcagagagagag

SEQ ID NO: 248637 - DNA, 324 bp, Homo sapiens
gatctcctgagctcgtgatccgcccgcctcagcctcccaaagtgctgggattacaggcatgagactctggtctttttaagtgattttaggtactcatcaaccaacaaacattaagaaacaacactttgcctacttgtaccagctgacatgaagcctgcagtacttgcccttatggaccttcaaactcacttcaattattcccttctggcaccggagaccgacttatgtcatctaaaagtcaaactaaaatctaatggcattaaaacaattcaagctcaggaatgacagccagcttgaattaatacatagtctgactttgaaaac

SEQ ID NO: 248638 - DNA, 337 bp, Homo sapiens
ggcaacaaagcaagacctcatttctacaaaaattaaaaaattagcgggtgcaagagcatgcacgtgtagtcccagctacttgcgaggctgaggcaggaggatcccctgagcccaggtgacagaggccacagtgagctatgattgtgccaccgcactccagcctgggaaacaagagcgagaccctgtctctaaaaaaacaaaacaacaaaaacaaacaaaaaaaatcatagttctactaggttgaaaatcgttatgttttggcaagtttctggcttaattaccaggtttaaaaataaatgtgtgcagtttatttcaattatacatcaagaaaaaaaaa

SEQ ID NO: 248639 - DNA, 480 bp, Homo sapiens
aacaaacaaaacattgttttaatgcctctagacatacacatcagtagccagtgtgcaccaacattgccctcagaaagtgataacttttaaaagttttattctcattaaattgtaagaggcaaaaaagaatgcaggtaggtactcattacctaattaacagtaacattctggaaagaacaaactttaagcagcaagcttggtgcacacaagccttgagaggccgctttcctccgggtccatctctggctaacaagcattgtccagaattaccaggatggagctgacaacctgacacttgccgcagagctctggagcacgcctacgcctcaggactagctaaagtgagccacacatgtgcagttgccctctttcatagcagaagtttcaaggtcttcaacccccattctttgactgagccactgaacagcagccagagctgaaccttaatctgttcccatcatttgttagctgacaaaatga

SEQ ID NO: 248640 - DNA, 462 bp, Homo sapiens
tcattttctccaccccccattaggccatcacttttatttcttgtgcatccctctagtgttttgttataaaaacactagcaaacttcttattctttctgctttctgttttgtgccatttcagtagagagagcgcctccttgctgtggtttacagctgcacaatagttcattctctgatgggtgcgcctttgtgtatttatccattcccctatacatgaacactggggtctgatcttttactatcacaaacagtgtcgcagagaataacctcgttcaagtgtcattttgtactggtatggctggaggacaaatctcagaagcaggactgtggggtcgaaagcaaatgcacttgtaatgtgtaatgttgacagtgagccacgatcactccaccgcactccagcctgggtgacaaagtgagaccctgtctttaaaaaaatggaaataaaaattcacacttatattc

SEQ ID NO: 248641 - DNA, 482 bp, Homo sapiens
tgctggaaagcctgctctccctttcccacagagtaaaggtaaagtcctcacgccagcctgcaaggccccatgtgaccttggttgctcatttcctctctaacctcatctcacatttgtccccacagctcactctgctccagccatccagccctccttgctgtcctttgagcaggctgaagacgcccagcctcaggagctctgccctggccagtccctctgactgctaggctcctccgccgggcatcctcacagccaactctcaccaactccagatcttcgcacaatagccatttcctctgttaggcctgtcctgtccaccataaggaaacttgcaactccctcagcccacagagcacctctcaccggctaacatactctgtggtcacgtgtttgctatctgcctccctaatgtctttgagaacattagctccctgagggcagaaatctccttcactgacatatcccgagccctatgcagtctc

SEQ ID NO: 248642 - DNA, 113 bp, Homo sapiens
aagttttagacagagcctcagtcctttaaccaattgcaaattaaagaatctctgaatccccgtaaaacctgtaagcccccacttcaagatatcccaacttttggggccgaagc

SEQ ID NO: 248643 - DNA, 217 bp, Homo sapiens
acagctgctttttatttttttgtctgtatcagctattggctcctatccccgcctctgggatccggcctgcgccgcggggtcctagggggccagcagctgtaaagcggtacgggattccgcaccctactccagcaagaaagagcctgaagcccctccccacctttcccggccagggcgctcttctacgtcccgcgcgcggacagccggggcgaagtag

SEQ ID NO: 248644 - DNA, 174 bp, Homo sapiens
ctgtcaatactaccaaagtctaacaacgacatgatttttaaattcctcttatcattcaggaggactgaagaagatgtgcttgccgaacaatgaagaaaagaacagctgacacactgcctaggtaactttaaattctactcaccaaactaactacatttgtccttaatacttttc

SEQ ID NO: 248645 - DNA, 274 bp, Homo sapiens
aattcatggtaatttcattcttctctaaaaccttataacagttccaaatataactggtacataattttcagtgtggatattgaagcctcaagttagaaattgcataattactgtgtaattatgtggcttttggtatgtatacacactgagtggctgcagaagggcttggttcattttgtacgcttataaactattcacctgctttgctggctttcttgaatttgcattcgtatattcaaataatacctcattttatgagcatttgcccatagcc

SEQ ID NO: 248646 - DNA, 260 bp, Homo sapiens
taagaaagtaaaggaataaaagggtgcgtactctatagacaagcagtcctgagggctgctggttgtctgtgtttatggttatttcttgatcatatgctacacaagggatggattatttatgagttttccaggaaagggatggggaagtctcagaaccgtgagtttctccacctttcaggccttatagggtaacttccagacatttcatggcatttgtaaactgtcacggtgctggtgggagtttcttttggtatgctaat

SEQ ID NO: 248647 - DNA, 377 bp, Homo sapiens
gcatgacgaagcccatgtaccctctcagcaggtgaaggaagagcagccagagcaggagggctggtttggaaccaggacccctgagtcccagacttatgcccatcccccaggcagagggttcacactgtcatccccctcaccacactctgtgcccctgcacccagcaaagccaccctgcttggatcagtgtccactgctggacgagacttgaggaggacatcactggagactttgccagggccctgggcctcggacctcagtcccaggacgtactctcagaccgttccaaggagcgctgtcttttggccataatgttccctctagatgcacattcccctttggaaacttccattcatcaacttcattgcatagagaaa

SEQ ID NO: 248648 - DNA, 433 bp, Homo sapiens
cagtgttagatgtgaatattattatatagccttgggtagcttttatgccaaatggcagagagaagatattgctcacttaagagactacagaatttcaggtagagtttatgtcaagttgctctttcttttaaagaaataaatcaaggccaggcatggtagctcttgcctgtaaacccagcactttgggaggccaaggcaggcagatcacttgagttcaggagttcaagatcagcctggacaacatggtataaccccatctctacaaagacatacaaaaattagctgggcatggtggcaggtgcctgtagtccaggctacttgggaggctgaggtgggaggatcgcttgagcccaggaggcgaaggttgcagtgagtggagatcatgccactgcactccaacctgggcaacagagtaagaccctgtctcaaatta

SEQ ID NO: 248649 - DNA, 370 bp, Homo sapiens
aaatttaaaggcaggatacagaaaaaaataccttaaaatataatgacaagacagtcttgcaagcaaagaaaaaggtgaaacatgagtaacagtaaattgccaaataaataatattataggcatatacgacatgaacaaaagtaacagaaaaaacccatagtggacctaggcaactaaattaatttgatatgcttaaagcataaaatggtggcgaaaggggctgaactacagttaaaaaaaaaagttggataagggacgggattatgacggctatttccgcccatgcaaaaaagtacattttagctgtttagtaatgaggaaccactggggaagtttcagtaagggaatgacatgtatacatctcgtttgg

SEQ ID NO: 248650 - DNA, 221 bp, Homo sapiens
gatcagctgacaccacccaaaccaataatatagctgctcagccagtctgccatcccacccagggacaaaagacagcaagaagaccacccttcaaccccctatgattccatctccaacctgaccaatcagcagcactccccacttccccagcctctacctgctagattatcttgacaaactctgatctaataataaacaataaaactccagtcccccacaca

SEQ ID NO: 248651 - DNA, 398 bp, Homo sapiens
ctaaaagcccaacaatgttttcctaaagaacagggcattcgctcttcatgagcaatagaaaacaggagccacaaagagccaagcagcaaagggcagagaatagatctagatagatgatgaagaataaccagtatacactctctgtcctcttaatctgttttgttgcagactgatgttttactctatgtctatgcatatgcacatatgcatgtacgtatacatgcgtgcaacttgatggcaaagatcccatcttgtatgttccttgtcatatcaccagctcctacggcagtaactgtcacatagtaaatattcagcaaatattcttttgagagaacgaatgaagatgcaatactattaaatacattcacaatttctcaccttgttcttttcactcaaca

SEQ ID NO: 248652 - DNA, 667 bp, Homo sapiens
aatcccagctacttgggaggctgaggcaggagaattgcttgaacctgggaggtggaggttacaccattgcactccagcctgggcaacaagagcaaaactctgtcaccagaaaaaagtaataaaaagaagaaaaaatttactgatgttgataacttactatgggtaggaaaatcctcattcttaggaaatacacactgaaatatttagggataaaggccatgatgtgtacaactttagttacctaatttagatcattcagaaaaaaaccacacataacaaaatgcaaaagggccaaaatattaccaataggtgatggggtaaaagatacatgagtattccttgtactattcttgcaacttcgtaggtttgaaattatttcaggccaggcacggttgctcatgcctgtaatcccagcattttgggaggccgaggcaggcagatcacgaggtcagtagttcaagaccatcctggctaacatgatgaaaccccatctctactaaaaatacaaaaaattagctggatgtggtggcatgcacctgtactcccagctactcgggagtctgaggcaggagaattgtttgaacccaggaagcagaggttggagtgagccgagatcgtgccactgtactccagcctgggcgacagagcgagattccatctcaaaaaa

SEQ ID NO: 248653 - DNA, 157 bp, Homo sapiens
gaagtggagttgcctgagcaatgtccactcttcctcagctaccagaaaattcctctggatagtggtcacaggagccgattggctccccaaagaggagttccttaccagttttaaatctggaagctgagggaggaaaagacaattgtttggcaaagaa

SEQ ID NO: 248654 - DNA, 254 bp, Homo sapiens
gtgatgatgaacctactctttctttgactttgagggagtcatttatagtcctccaaatgaagaaacttagtttatttctccatttctaaaaacactgtctttacttggctagaaacattgggggaaagaacaaaagatgcattgttttataaagctcctttaaaaccagcaaatcattttcacatttatattacttttgtaaagtcttttcaaaatattacatctatggtgttataaaaaccaattgtaaatcc

SEQ ID NO: 248655 - DNA, 373 bp, Homo sapiens
catttctggacccactcagggcctgggggacctcactgccttgaagggaaaaacacaggcctggctagctttgccacttggtaagtgtagtggaagagaacaaaagtatctccctggtaatctagagaatcatcacagattttgtccaacaccatcaagccagtacctatacaagtttgcaagaaccacattattactgggcttggttccatatctttaaagcaggtacagcttagatcacaacaccaagtccttgtgaatatctggaaagccttttcaagaagtacaggtacccagacagtgacaactatatgcctaactcttcaatgcccggaagaagacaaacatctacaagtatcaatacattccagaa

SEQ ID NO: 248656 - DNA, 277 bp, Homo sapiens
aatgaactgaatctgttggaattgataaaggatggtgtggagtggcttgttacatgagtttgagtgacacaaacatgtatgaggaaaaactttcaccatttcagctatatacatattctaggaaattaaaggcaaaaaaaaaccaaaaccttagattagacattcaacatttaattgaagtaatttatgggaattgctaactctttatagatgaatattgtatggtaattattatttattcattcagctaatgtgggtgagcaccttctatgtacca

SEQ ID NO: 248657 - DNA, 323 bp, Homo sapiens
ttcaaaaacaggaaagtctcttgtttgaaaaccctctaaagcaacatgtgggcttagaaaagaagccggcttgtggtttggtgattgtacttccttattgatataatggccgctgacgcaaggcctcctgggattgcagcgcggtgaccgcaggcctgacggttaccctgaccgggttctgaaacagcccggggctttcagcacagatgagaagtctaaaaatttcccttttcatttcctctcttgtgtgactttgtcatttttaaaaaaactggtcacagaaaagggaattttgcccatgcttttaaggagtttatctcgac

SEQ ID NO: 248658 - DNA, 1268 bp, Homo sapiens
atggggaaagtgtcctgctgtggcatgaaataaatgaaacagaaaatgatggcaagactgctaagaacatcctttgctttgctcttccttggcctctttggggtgctgggggcagcaacaatttcatgcagaaatgaagaagggaaagctgtggactggtttactttttataagttacctaaaagacaaaacaaggaaagtggagagactgggttagagtacctgtacctagactctacaactagaagctggaggaagagtgagcaactaatgaatgacaccaagagtgttttgggaaggacattacaacagctatatgaagcatatgcctctaagagtaacaacacagcctatctaatatacaatgatggagtccctaaacctgtgaattacagcagaaagtatggacacaccaaaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaatagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacgacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgtttaccattta

SEQ ID NO: 248659 - DNA, 701 bp, Homo sapiens
tcatagtaatgatgataataacttacatttgcacatcactttagcatttacaaaatgttttctcatccactatctcaattatgttgttattattgtgctcgtgacatccacatatcaggggtgaaagatgatttccattccagagtatattttcagggactaatctaagtgtaaataccaacctcactatctttctcctcctaaaccctagacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgtttaccattta

SEQ ID NO: 248660 - DNA, 1335 bp, Homo sapiens
atggggaaagtgtcctgctgtggcatgaaataaatgaaacagaaaatgatggcaagactgctaagaacatcctttgctttgctcttccttggcctctttggggtgctgggggcagcaacaatttcatgcagaaatgaagaagggaaagctgtggactggtttactttttataagttacctaaaagacaaaacaaggaaagtggagagactgggttagagtacctgtacctagactctacaactagaagctggaggaagagtgagcaactaatgaatgacaccaagagtgttttgggaaggacattacaacagctatatgaagcatatgcctctaagagtaacaacacagcctatctaatatacaatgatggagtccctaaacctgtgaattacagcagaaagtatggacacaccaaaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaatagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacggtatgaaagaccatcatcaaacaacatgctgtataattctgctgttgaactgactagggatagcttagagaaatattttgagtattcagagaaagagagatgaaaaaagggagcaaaagaaaaggaaaaaggaaagtcacggatcagttcaaacatcagccggctatatgagtcaaccacaaaagtatctcacaaccatccagccacgggccagtgaaaactcagtctccatcctctgcttggcaaggggccatagccatctccatttcttccattccctgagtggttattttaagccttctttactctcaagccctttacactactctgcaccctcactcatggcttccttttttccttcataaatagaacaatgttcactagggagaaaccacttctatatgctaccccccccccacccctccaacaatcttatctgttctccttcctttttgcagggtttctcccacccccaaagaagtgatgcaccccctatgctctgaaacctatctcagcctcagcataccttgatttgtccacctgatctgttctctgtg

SEQ ID NO: 248661 - DNA, 688 bp, Homo sapiens
catggaaacagcctgaattcgccgtagccggaaattagtgttccatagtcccctgcatctttattcactgcacttctgaaatccctccgcaggttaaatggggatagtgggcaaaagaaggaaggaaactcataattaagcaagtattttctggttctggattttgctagagaggccctgcggttttccacctggacagatacttcaatgaagcacaacttcgttgccacgtctcccgtgaggttttccccgtgatattagactctggagccaagcagcctgggttcaactgccttttctaccacttagtagctgtgtgacgttgagcgggtcacttgactgtcgtgtgcattgttttccccatctgtaaaatcttagtgtccttaaccacgtaaaacacttaggacagtgcataggacgtagggagaactatagttattcattcaaggtgtacgttgaatgaatcgatcccttccctgcaaaaaataaataaataagtaacaccacacacaaaaagaaagtgaattgatttttcccatctgggattgatgtctccctcctccgcttgtcgcctaaagcactttgttcttctcatgttgcatttctactctgttacagaaatgtgtctctatagtccatgtgatatctgtaaaccaaaaataaaagtctaagccccccaactgactgg

SEQ ID NO: 248662 - DNA, 218 bp, Homo sapiens
agaaacaggcatttcagaggcccattcttgccacgttgtcagataagtccatgtgggaaaaagaggccacctttgggaggtaggattatgggtaaatgttagtatcttcctttcacccttctgcattttccagtttttctataacttttttttttttatggagaagaaacaactccattatgtgtctctaagtcaaataaacaggccctcattatacc

SEQ ID NO: 248663 - DNA, 428 bp, Homo sapiens
aagacctcattttgttgctgaggcagagctttgtgttgccatagagacagaaatgccaatttgtagagactcttagactcccccgaatggccttccagagccaaagcaaaacataagcttcttttgcagtgaaaaggacccatctataaccctcctgtgggtccacgagatggtatgcttgtgttccccttaaggttttttttttattttttgcctgatttttacattatgtatttgtatgtcagattacacgtgtgtttgtgtgaaccataaatattctatttttttagatttatgcaaagttgtgttttaccttcataatttaagaaggaaaaataagcctctagaaacataaacgtggtattattaggagaatttcatcgaattctggtgggcaaatatgacaactaatattttataaaaaaaga

SEQ ID NO: 248664 - DNA, 442 bp, Homo sapiens
aagacggaacacatttctacacccagtgactggccaggtcccagaggaaaacaaaaaatttgacttgaaaatgtaagtgtgtcccctacttgctgtttgggctttctgcccttaaccactaccatcccactgcctccttgcagctggaaagcagaaggcaacagggaggggaaggaaagcagaagggctttgcagtcactcacctcggttctgaggactggaagcatctgagacccatctggcttgacaccctcatccacttttcctagggtctagcaaaagccagggtggtgcaccccacaggttgagctgatggagtagaagacaggtatgaggctggcatagcacccaggggcctttgacggaagcgctgagaaaatctgatatgatcatgagagccaaatgctaattcctctcactgtggatcctggctcaccaaatg

SEQ ID NO: 248665 - DNA, 337 bp, Homo sapiens
ttcctttatgttctactttagataagatagattttcttagtttgggttgctgttaacaaagtaccctggattgagtggcttataaacaacggacacttcttcctcacagttctggaggctggaagtttaaaatcagggtgccagcatggttgggttctggtgcagggtctcttccaggttgtagactgccatcttctccttgtatcctcacatggtagaaagagggtgagtgagagggtcccttttataagggcactaatctcatcatgagggctccatcctcattacctaaaaatctcccaaaggaggggggagggatagcattgggagatatacc

SEQ ID NO: 248666 - DNA, 569 bp, Homo sapiens
tgatattcctgcattctgtgggaggttattctttgcattgtaggatattaatagtatctttaggctataccaccacataccagtagcatcaccacctaatcattataattcaaaatgtctccagacactgacaagtgttctatggaaacaaagtcattccttgttggaaaccacttgtaaacaaaaagtctagtaatggtggaattatacagtgacagaaaagctcaggtttttctgattaggttgaaaaagctgctcagaaattaaatcctactgtgttcataaaaaacaaggaacccagccctgaagcaaagaactcatcagggaagttgttttctctttcaagtctatgatttcaaatgaccttaaagtggtcatctttacagtcagagaagcatatgtgtgttggggaggagaaaaaagaaggaaatgaggcagactttagaattatacctaggaaagaactgtatgtttggttataaactagatccaataaataaataaatggtttccacataactacttggcaaaggtacaataagcctattgtgagaaaaaaaaattaaggc

SEQ ID NO: 248667 - DNA, 484 bp, Homo sapiens
tttactctctaaattacttctccatttttcccctttgtttttctcttgaagaactggactccttgaccaatagggttttccacagtgcgagtcttgctaattgcatgctcatgattcagctcagtatatccctcaatcctctatttcttgcaaactggcagctggattcagagatttaatgaaactcaggtttgccatataggaggcacaaaatgtctggttgtctctcctgttgagatgatggtaggtacaggtgctaaaatgtctacgtgggtggtgggttggggagaagttgttgcaagatggtggaattctaagtctaaattttacgtttcatttataagttgaaacactctttatttttatttatttattttttgaaacggagtcttgctctgtcacccagctggagtgcagtggtgtgatctcggctcactgcaacctctgcctgggtgacagagtaagactctgtctcaaaaaaaaa

SEQ ID NO: 248668 - DNA, 365 bp, Homo sapiens
tttttttttcttaatcacttttatggggtttggttttgtgtttgtttggttgtttgttttgagacagagttttgctcttgtcgtctaggctggagtgcagtggcgcaatctcggctcactgcaacctccacctccagggttcaagtgattctcctgcctcagcctcccgagtagctgggattacaggcgcccacaaccacgcctagctaatttttatatttttagtagagacagcgtttcaccatgttggccaggctggcctttaactcctgacctcaggtgatctgcctcccttgacttcccaaagcaggaggaatggttgagctcaggagtcagagaccagcctaggcaacataaattaaaaa

SEQ ID NO: 248669 - DNA, 348 bp, Homo sapiens
actgtggcttcttcctagctctctcttttggattgctcattttgggggaacgttagcggccatgtcatgaggacactcaaacagccttgtggcctcctgccagcagctgagtcccatgcccaaagattctctcagagctcaaaataatctattttatctgcggttatattctttacttaatcctcatactgcttttgggtttttctcaccaatctttggttatgttaagtttgtgtttgtgttggcttattgcagatttggtttaggttcattgttcttttaatttttatttatatttagccaattcaataatttctttttatctgtattaaatctttctttgaaaaa

SEQ ID NO: 248670 - DNA, 388 bp, Homo sapiens
gcaaagggaactctgatacactgctgagagtataaattggtgcaactatttcagagactaacttacaatatctaatatagttgaagatgtaatatccaagaacccagtgatttggctcccagatattaacttctggagaaagttttgcatgtgcgtacaaggaaacacatacaagaatgtgtattgcagcattgcttgtaataatggaaattggcaacaaaatattaatgatagggttgaccaataagttgtggttgattgttttactggccaataaattgtggctgatttttttactttaacataggagttagaatgaataaatttagagctaaatctatcatcatgaatcaaccttgaaaacaacattcagtggaataaaaagaaa

SEQ ID NO: 248671 - DNA, 437 bp, Homo sapiens
caaggagtaatgctgcttttcacacagaaagggcttctactgtgcctgaccttaagacaggaaaagtaggggagctaaggaagctacctacaccgccctcacccccagtagccaggctcaggaaggaagaggcacagcggtgtgaatggatggagaagaggaggccggtaggctgagcccctggctcctggaacgaacacacagccatggcagaggagaatgtggcttgaataggttccatgacttgtacaagaccacagctggtacatgatgaagcaaggacaagacacgggcatctgacctcaagagtctctccaatcatgaaatacctgtatgagttatctattgctgcataacaaattgccccaatatttagcagcttaggagcaggattgctggaatggtgggataaaacttagtggcttaaaacaaaatct

SEQ ID NO: 248672 - DNA, 468 bp, Homo sapiens
acagcagagctgttcaaagaataagaggaaaaaagccgtgtgtgcatgctcacccaaaaggctctgtgctgttgttctacattggaacaaaatctatctttgcaacaagtggatggaaatgcgtattaacgtatttgagcctcttgaggggttggaatatcagccttgccagccacagggcagtggtggacttgagcagagggaggaggaggaggaagagggctgagccactctctggcatcctcaggtcactcttcagctgccgttttgaggacattttgcaaggattagctcagggagagccccacagggtgcaagtccacactgccgagcaggacttgaatgctacgagttgtctgccttgggtctgggaccccagggtcaacgggacccagagaggcgcctgtcatctgtccctggaatcgcttctgattttttttaataaagttcatacaaatagaaattcta

SEQ ID NO: 248673 - DNA, 460 bp, Homo sapiens
gctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaaaaaa

SEQ ID NO: 248674 - DNA, 335 bp, Homo sapiens
ccccagaaactgcctgccatagagaccaatgagaattcatgaatgagctgggcatggcggcgcatgcctataatcctagcactttaggggctgaggctggaggatcactagaggtcaggagttcgagagcagcctggccaacatagtaaaaccccgtctgtactaaaatacaaaaatcagccggacgtggtggtgcgtgcctgtaatcccagctacttggggagcctgaggcatgagaatcacttgaacctgggaggcagaggttgcagtgagcagagattgtgccactgtactccagcctgggcaacagagcaatactctatctcaaaaacaaa

SEQ ID NO: 248675 - DNA, 435 bp, Homo sapiens
agaattcctgtttaatttgtcctgacaaccttcctctccccatagtagctgtcttgcacacaaaagatgctgtcatactacatttcaccaataggtggcacgaataatcatgacatttgctaaatccagttggtatttacacaagaggaaacatcatttgcagaaagttggcaattataggtaaatatacaaacacagaaattgaaaatagcctgtttgctctatgtaacacgcataaaacctgaatacatcccaattctaagggataattattgatatcattcaaactttctatttgttttaaggagaacatggaaaacgtatttcttggtgttgacgtttatctctacaatgtcaacatttttagtgttaaataattgaggccagttatgtttatttattcttccgcttaataaaagaaaaagtaaatagaat

SEQ ID NO: 248676 - DNA, 510 bp, Homo sapiens
cactaagcaagcagaaataaccctctggggcacaagcaagccaaagctggcaaatagtacacagagggaattgggaatacagagagagctggggtgttgatgttgacacaaggcctggatcacatggtgtctgtgtggggaaggcctaaggaaacaacaggagccaaggttaatgggcggatgagcggaggcggccaaggcgctgctgtgggcactgctggaaatggaggctggagagctgcaagaacctagtactcttctgtgcacagcttgtcgagattcgaatctcgacaagttgtgcatgagtccatttgcttaaaactctgaaagaataaagtggtaagaaaacaagaaaaaaaattgatgctgcattctctgatcttctccatttggctggtcagtactctactctggcatatcaggacggaggtgatcctctatggtgccaattgcccaattgggttgagctgtacctgtggcagggtagaggcagatgctgcacaagttgtc

SEQ ID NO: 248677 - DNA, 458 bp, Homo sapiens
ttagttggattgtctttttattattgagttctggatacaagtcccttattagatacataattcgcaaatgttttgtcccattttgttagttgtcttttcacttccttgatggtgtcctttgcagcatggaaattttaaattttgatgaagttaatcttatctatcttctgtcacttgtgcttttggtgttatgtgtaagaaatctaagatcatgaagaattgcctaatttaagatcatgaagaattgtttattttcttttaagagttttatagttttagctcatatatatatatgtgtgtgtgtgtatttttttctttttttcttttttgagatggagtcttgctctgtcaccaggctggaagcgaaactccatctcaaaacaaaaaacaaaacaccaaaccgatatcatcataatagttataagccttcgtgaaattcttggttgcattttgtcctt

SEQ ID NO: 248678 - DNA, 465 bp, Homo sapiens
agcttgtttattgctttatgtatgtaggtaacttcataaactcccaaaaagcccataattgatttcaaacagcaaaaagaaagttacatgataattttgcccttggcttgaaaacattttattggtagacgatataagagggagggaaagaaacagcttaggttagagacggaaaacctatcaatcttgggacaagttaaagagcttcaagaaataaattgtagagctggctgactcagccatagtagcaatgctataaatcacttgcagacaaggggcatcacagtgccccttcatgaggtgcagtcttaggtcttctgagtcttagctcctacatcactcaacctgaaccacaaattccccacctgagaagttaaatcacagtaaacttctgttctgattcacagaggggaagagtaatttgagttaataaaagttctgaaatgcatttttttaacctcacat

SEQ ID NO: 248679 - DNA, 743 bp, Homo sapiens
agtgggaaccgctagctttgcagaacgcagagtccctcctcaccctggcggtcccggtgccctggagtgcagtcgcggaatactgttcagcggctcgggtggttttccttgcgtcccgccacgcggcggctcctcactaaaaggctgccttctccccacagctccaggtccgagaggagccgcaccgtcgggttggagatcgcgcgcaagggtggcctctgggtctgcatctgccccgcatcggccacaggaaaagcctggtccctaggcacggtcgtggttcgagcttttcgttctctcgcacattgaggtattcgctcagcccaccacgttgtcctcggggttattaggccccagtcacaagccctatgatgttttcagacttcccaggtggagataaaggaaaattttactatttctgcagaacttctgttgatgtacagcattgtatttagcaacttctgtgtagatctgaaaataaatacattaccaattgttacacaacaaaaaaaaaaaaaaaccttcgggggcctctccatattgttcggggtgcggaaaacaaggcggtacagcgacaaaaggggcaccagggcacaaaaacagagagacccatgggccacagcatttctgtgtcccaacgggggacgactctgccgggacccccatattagggagcccgcatactttcggaaacccagggtaaccgcgattctgacccaggaaagagaaagcagacacgcgac

SEQ ID NO: 248680 - DNA, 402 bp, Homo sapiens
tttcagacttcccaggtggagataaaggaaaattttactatttctgcagaacttctgttgatgtacagcattgtatttagcaacttctgtgtagatctgaaaataaatacattaccaattgttagttgcgtttttattaatataaatcttagagtacttgattttgctgttagctttacttaggtaaattatgtggcactctagcatttttgttgttgcatgttccattgaactttgctctgtgttttccatttattccaaattcaaaatagactgtaacttcccaatttattctatgttcccaaggcaccaggcatagtaggtgttttatgaatacctgttgacttgaaatttctcagacttttaaaaaatttttcattactgacaaaagatggagcgata

SEQ ID NO: 248681 - DNA, 827 bp, Homo sapiens
tattgttaaacatttggccagctgcagtggctcacacctgtagtctcaactatttggtagggcgaggcaggaggattgcctgagcccaggagtttgaggctgctatgagctatgactgcatctgtgaatagccacttcactccaccctgggcaaaatagcaagactctgtcttttaataaaaaaggaagattaaaaatttgtatgcctttttcacaattcgttttcaactaccattctgagggtaaaggagaagctttccctttgttcctacgttaccactgaaacttctgattgattaaataaacaaacacagtagcattctaataaaccagtagagtttctccgtaaaaaaacaacaaagaattaccttctaggacaaaactgatttcattgctaaataaaataaagacaaaaatgtccaacacattattcaaatgtcttacttattgaaatacaaacggatgtatattacattattgtaaagaatcataaacccggctacagagttaatcatgtatgttcttagagaaaaatacaatgagctattggccaaacagctttatcaaagatcttattgtataaatatggtactgttggggctcagaaaccaataccccaaaatatggccctttgacatgctgaatggaagaagcctcaaggcctctgtgacctttcccatgtgctatctctcaattctgtatgacctcccacaaagcacaggctaaagttgttctctgaagttcccttacctccctggagtccagatttgccaaagaaaacaattacctccaaatcctgtccctgagttttcattaactgaactcat

SEQ ID NO: 248682 - DNA, 662 bp, Homo sapiens
caagcgtgaatctggaagaaatcaaaaccctgaacagactaatatcaagttataaaattgaagcagtaatgaaaaaacctagcaaccaaaaaaaaaaaaaatcccccaacaagatgaattcacagccaaattctaccagttatgcaaagaagaactggtaccaattctactgtaactattcaaaagaatcttgctaccaaaagttgtcaaagatacaacaaacaaagaaaaccacaggccaatacccctgataaacaaaaacacaaaaatcctcaacaaaatatggatggcaatccaaattcagcagcatatcaaaaagctaattcaccatgatctagtagacttagtacatgtgatgcaaggtttctttgacatgcaagtcagtaaatgtgattcaccatataaacagaattaaaaacaaaaaccatttgatcatgtcaacagatgcagaaaaagctttcaataaaatccagtatcacttcatgataaaaacactcaacaactagacattgaaggaacatacctcaaaataataagagccatctatgacaaacccacagctaatatcacactgaatgatcaaaacatggaagcattccccttgagaacttatatgagaaaaggatgctcattctcatcattcccattcaacatcgtactgg

SEQ ID NO: 248683 - DNA, 464 bp, Homo sapiens
tatgtttatcataattgaaatgttcccttttttaattacttgtgatattacatacattgaactttttgaagtttcaccaacaacaaaaaattgacattcaggtacagtagtgatctctcttgatatgggggatacatttctgtttataaaatggttattgagataacttcaaattaaaagcatatttgatagatacgctactgctcatgtgtgggagcctggaatttggaagtcattctatgcattgtaaatggagttgtaaatgttaagctgtgtgtatgcacatgcatccagacatccacacaaatatatgggcaactgtaacccaagttgggtgacgtataatgaagcaaacatgaactctgagtaatcagaaaaatcttaaaagagatgggaagaaatccatttttttttagttagtgataataaattttaaaactaataaaatattttaaactcagata

SEQ ID NO: 248684 - DNA, 469 bp, Homo sapiens
tgtgcttgcgcagtctctcggtgtgttttctaacatttcacaattaaataaggagtagttgatattcacagccaccatttccaccgtatatgtagagaaaaatgctcaaatcctagcgatcagcccgctgagctttcacaaaccgaacacaccgtgcggtcacgaggcggctctcccgaacaccggctctgcacccccagggcccggggaaccaagacttccccaagggcccagcaaaagtgagggaggaggggaggaaaggagggagagggagggaggagtgctggctgctttccgccagcgcctcgtttgggtttcgctctgctgaggcctgaaggcgccctgagggcccctggggggcagggaggggcggtggctgcggccgacagcaaggaacctccggagaagcgaagccgggccagacgtgccaccggggcctcggcgctggcgaaggggcgcgtgcggccgc

SEQ ID NO: 248685 - DNA, 391 bp, Homo sapiens
taaaaatgctggagtttggattaggtcaatgtttagaacttttgaggagagaacacaatccactttccaactaaaacaaaaaatctcggccaagcgtagtggcccacacctataagcccggcactttgggaggccaaggcgggtggatcacttgaggtcaggagttcaagaccagcctggccagcatgatgaaaccccatctctactaaaaatacaaaaattagctgggcatggtggcgggcgcctgtagtcccagctacttgggaggctgaggcaagagaattgcttgaacccaggaggcagatgttgtagtgagatcatgccactacactccagcctaggtgacagagtgataccctgtctccaaaacataaataaataaaatgaaata

SEQ ID NO: 248686 - DNA, 319 bp, Homo sapiens
ccagggatctaaaaaataaaagctatgccttgtaaaaacttacttgtaaacttcacaaaactgtcccatgtcaggtgctattgttttatactagcacttatttacaccttttcaacataggttaaggttttccaatgaggactgaaaaggcaaaaaagtagttaaatactgtttaaaaacattatccccaggtttaaactgcctctaactttgaagtcaaacaagagtttagcaattatagttgaaataatttaaaatctagcaaagttgcataaaataaaatgaaagttacacacagcctaccaacaacaaagttaaa

SEQ ID NO: 248687 - DNA, 671 bp, Homo sapiens
tttttttgagatagggtctcactctgttgcccaggctggagtgcagtggcatgatcttggctcactgtaacctccaattcctgggctcaagcaatcctcccacttaagcctcatgagtatctggggctacaggtgcacaccaccatgcccagctaattttttgcagagatggggttttgccatgctgcccaagctagtctcgaactcctgggctcaagcaatctatttgcctcggcctcccaaagtcctgagattacaggtgtgagccaccgcatgatttattttttggtttatctatgctgtttatttccttagactataataaaaaacagctaacattaatgagacttatttgatatcaaacactgtatactttaaagtatttatatcagcctcttaatttccaaaaccaacacttttacagatgagaaaatggaaacttagagaagtgaagggccatatccaaagtcctagagctaataattgatacagtcagtatatgaacccagttctgtataattttctcagggagtttttgtgacctgagttgttttgtctctagcattgttcttccctctatggaaatagaacttctaccaagagaagagatcaagcagagtgcctatggcccatcactgggcatcttcacttggcatctgaaggcacctatg

SEQ ID NO: 248688 - DNA, 232 bp, Homo sapiens
ccccacaagtggacctgccgaacctgcgtgtacagagtcggccctccgacacacgtttcacatggcaggaacactgtattttctccctgagtttggttgaaaaaattcacatataagttgacccacaaagctcaagcttgtgtggtacaagagtcaactgtatgcaattgacactgattcctaccaacgatatccaaatcttagcatgagcagcacgataaacagaatgagc

SEQ ID NO: 248689 - DNA, 371 bp, Homo sapiens
ttcatccttctacacaatgatgttgataggtcacttcactagtagagggtgcctctctgaagagatgattatgatgcaaccttcttgtgctggtttgttttgggtgactcttatataatccatgagataatgttggggtactggaataggagctagagaatataccagaagagaacacaatcatgcaacatctctcaaatatattgtattagtctgttttcacggtgcagataaagacattcctgagactggacaatttacaaaagaaagaggtttaattggacttacagttccacgtggctggggaggcctcagaatcatggcagaaggcaaggaggagcacgtcacatcttatgtgggtggcagcaggc

SEQ ID NO: 248690 - DNA, 846 bp, Homo sapiens
cctgaggtcaggagttcaagaccagcgttgccaacatgttgaaacagtgtctgtactataaatagaaaagttagccaggcacggtggtgagtgcctgtaatcccagttactcaggagtctgaggcaggagaatctcttgaacttgggaggtggaggttgtggtgagctgagatcgtgccactgcactccagcctgggtggcagagcgagactttgtctcaaaatgaataaataaatagacattgactacagggtaatttctatgattatattatttagaagtatgaataaaatgcatacatttgtgagtcttgaatacgtattttaataaatttcttatatatttttatttgaacatgtggcctctctgcctgcaaacacacagacttttaattttgatttacataaagttaaaaatatgcatgtattactctaaaccttaggaaagaaaattatggagtgagtgtgtttgtatgagcatgagtttgtacctattttcagaagaatagagcaatatcggaacaaatcattttaataaggtgattaatttgctagctagtaaaaacctcaaaaatgctgaaagcaaatttatgctctcagctttgtattaaattcattactgtaaaaccttatggcttaaggttcagaatctcgccatacaaactctttgcctggcactcatgccagacctataattttcttgttataattttttgttttatagtttatgaagtatccattacatgagttggtcgtgattataagaatgttttttataaaattcagtagtgcacataatttttagaagtaattccataattaatgtattttatttagaacattccat

SEQ ID NO: 248691 - DNA, 577 bp, Homo sapiens
acagtaaacacagcagggagaaaaggggagaaagtgactctctatcagggaagaagacctctccctgaagcctcagcatctttcctctgtgactcatcatgcccaacccatatggatcactggaaaagaagaaggggatgtcatgactgacttaggtctatcaagaatcatgccataggatacattgctacaacaaaagctgggttttaataacaaaagagaaaggaagaatggctgttgggtaggcaactaacatttgctataattcttaaatgtgtttcctgaagattattaatgaaaaaaagtatcagcccctttatctaccattttacactgattctttcaactagtatttataacatctactatatgttgggtactgtgatagaagcaggagcctcaaagatcatcaagacatagttcctgtcctcaaggtcaaattaaatgagagaacaattcgtcaataattcagaacagtatagcaaatgctgttaggtagcatatgcatggtatagtggggcaacagaatagtctgcagcatcttgaaaagcaatccttgaattgagttttagaggag

SEQ ID NO: 248692 - DNA, 523 bp, Homo sapiens
gatccagagagctcaaaaagcagagaagcatctttcctcataggcatctctgtgggaaaccagggacacagaaaaccaaggggttttggaaattagctacttaacttgctaggtgttctacccttgctgccacttcattcttcatgtccaaggtgcaggacgacaagcagagccttgcaacctcatctgcgaactaaactcccctagatagagctgtggtgaacctttgtaagtctgaaatctgtgcatggaatagcaggtacattatagcaagacatcagagtttacgattaagcctccaagtctcccaggggtcaggaaaccctgcaggtagaagagacggtttaattggatgctcaatgctgattccagagaaatcatcagaaaacctggaggactactctaaatgggtcagattaagaaaatgcaatttggaacaaagagggtaacatctaacccagtatcaagcatgcagtaggtaatgagtaaacatttgtcaagtgaataaatgaatgaatagcta

SEQ ID NO: 248693 - DNA, 336 bp, Homo sapiens
ggaaaagagtaccagatggggaaatattaagtggagtgatcagggaagctctctttgaaagaacaagatttgaacagagattgaaatgcagtgaaggagcaaaccatgcatagagttgggagaaaagcatttgaagaagtacaaatacaaaggccctgatgtggaaataagctttacatatctaaaggacaataagaaggcgaggtggctttctatagtagctgagctgaaaggtcctaagatagattcaagtctagagttgccactgtgggccacatgtgggaggacctcactgggatgccatggtttgaaggtgaggcatggaaccaacttgca

SEQ ID NO: 248694 - DNA, 491 bp, Homo sapiens
atactctgtctggtaaagttcttcagtttataaaatatgagtactttagtaaaagatcaggacaccagaatcttagaaataataaaaagaaaatatctttgatctttgatagtatgagattagcacctccaaatattttaagtgtttttttccttcactgggaacatataattttcagtttcaaatgaaaatgtttcctaatggaggatgggttttgtaccatgaaattactcatataacttttaaaaattagatttgggtggtatgcattgtataaaataactgtcttctctatcaaaccttatacttttgccaaatttgggcacatctacaaagacttctatatagatcatgaaataactgaagtcattaaaagaaatgtatcaagcaatataaatttattgatatctacttctccattctaatttatgaaaaaaaattagcttatagatagacatgtctccttcaaaatgaaatcagatttgttcatt

SEQ ID NO: 248695 - DNA, 486 bp, Homo sapiens
cggaatgcacgtctgaaagagtggccagaaacgagtgtgccgggcaggaggccagccccatctcaggctcacgtgcctctgacaggagaccagccccatctcaggctcacatgcctcgcggacagttggacgtggcctggggcccctgctcacttgagcatgtcgcccaccaagcttgtctgaggccacagagcagcgtcccagccctgttttccaggactggtgggtgccccagtccacggccctgccccacccgaactcctgcctcacggtgtggccttgtgcatccccatggcctgaccccgggaacagtcagaggaaggggtcccgccctcccaccagaggcctggacccaagggaacggcagtcagagactacagtccagacgtttgtgtctaggccttgctggtagctaaggaaatgccttctgttgggaaaaggtcaaatttaacatagcaaaatttttacttaattccactaatttta

SEQ ID NO: 248696 - DNA, 529 bp, Homo sapiens
agggaaggggcattctcagatgacccagtggcccaggaagggacctcatgagcttggccggtccactcaacatcttatcacaaagttaagcaaatctggtgtggaggagcatgctggctctccatgcacatagtgctggctggttctagagagatcatttggtctcaccattgcctggggctgctgaggagtaggggaagttgcctttgatttgtaagtccctttgagagcaagttcttgtgtggttccttggtttcccccacagtgtgcacaggaaccacatcttgcccttagtgcgggcttaatgtatgtttgcctgaaatacagttggtccttgaacaacttggtgtttggggttaccaaacttaaccactcctgcctatgcagccaaaaatttgtgtataacttttgacccccaaaactactaacagcctactgttgacagaagccttaccaataacataaacaacacatattgcgtggttatatatatcatagactgtattcttacgataaagtaaactagaga

SEQ ID NO: 248697 - DNA, 417 bp, Homo sapiens
cgctttctccacccgggcagagctgcggctcccgggcgttgcgcgtggcgtttttcatcacggagggaaagccgcggctccgcgggaaaggagtgaaaaccgagtgtgggtgaagaggagagggaggtcagggggcaagggaagaaagcagataaatgcatcttccctagcagccaagctggaaatttgtgctgaaagtacaacagcaagagttttcacatgaaaaacacgtgaagaacccgagcaagtgatagatccaaagacggaaaatgatcgtctattttgatagtaaaaataaaaagaacagaattgacatattttcgtctaaattacttttcatctgccgatatgaaacaccaacactcaaacaaaaacaaaggacaaagcagtttttaaaaacaacacaaaacaagcaac

SEQ ID NO: 248698 - DNA, 606 bp, Homo sapiens
tttggtttcttttcctaactgaactctgacaggtagagtcctcatgtccaggaataattccagaaaacaataaaaaaaaaaaattggttttcagaccaggacacaaacataaccatagtagatgagggctcactcatttactaaacttgaatgtggttattacttcattgctattgtaaaccaaaaataaaatttgaagccccctgccaccaacatctgaatggacccctcttctccgccaagggcattccaaagttagactgaaaaagtagtttcaagccatgctgggaagggggagtcagacatgcctcattatattctcctctcttttaaaattattgatagaacagactctttaagtctggttagaaacatttacaatctatctctctgaagtcttccacctggaggcttcatctgcgacacctttgtctctggaacaccttatggcaacccaggcattcctttctagagataatagttattgcaacaaattgccaatcataaaatttttgaacctctccaacttgaaagatcatgcttccagttgtactgcctttctggactgaaccaatgtacaacaccttaaatgtattgatctcatga

SEQ ID NO: 248699 - DNA, 187 bp, Homo sapiens
aaatacatataaaactaagagtttgacagacactttgagagttcagactgtggcaagctacatgttctccaaagaccaagaggacatgctgtgacattgccacagggcaacatcattccagctaatctctgaagccttgcctgccactactggcaccaccctcagccttgagggaccttacctgtgg

SEQ ID NO: 248700 - DNA, 504 bp, Homo sapiens
ccaaagtgctgggattacaggcttgagccaccgtgcttggccagtccatacacttttgttgagagttatggcattggtcttctggcaagggaagacttaatttaactggtaaacttatagactattccaaaaacatattcaaaccttttaagcagtgaaaatgaaatttatttataaatgttcaaatggtagattatggttattacatatgagttttcaaaaatgttgagtctttctggaaagatttattcttcagtatctgtgcaaagtttgaagtaatttgtctttgccatttggtttgtattttgttacataaatacatactcaagtctggagatggtttcaggcaacatccagtagcctaagaccattttaaggtagctggtgatctttttctgttttgtggggaccttttttgtaatgaacatttttttaaaattcagaatttagattaatcggttgtcaagagaggagagaaagcgataaaacagtttaggaatagta

SEQ ID NO: 248701 - DNA, 472 bp, Homo sapiens
atgtcttgcacatgtcagggccccaggtaggtggtggcaggagtctgggaccttgggtgggcctcaccagtcacacagccttggctgacctgtctgtcctcccatccagccagagggacacaaagacctctttgtctctccacccttccgcccagagcctccccagccagtgcagctctgagcgtgtcccccagggagggagacagcccctggtggggactggcagtcctggcagctgccctgaggcacaggccctgggggactcggtgctttgagggcaggggcaggtgatggagatcggctggggaaagggaggccgagaaggcggcagtgtggagcgtgtgaatttgttcatgaacttagctacaaaaatgtcttttccagtgtcacagctcttctagaatttgactagcaggttttccgatttttactggaaagccctttaaataaagaaagaaaaagaaaaaaaaac

SEQ ID NO: 248702 - DNA, 457 bp, Homo sapiens
ctgttaattcttaaagaattctgaatataaaaggtatcagtttatttaaagaatcaaggtgtgagtgtcacctttcctaaacttcagcaggctttgtggtttccccctggttttcttctgcattgggagccatccttgcactggccctgaagtggcaatgctgtcggtgtgttacaggtggacacagcagtgatttctctgtaaatgtttggcacaattcttgtattagacagttgtgaactgttcccaggtgtctagagtgtggcaagtcatccccaatgaatttattcttgggttatggaagtgactgcagacttgatagtcacccaaggctttttaaaaagttaacatacagcagaaaggaatcacgagcatggttaagtctcactattgctttgtaatctttaagatttattccttcaacatggcaacaccctgtctctacagaaaaaaaaaa

SEQ ID NO: 248703 - DNA, 406 bp, Homo sapiens
gacacctcctgacatcatcaacctgtctggcctaatctgaaaccaaaagccccattcccttttagcataagttgacatcccctttttgtagtgtatcaagaaatcctggctgggtgcggtcgcggtggttcgtgcctgtaatcccagcactttggaaggctgaggcgggcggatcacctgaggtcaggagtgggagaccagcctggccaacatggagaaacactatctctactaaaaatacaaaaattagctgggtgtggtggtggaagcctctaatccctgctactcgggaggctgactcaggagaatcgctggaacccaggaggcggaggttgcagtgagccgagatcacatcactgcactccagacttcagcctgggctgttaacaagagcgagactcgtctt

SEQ ID NO: 248704 - DNA, 550 bp, Homo sapiens
  misc_feature (19)..(19): n is a, c, g, or t
  misc_feature (389)..(389): n is a, c, g, or t
atgagattgcctaccattntataggatatttactatgtatttatacgttaagacctctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaagattgagtttttgtttgttatttctgaatggttcatcagtatgttaactataccttttatctanaaggaaaatcaaatcaactataccttttatctgagaaggaaaatcactcactaagttttattcaggctctaccaacccccattatatctactgtttgtttgtttatgtcctaaattaacctttcatcctatgaagtaataaagttcattttaaaccaacga

SEQ ID NO: 248705 - DNA, 376 bp, Homo sapiens
tgaaacctcgtctctactaaaaatgcaaaaattagccgggcgtggtgatgtgcacctgtaatcccagctactcgggaggctgagacaggagaatcgcttgaaccggggaggcggaggttgcagtgagcagagatcacaccactgcactccagcctggtttccaataaattcatccctaattggatccaggtgaacgctcctatcagcactgcaaaacgtcaaagtctccttacaagctttcctaggcaatgtcagtcaaaaacaaccaagatacaaaagcgcgagaattgactagaaaacgacagaaataaacaaacaaacaaaaacaataaacccagatccatagaagaggcaggaagaggaactgcttctgggg

SEQ ID NO: 248706 - DNA, 511 bp, Homo sapiens
aattcaagaatacttaataagggactccattaaaaatttatgttcatttcaatatatgtatgtgattattttgaaaatttatatgacttcctagtcagagattcgttactttgtaaaacactcaccacataaagatggtttataaatacaaaaatgacacaaagctctatgtcaggcagcaagtcggtggcagaactggatttaggattttgagttctgacttctgtcctgtcatcaggccactaatctgcttgattttctgaaagaatttgaggcctgaggaaagaatatgccagagacacatttccaaagagatgagtcacattgggtggtttgatataataaaatctgtgtttattttgcaaagggcttttgaacagatattagagaaacaaatttcatcatcatgttcaactttatactttgtaacattgtactttctgttccaatagttaacagcactaagttcatagttcttctcttcctgttctcttttgggagttttctattt

SEQ ID NO: 248707 - DNA, 470 bp, Homo sapiens
gtggttttcaattaaacctccttgtctctcctaagaacccttttcctcatttatgaagatgggacaataaatagtagccacttaattgggctattgtactgattaaacatgcttatccagccttctaagcctccataagtggtatttactataattagctctttatttgcctcaaattcttctctttctcagctgggcacagtgtctcatgccagcactttgggaggccgaggtgggcagatcacttgaagccaggagcttgagactagcctggccaacatagcaaaatcccatctctactaaaaatttaaaaattagccagccatggtagaacacacctgcaatcccagctactcaggtggccgagacatgagacttgcttgaacccaggaggtagaggttgcagagagccgaaatcgcaccactgtaccacagcctgggcaacagagtgaggccctgtctcaaaaaaa

SEQ ID NO: 248708 - DNA, 476 bp, Homo sapiens
tccccgggctgtacgaattcggctttaaagaaataaagtggattcctcttccagtttcttgcctagcttaaagccatgtaattcttgccagctcacattgtgacttttctggctttcaacactttgattgggatttaccatttaattaaataagcttaggagctggagggtggtgctgtccggggtcagttcagtcaacccctggttctctttgcacttcacagaatgtggattgtctctctgttcatgggctctgctgggctctctgagctcagaaccttcagatttgttgggtgggaccacaggtatgcaccaccacacctggataattgtggtttttttgtaaagatgggggtctcactttgttgcccaggctagtcttgaactcctggccttccattgttggtattataggcgtgagttgacaggctccggcataggccattttcctcccagattctctcccttttgtgctt

SEQ ID NO: 248709 - DNA, 1107 bp, Homo sapiens
cggctccctggcgttagacgtgctgtgttgtgatcacgtgggcagctccgggcgcggcgcttgttttggtttccttctaacttgcccacggcagcttcggggtgagcgactttcctgcaccagctgccgcgcctgctcacaccctgacctcgttttcgggctctctgagcccgcagttccgcaagcccctggggcgggctcctgccatgccgctagtccgctacaggaaggtggtcatcctcggataccgctgtgtagggaagacatctttggcacatcaatttgtggaaggcgagttctcggaaggctacgatcctacagtggagaatagatgagtacagcattctgccctattcattcatcattggggtccatggttatgtgcttgtgtattctgtcacctctctgcatagcttccaagtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaataaattgagaaatctt

SEQ ID NO: 248710 - DNA, 800 bp, Homo sapiens
  misc_feature (1)..(1): n is a, c, g, or t
  misc_feature (30)..(30): n is a, c, g, or t
naaccttaggctaggtacgaggctgggtgngctcggataccgctgtgtaggtgagtctccgccctgcagagctcggacgcgcagcagctttgtagccagaagaggcgcgctgccgtgggaacgcgacccagggaggaatgatgacatcgtaaggatggggttgtagagcgaggattggaagagtggaggaataaagggaagacatctttggcacatcaatttgtggaaggcgagttctcggaaggctacgatcctacagtggagaatacttacagcaagatagtgactcttggcaaagatgagtttcacctacatctggtggacacagcagggcaggatgagtacagcattctgccctattcattcatcattggggtccatggttatgtgcttgtgtattctgtcacctctctgcatagcttccaagtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccttggctgtgccggggggggtcccaggctccgggtggggcccgtttcgggcccggccggggcccttt

SEQ ID NO: 248711 - DNA, 1325 bp, Homo sapiens
cggctccctggcgttagacgtgctgtgttgtgatcacgtgggcagctccgggcgcggcgcttgttttggtttccttctaacttgcccacggcagcttcggggtgagcgactttcctgcaccagctgccgcgcctgctcacaccctgacctcgttttcgggctctctgagcccgcagttccgcaagcccctggggcgggctcctgccatgccgctagtccgctacaggaaggtggtcatcctcggataccgctgtgtagggaagacatctttggcacatcaatttgtggaaggcgagttctcggaaggctacgatcctacagtggagaatacttacagcaagatagtgactcttggcaaagatgagtttcacctacatctggtggacacagcagggcaggatgagtacagcattctgccctattcattcatcattggggtccatggttatgtgcttgtgtattctgtcacctctctgcatagcttccaagtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaataaattgagaaatcttttgttgttgacttctttttcgtgtgtgtgtgtgagacggagtttcactctgttgcccaggctggagtggtgcagtgctgcaatcttggctcgctgcaacctccgcctcccaggttcaagcagttctcctgcctcagtcttctgcaggcac

SEQ ID NO: 248712 - DNA, 478 bp, Homo sapiens
cagtagaaatcataagattttttattgtaatgctcataaaacattaagaatacaaaaaggatgttatgtctgacaataattaaaactaaatataagcacaggcatatatttgattaacgtcttggtggatgaagagtttttattatttttaacctttcattttgagattattgttgatttacatatggttgtaagacatagccaagtgcggtggctcacgcctgtaatcccagcactttgggaggctgaggcggcggatcacgagatcaggagttcaagaccagcctggctaatatggtgaaaccctgtctctgctaaaaatacaaaaattagctcggtatggtggcacgtgcctgtagtcccagctactcgggaggctgaggcaggaaaatcacttgaacctgggaggtggaggttgcagtgagccaagattgtgccactgcactccagcctgggcgacagagtgagactctgtcta

SEQ ID NO: 248713 - DNA, 587 bp, Homo sapiens
tctaaaccactagtgggcatttcagcaaattaccttttcagtgcactaaaaagctcctcagtaacccaaaagaattaatgtaccaccaaacagtgggcaatttattccctcaccactgatgagggcagacagtttagagcattaatgggagcatttacattgagtcacagtgaagtatggagtcactgagcctttgtgaagctaacccatggagggtgaggaggtgtttatcactgtggagaagggaggagggacaaaggagatgatccctacccttaaaagctgtagataatgctgtcagccattatctggatggaattcctatatcatcatctgtatatttggcaataataggcaagttaacaacccatggtcatgaataattatctggttttagagttgtataaaagtattctttgtgaaataatcaaatcttttattttttcatgtactgaccattgctatttttatcctggtcctgtttgtgaaatgggataatttatttctgtcaactaaaaaaatcaatgacttggatgtaaatgaacctactacatgtaactggttttggttttaactcttctcctgtt

SEQ ID NO: 248714 - DNA, 513 bp, Homo sapiens
ctcttgtagggccatgtagggattttgagaaaagaattttgtctctgtgatattttataaacccaggctacttgatagagggacactataaaaaagatccatttccacagagtatgtatcttagaacatgaaacactttatcatgggttttttaaaaatctataataaagattttcatcaagtttggggaaatttctttaaggtactaatgatgcagatagtgtttttggacgttttagttcttcttgtaattgctatatggtataaaatctcatataaaatccaactgtcatatttaaataaaaattttaattaaaaattataatcaacacatctaaataactgtatgcatgtgcataaacccacatacacacaaatacacaaaaatttgacaactgtatcaactctacagaacaatgaatgtttacctgcaagactaacagcacctgaattaagagatagtaaacagaaaaaggcatacaatcctaaagcagtatctacaaattaaagggt

SEQ ID NO: 248715 - DNA, 515 bp, Homo sapiens
gtaaagagtctggttccactaactttcccatagacctgcttcttaatgcagaatgttactatcgatgccctgacattgaggaaatgtaatatttcccatttgctgcctgagttgaaggacctgctgtccctggaggcaccttggttactgtgaattaaaatgtattgaagaattacctagtgctgtcatagagaatgtcattacaatagacccatgggtctctgatgctctcaaaagaatgtgtttctttgcctttgccatgaaggatatgtctgattgtctagacgagagagcagattgagatggtccatatgcatccttaggggctgtccaaataggaaagatagtgaggctggcattagattgatcataataagaactcttcactctttccaacactcctgtccatattccaaaacaagctaataccatggaaaaagcagccttatgaaggaatgtggtgagagcaaccagctgtccagggtgatcctgggaattgatggtcttttttgaaa

SEQ ID NO: 248716 - DNA, 434 bp, Homo sapiens
atgtcattgtataggggtgctcccccatgctggatctgtgtgagtgaaggacagggactagaacagtggttctccaacttggctacacatgagaatcacctgggagtttctgaagtcctgatgcccgtgccatccttcatactcactaagtcagaatctctgggggtgggactcacgcatttgtgttgttttaaatttccaggtgattccaatatgtagccaagtttgagaagagtgtgtgtgtgtgtgtgtgtgtggtggaagggccagggtcggtttcttttgtctccttccaccttattaccccctgcccctcactctctcctaaggcctgtcttaatacatacgtcttggttgacctgtactgtttggtaatgggtaaagtcttattagcattttactaaacttagctaaataaaataagtaaataaata

SEQ ID NO: 248717 - DNA, 1694 bp, Homo sapiens
atctttacagtgtcagagagtgagagtacaaaaggaagtgctgattgccttcctaagctcagttatcaaaattcttccagtatcgttcgcctcactggtacaagtaacaacagtgctggtaaaatatcaggagaaagcatggaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgctggaaaaggagttgcagagaaagcaagcaaatggtattcaagattcaccatgtacaccacatcatctaaggatcaaagttctgatcgtaccagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaagggatctcgcgaagtttgcccaactgggaaatccgaaagcgacatcctactacaacgcgaagtaacacacaactctcgccagacaactatgcacagggagggccccaacatcaagaggccacggggagaacagtgatgtacggtccagactacgacaacccgatggagacacgagcgataccaaccacaaaaatgcacacagagacaaaagaaacacatagaacagacacaaccaacacagtgcaaaacaatacaacacgggaata

SEQ ID NO: 248718 - DNA, 233 bp, Homo sapiens
aaaggagttgcagagaaagcaagcaaatggtattcaagattcaccatgtacaccacatcatctaaggtaagtttggttagtatttgctacttttactgtcacacacacatatccatcaccaccaaaagccccttactcgttttaactattcttctaaacatagctttataaaaaggactcattgggtatgtaagttttgtaagtatcagaattggaactgaaataataacttc

SEQ ID NO: 248719 - DNA, 393 bp, Homo sapiens
tgtttgtttgtttgagttggagtttcgctctgttgcctaggctggagtgcagtggtgcgatctcggctcgctgcgacctccacctcccaggttcaagcgattctccagctactcaggaggctgaggcagaattgcttgagcccaggaggcagaggttgcagtgagccaaggtcttgccactgctctccaacctgggcaatggagtaagactccatctcaaaaaaaaaaaaaaaaaattaatgttttataaatatgtattttaaaatgttagagaagattcccttttctactcttttatttatttgttttatttgatttacttttatcctttaagcctcacctggaagaagattccctcttgatacttctctttttattaaaaatatctttgca

SEQ ID NO: 248720 - DNA, 654 bp, Homo sapiens
tgccacatggggtgaagtaggaatttaacttattttccagatgtttagtgagttgtaccaaatgattcactctttttcaatttacttaaaaagccacttttattacatatggcatgtgtttctgctttttatactatatatatttattgctggatattctactttgttccattgatgtgcttactttcatgttagtacctgactttaacaatttaatgttttataggcccggtggcggtcactcacgcctgtaatctcagcactttgggaggccgaggcaggtggattgcttgagatcaggagtttgaaaccagcctggccaacatggtgagaccagccaggtgtggcagtgcgtgcctgtaatcccagctactcaggaggctgaggcagaattgcttgagcccaggaggcagaggttgcagtgagccaaggtcttgccactgctctccaacctgggcaatggagtaagactccatctcaaaaaaaaaaaaaaaaaattaatgttttataaatatgtattttaaaatgttagagaagattcccttttctactcttttatttatttgttttatttgatttacttttatcctttaagcctcacctggaagaagattccctcttgatacttctctttttattaaaaatatctttgca

SEQ ID NO: 248721 - DNA, 1789 bp, Homo sapiens
tcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatatgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacg

SEQ ID NO: 248722 - DNA, 296 bp, Homo sapiens
cgcatggtaaggaatcacttccagactgggccttcccatgggcttccctgagcttcctggactcaaatcatagtccttcttttcctctcccctttggacttgataaacgcagtcccattcatttaatctccaacttagaaatccggagaatgtgagccctgggatttactttcagacaccctcgtcgataaccttggccacttaggttgctgcagcctgtccccagggagacagttagaatggaacaatgacacaaacaacaccaacaataacaacagcagcagaagcagaagcaa

SEQ ID NO: 248723 - DNA, 171 bp, Homo sapiens
caaaggagactcttcttatgtttacattgtgttttatttttattttgcagagttgaggctaatctctttttcacctggaagaaatggtgaaatatttcttccaggataggttaatacttcatttttttcttcctttctattattttttccttttctggtggtatttgtcat

SEQ ID NO: 248724 - DNA, 526 bp, Homo sapiens
tgacacacctagactaggtatatctaagcaattattcctttatgaaacaaaagaaaatgaggtgacttcccttgatattgttatggaacattctcttaccttctggtcttgtgttaacaaaataactacagcttaaacaggaaaactttggcttcatatggaaggaggagaggttatgtaacatggaggttaagagagcagactcttgaggctaacattgctggattcaaattctggctctgccacattctaagtaggtggtcttgggcaaactcctaaccttctctggatctatttaatcatctgtaaaatgtgggtcaggtacttaacctgcatgatgacagtaaaagtatttagtgtagtacctagcacataaatagtacccagtaaatagtggcaatcatttttgtctttattaagagaataggaaatatagcatgttggccaactcgataaagcagaagcacagggaatccccaacgacaccactttttaaaaccaatttcaatggtaaggatgtttaaaa

SEQ ID NO: 248725 - DNA, 575 bp, Homo sapiens
tactactaccaaattcggcggccgctcgacggaagagcccctgtttagcctgcagcacacacatcatttccctttctatccctcctggcttcattgtacccacgcaccaccaaaacttacacagcaatgcctaaaaagtagcacaaaagacttaaaaccagtgccaatagagcagaacatttatcttgaaacctaaactcttgtctaaacttttttccacttggtgtactttgcacagacctaacttttggtatcaggaaggagtccttccctaaatacccagtcgatgtcacaatctactccttggtcatttaaaaccccataatgttacttatttattcatttgcaaccagtgcaacacttattatctgttagctctcagcttcaaacagctaggtcaaagtcaagtagaactttcaccacaaactgcacatcctgacctatttcaacagaggtcgtcatccctgtgaggaattcacttaaatgtgaattcattaaatgtgttgccttacctaaactgcaagagatagaggttcacaacttgtgatagcagacttcaaagtattatgcaaaaa

SEQ ID NO: 248726 - DNA, 484 bp, Homo sapiens
tatagaacagtggatcctccgggctgtaggaattcggctcgagcataatgacatggaaggtaaggctcgaatttagaattgtacttttcatatatttgtgctggaatgtagttgcacatagaaaaccagcccctatcccaaagcccctggattatagcctgcaatctacttcccttctctaccatcattgtgtccatcccatactataggggatttccccatttgcatgtagatactacattcattttcattcatgtaggccccatccctgccccagtaaacagctattccttagctacccttccagctgagagatgtgaacagcagtcgctcagtggctcaggctgcctttaagatgaccaatgcagggaggagacctaagtatgctgtggaacaggctgaagtcatatgggcagggaattttggttcctgtgtcccaggaacatgctctagaagagagacagagactctgacaatcggatct

SEQ ID NO: 248727 - DNA, 721 bp, Homo sapiens
atccttattgcaagtattcctacttcaggacaagcatcatagatccagtcagtaaaagatttctcatccagccttcttatttgtgcaaccaaaagactggcagctggtgtttgtcttttctcttcaaggcttaagggttagcatctttatagataatggcagtcctgatcataaacctgacttcatttgcacaaagcagtagggttagcctgtccgttcttggacttaaatcctggtttatgctcctcttttttgctaataagtgttctttgtggcattttttcccagaatagagtacttttgtttgcattaaaaacctgttcaaacaggctgggcatggtggctcatccctgtactcccaaaatgctaggattacaggcatgagccaccaacacccagcccatatattcatatttttaatggacttatacatgaaaatggtatctcacttttaaaaataaatgatatggaattatgcgttaaagggaaattaaatcttattatatcatgttttaaaatttttaatttttcatagctaatacatttatgtagttttaaaaatgtaaaacatttggaaagatataatgaaaaataagtctccttccatctcctgtctcccagccacccaattgccctccccgaagacaaccaatgttatcaggttcttgtgtctccttccaaagacagtctaagtgtgtttttacaaacatggatatataca

SEQ ID NO: 248728 - DNA, 506 bp, Homo sapiens
ctggcctcccaaagtgctgggagtacaggcacaccccgccacacctggctgatttttgtatttttagtacagacaggatttcaccatgttggccaggctggtcttgaactcctgacctcaggtgatccacctgccttggcctcccaaaatgctaggattacaggcatgagccaccaacacccagcccatatattcatatttttaatggacttatacatgaaaatggtatctcacttttaaaaataaatgatatggaattatgcgttaaagggaaattaaatcttattatatcatgttttaaaatttttaatttttcatagctaatacatttatgtagttttaaaaatgtaaaacatttggaaagatataatgaaaaataagtctccttccatctcctgtctcccagccacccaattgccctccccgaagacaaccaatgttatcaggttcttgtgtctccttccaaagacagtctaagtgtgtttttacaaacatggatatataca

SEQ ID NO: 248729 - DNA, 401 bp, Homo sapiens
gtctttctaggtaatccctgtaacagagcaagtttctttgaaccctagccatgtatgtgtagtgttccattattggaacgctaagcatgtgggagttatttatatcttactgctcacggtcatcatcaaggtctgattacaaaaattcaaaaaattacaacctcaggcataaatttaaagaggtggccatttaaaaataatccgttgctaccatttccacttaaaatggtagctctctgatgagttttatattggctctctgttagccaagcccgtaagagcatatggagagaaaggtacgattgaatgaacttctgtgagcggcataaagacatttactctgacaacattaaagaatttactggtactgttttttttccttgttagtttaattccatctg

SEQ ID NO: 248730 - DNA, 427 bp, Homo sapiens
gattccatttccatgtgatggggctagaaagatcttgccaattcagaagtcaaataaaatgaataaatatcacttgataaagtggacaaatccttcacaaattaaagtgagactgttactgaagccagatgagcaaacgttggatacacatgtgtatagcaaaagccaactggaacttgaagttttgaatgtcttacaacaagcttggccagggtggttaaaacaaactgtcatccataatgacccgtgccagatccagttagctttaaatagattatgcctgcctataatgtgaaaaaaaattcactggtcagttgaagactacctgaatattgtctgtttggtccatcagattggaagattggttagaaggatgtaaagatcattgtgtaaataaaatgattgatatttttctaatgacaacatt

SEQ ID NO: 248731 - DNA, 508 bp, Homo sapiens
ggtcacacacacacacacatacacacacacacacacttacgctcacaccccagagggggaagggatgacgagggggagaacgcctagcgatgggcaaaaggagaattagagggaaattattttgatttcttctgaaaagtttttaaaattagattttatgagcgtgaagagagtgtcattgaaaatgtttggaaaaatttttaatgggaatgaaacccccaccattttaatgatttgtgaaatatactggatttggattgttttcttctctcacatataagcacaatccaagtctggattctgctcattttatatcctttttagaaacaagtagaaacagggtaggatctccctattttttaatccaaagtataccttggtttaaaaggtttaatgatgacaaagcacactcctggaatttgcagctattgccacaaattcgatcggaatcaagggttcctatttatcccaaagatgattttaaaaataaactttccaatcaatccaa

SEQ ID NO: 248732 - DNA, 615 bp, Homo sapiens
ctaattcagaagaaatatataacatgtctatttggtagcttaaaaacattcttttaaaatacaaatacagtagacccaagtaggcttggggacttaatattagttactctagctacatgataaaattactggatattggaatctgaagcagcacaattatgcttcaagtaccatgctcatctgtcactgacacacacacacaagtgtgaatgcctgctttgctcaattaactctgtaaataagttcaggatttgctgtggaatgttccctgctttccattttcactatggtgaaagttatggaaactcgatccccataatttaagcaaagttgtacttaaagtaactcatatgtaaaaatttaagatactacctttagtgtcaaaaacattttaatccaagtaacgtaatctgcctgcttctaaaaactggcatataaagcaacagatctgttaggcagtcacaaggtaaacaggctcatcctactggagcagaagttttactcacaaatatgaaagaaataatctaaaatatcagagtgccacttaggattaagaccacaaactgcccccagtacacatcctctgtccttaaagatctgagctactaacatgga

SEQ ID NO: 248733 - DNA, 526 bp, Homo sapiens
cagtacacaacattaagaaagaggaaggataaaaactacaaataacagtttaacattttactgagcgtctgctatgaaccaagcactgaagcatcaacttacctaattcacagctactctacaagttacacactattgtctccattttacaagtgacaaaactgaggtgtataggttaaccaagttgccagaggttacataaatagtaagtggcagagcgggactcaggatcccaagcggtgtgattctggtacccaggctcttaaccactatgcaaactgcttccaaactctggtgggactgctcttctaagtcagaatcttgattctgctctatcagcctagcccccaaaaaaaaccccagtcaagcctgtttttccccttgcttgtcttctattcattctttgccttcttgacggttacagcctggggccaccttcttacacctattcctttgccctttctacttataattccagactcctccttgggaaaataaagggagtttgctcttagcaaccagttta

SEQ ID NO: 248734 - DNA, 176 bp, Homo sapiens
gtaaagctgagaatgcaggataatgatgttagttaccaaaacaaggtctggaccactaaagagttgtctcttcccccttccaagatcttttgcatttcctatcagactctttttagtgcactactagcaaattctgggtagcccctgagtgttagtcagcattcttcacatcctca

SEQ ID NO: 248735 - DNA, 394 bp, Homo sapiens
agcatgtattactttatagtagaaaaatctataaaacttttcatagctacagttgttactaggcctgggggcagtagcaccctccaccattttggttgtcccagtgacagataccattaaagatactaaggcttggcggtgcttacttttagtaatgaattctatactagcagctgtttaagcagtcagaaaatcctcagctactcccaagaccagttggagctcccaaactctagcccgagtgtgataatccttcccatttctttttggtgaacttgaccataccccaaaatgcaaatgctctgcagaagtgtggtgtgtggaaagaaagagtgttttcccaactggggcatcatagtgagaccccctctctaaaaaaaaaaaaaaatttagc

SEQ ID NO: 248736 - DNA, 374 bp, Homo sapiens
gccgcttcctgaggaagggaaaacagagagaggttgtggagggacatctcgactcctatctaaccaggctaagtgtgagatgctgtgtcagagatgaattactttcacctttccctttggtaaaagaatatcctgagttttggcacggcttttggcttctcaattaaagactacatttccctgccttcctccgcagtatgtgtggccacgagtaagtgcttccaatggaatgaagtagaaggaatatgtgtagcttccacgtgacaaaaatgggacttggaaagaaaaagaaatggagattatttccaaatctctggaagccaacatttttacaatatattctcctgaattatatcacagaccctaaaaaaaaa

SEQ ID NO: 248737 - DNA, 597 bp, Homo sapiens
tttagaaaatagatttttttgtttaattttagactccaggatagaaaatagaaattattaagctctaagttaaaaaaaaaaaccaataagcacaacacaaagaaatatctgcaatttagcatatacaaacaagctgacttatacaacaaaaaaccttaaagctacaataataataaagtaatccatcctactccaggaatatgataaaatatcaaccttaaaaaaactttaaaaactaactttactagttaatggtaattagcaaaataatgaaacagtgaatcttcaaaatctgaattatttcaaggtaaaaaacatttttaatctttatcgggaaaaactggtgacagtgaccaataaaatgagcataaagtataagcaacgctttcacaccaacaaaaaaattcaagaaagaatttcctgaggcagatgatgatttaaaaagtaatctgaaggaaattatccttcaatgcctttcaacagattgaactactgtgtcttataggaagtaagtaatgcagtggtttggtgtttgactaaaatataagtgaaaactttcttttatatttatggcaacagaattttactttctaatta

SEQ ID NO: 248738 - DNA, 480 bp, Homo sapiens
gctgggattatgggtgtgaaccaccgcgcccagccccggcctccattttaaatccatatggtggttctcccatggatgcttatctccccacgagaattttaagccccatgaagacaaggactagatctttcttttgttcactttatatcctggtgcctagcatagcccttggcatatagagggtgctcctaattatttaagaaacgagtatggttcatgcctgtaatcccagcacttcgggaggccaaggcgggcagattgcttcaggccaggggttcgagaccagcctggccaacatggtgaaaccacgtctctactaaaaatacaaaaagccgggcatggtggtatatgcctgtagtcccagctactggggaggctgaggcaggagaatggcttgaacctgggaggcagaggttgcagtaagtcaagattgcaccactacactccagcctgggcaggcaacagagtgaggctccatct

SEQ ID NO: 248739 - DNA, 465 bp, Homo sapiens
ccaagacttttgagcgagatctgttgacagccaagatccctgtcttggcacaagtcatgttgatggggagacagacaggaagctagtaaaaaggtaaaacataatattaaatagtgagaattgctgtgggaaaacgagatgatgatgagttgggggtgggaagtttgaattgggtgctcttgggccgggcgcggtggcacacacctgtaatcccattgctttgggaggccaaggaaggaggatcactggaggccaggagtccaaggccaacctgggcaacatagcaagaccccgtctgtagaaaaattataaacaattagtcgggcatggtggtgggtgcctgtaatcccagctactcaggaggctgaggtgggagaatcgcttgagcccaggagttcgaggctgcagtgagctatgatcacaccactgcactccagcctgggtgatagaacaagaccctgtctc

SEQ ID NO: 248740 - DNA, 179 bp, Homo sapiens
ttttctttttctttctctctttctttctttcttttttttgacagagtctcactctgtcacccaggctgaagggcaggaggcacttggattttcatgcattcttcttcgttccttaaatctaatcaatcactgagccctacaattttatctcctgtgtctggaaatcttttctacttcaa

SEQ ID NO: 248741 - DNA, 385 bp, Homo sapiens
agaaggttgtgatgtttcagtgttgttttcttgattttgacagctgtgctgtggtttgtaacattatgtccttgctttgattcaggaaacatacactgaagtattttaggggtaaatgggcatcacgtctgcaattcattcccaaatattcattaaaaaatcacacacacacacacacacacacacacacacacacatatacttgtatgtgtggtgtgtgcgcataagaaagagaagaggccgggcatggtggcacatgcctgtaatcccagctactcgggaggctgaggcaggaggagtgcttgaacccaggagtgggaggttgtggtgagctgagattatgccattgcactccagcctgggcaacaagagcgaaactctgtct

SEQ ID NO: 248742 - DNA, 388 bp, Homo sapiens
catagagtcccccttgatacggctgttcagcagaccaactttgttgtaaatatttagataaaaatgggctttagagcagccacatctgaagacccacaaggctgaatgttacacaggcaatcagaatctgattgaagataaactcatcctatttggatcagagcattagaagaaagaaagaactgacacttctcaaccttctctagttgaagacttctctttgctataactacttgaagagttcagcagaaaaattttactgaagaatccctgatcctcctttaagtagctgtagagaatattcactaagtgtaatgggacacgtctctctcatgcccacttcttttctcttatccctgcaagaaaatgaagttttgttggagtcaga

SEQ ID NO: 248743 - DNA, 392 bp, Homo sapiens
taagaaaaatacagttttagcaggtttgtccactgaggagcctgggctggccggtgatgaaagcgaaccagaggggaccctgctctcagccggtttatgactggctctggaccaaccaatgtaggatggtcgaagcaagagatgtaaaaccacccaggcccagtggttcatgcctgtaatctcagcactttgggagactgaagtgggagaatcgcttaagcccaggagtttgagactagccttggcaacatagtgagaccctgtctctacaaaaaataaaacgtaccaccactttggggatcaaattttagcatgagtttcttttttttttttttttctccttgccatgtttcacatttaataagattctgtcacttttacatccctttgtc

SEQ ID NO: 248744 - DNA, 397 bp, Homo sapiens
ggcaatattcttggtatttatgtatacttgtgatagtatttttggtttaaataatttaaaaaccatattctttttcaagcaggatttgttaaataattggcatatttgggacttaatctttagggcagaatgaactctgattatactaacgtatcacgtattaaaaagggggtaaaaaaagctctgtcagccattttcactatactttgtaaagatttgctgttatttagtaaatgagatgacatcttacctttccaaggactttcttggagataaaaatactattattactttttaactaagcctatacctttggattattaatttgaatacttgatactttagagttcaattgtaaaaataaaggaaataatacaatcaaactatttgtgaaaaa

SEQ ID NO: 248745 - DNA, 437 bp, Homo sapiens
caggctcccgccttgtgcgtaggtgtgatcttcacaggacaaggctgagtcttgcctgccttttggcatctccacactaccctgcagatactcaaaatacagctcttgtattggattgaaaaatagaggcccctggcctttgggcatggttctaccactgaagaaacaacctcaagccaccaaaagccttttgctttctcaataaagagcatacaagatttagtgggctgcaagtcatgaagaagcttgatggcaggaaaaccctccccctaccggatcccctccctgagtggctgggaccttgaggtttgggctgaagactgcctaccaactacagcagagagaaagcgtgacagcctgcaacggctcccgcaaagtctctagcaccattatcacaccagcaccataatggcaataaaaagttatttctattttaa

SEQ ID NO: 248746 - DNA, 719 bp, Homo sapiens
agtttaagcaggtgaggccatcttgaaggtttgccccagcagcctgggtgaatggagggagtcttgggagaatagataagatgcagtcaccacttttaactcttgcccttaaaaaatacttttacaacacggcttataatggaaagagcattaaaatggacattagaaaactgccagtgattctaaccttagagagtttgtacagactccgtaagatttgtttttttagtgataaagggaaattgtactggtcattccttaataacacatccagatttctgttatcacttaccaaaaatttatgaatttgagaattgcttacacagtatcaggtgctgggtactgggaggtacaaaacaaagtatagtcaggtaagggctaactttattactaatttggctcattataaaaacaacgggaaaacatgaagagagggctttattaaggagttaagtcagcataatggaccacttaatatataataaccacttaagagaaaaagaaaaattaggaagtccacataaggtggcgttttataaaggcaacatgctgttgttaagggcacttgggccattggtgttttgtgacagctgggctcaggcatctcaacaagcagcggtgtgcctgctgaccaacagggcctgccacggccagtgaaacacagctattagagctctctcaatccatttctgctcagaaatgtagagatggcaggggaa

SEQ ID NO: 248747 - DNA, 227 bp, Homo sapiens
atatatatatatatatatatatatatatgtacactttataggtatttttatctccatgaaaaattatgtgtagaattctaattgatttttaattcagagttatctttttgatatttaaaaaaacgtaaaaattcaaagaatataatgaatatgtggcttaactccatgtcaatagagtcatcagtcctgaggcacaatactaatcttcttaattaaagcaaaagtta

SEQ ID NO: 248748 - DNA, 677 bp, Homo sapiens
attgtaattcccaatgttgggggagggacctagtgggaggtgattggattgtgggggtggaatttcccatgctgttctcgtgatagtgagtgagttctcacaagatctgatggtttgaaagtgtatgacacttcctccctcacactttctctcctgccaccacatgaagaaggtgcttgtttccccttcaccttccgccatgactgtaagtttcctgaggcctctcagccatgcttcatgttaagcccgtggaactgtgagtcaattaaacctcttttctttataaattacccagtctcaggtagttctttacagcagtgtgagaacagattaatacaggttcatttctagggctcaaggcagctttcatggctctcctttgttttttctgcatgttcgtttgttcacctgtgcatccatcatccatcacccatctaccttttgttaaatgcctactgtgttcttaattttaaaacttatgcttcgtgtttcctctgaatcataataaaatccaaaataaaatccagtgttgtgtgctggtctttagaggctacaataaatgaagacactgggatcctttactaagattttatttcttttttaaaaaaatgttttcaacttttattttagattcagtgggtacatgtgcaggtttgttacctaggtatattgcatga

SEQ ID NO: 248749 - DNA, 670 bp, Homo sapiens
aagcaaacattttattggacactaaggtgcaccaggctctgtgctaggcttaggggaactaatacaacagttaatatccttatagtctaatcctggctattaactttcttaacatcaagagtgaagaaataatattattatatactattatattaaataataatattaatacatagctaattaattcaagccagatccattgctgcatgtagacactatggaggcagtaaccaatttgcctaaagatgatgcattcacaaatttcacaattttaaaggttacttaaaagggtatcacatagctcttaaatatagcttaaaatgcacagtttaagtctaataagaaaattgcagtttaaaacttcactgacatgctatttcttacctatcagattagaaaaatccattttccaggttatgtggaaacagaccgtctcaaaattttctggttgaagtgtaaattggtacaactcctatgaagaatgtggtaatatccatccaaatttcaaataacatcaccctttgacccagcaatcctacgtgcatttgtgcaaaatgacaatgtactagtttattttgggagtattttttataatagcaaaagattaggaacaactcaaatatccaccaacagagacctacttaaatatggtacattgatctagtagtgt

SEQ ID NO: 248750 - DNA, 327 bp, Homo sapiens
gctcgggtccccctccatactgtggaagctctgttctttcactcttcacgatacatcttgctgctgctcactctgggcctgtgccacatttaagagctgtaacactcaaggcgaaggtccacggctccgttctttaagtcagcgagaccgcaaacccactggaaggaaccaactctggacacaccttgagtacacgaatttgaaattacactgaggtgatcatgccactgcactgtagcttgggtgacagagacaccatgtctcaaaaatctacccagagttgggaaccactgatctaaaccattaaaatttttatttctgtcacta

SEQ ID NO: 248751 - DNA, 449 bp, Homo sapiens
gggtgagggaggggcttgggggagagaggagtgttaggggaatgggcacatttctccattgctgggagcagtttctatggtaccagtagtcctgaaggtagcatgctaagactgttcagaagcctgaagaatttggaagctctttgacccagcacagttttattcctaagactgtgtccaaagaaaataatcatgggactccctggaagattttgtttcaaacactatttgccattagccaaaaacaaaacaaaaggctgaagatgacttaagtgtccaggcttggagggttgggtacaatttatggtacagctctgtggggcactatacatggctcattggagatccttgggtacgtatatattatgcagccattaaaatgatgctgctggagattacttactgacacggcacttactaaaccatgcctagctttattacatctttat

SEQ ID NO: 248752 - DNA, 517 bp, Homo sapiens
gcccggctcccctttgtaaactttcttcttcttttggattcttggccctgtaaattctcattccctcagtggctttctgatgtctttgaacagatgtttattttatattttgtccattttgtgtgattcttatcagtgccaggattactccaaaataacctagccagctattgccaaagatagaactctatctaataatatctaagtaaaagtaaaaaagattagtcctagagaaaatatatagaccaaagggaaagtaatcgtaaactatgaggaagaattggtcatagagtatctgatcataaggttttaatatttggtataactaaaccataaatttgtctgtgttgtattgggcaatgctttgttattaaattatagtttctattcatcacatcactacattacacttaaataaatgatattatttcatatatttggtcttgaaggggaagatggctatctcttaagacaaaacatggcaactgaattcctaaataaattattaaacagattg

SEQ ID NO: 248753 - DNA, 532 bp, Homo sapiens
ctgtgggggttgagtctctccatctgtaatgctctttgtctaattggctcacactttctttctgctgaataatgtcacttctgtgcttgggagtggtccctggggtagaggatgccagttgccaagcaaaacctatccccctttcttcttgactgacagacacttatattattggggcagctaaagcactacatttcccaagtttacagacatctgtggccaagcgggtgtaagcagaagactttaggggtagaggatgcctcagagaaagttattcaaaagggggataattaaaacaggaggtgaactttcttctttgcccttcccccatggaatgtggccatgatggttggagctccagcagccatcttgggaccaatgtgaggatggacattacaagctaagagggctgagcagaaagaaagaagacatcagactctgatgagtgactgtggagctgccttgccagtcctagactgcccaaggccgtatttctctcaggtgaaaataaacctgtatcctctttaactga

SEQ ID NO: 248754 - DNA, 210 bp, Homo sapiens
gtttcaaaaaaaaaaaaaaaaaaagaaaagaaaagaaaaaagaaaaaaattagtttcaataggatatgctgtcttttaaaaattacattcagcaacttgttgctgataattaaaattcgctgagatttatttctgtatagagtgtgcattctagaaacttactaaaaatattatgtatgcacaaaatacataaaagaattgcacaatgaa

SEQ ID NO: 248755 - DNA, 528 bp, Homo sapiens
gagccagatggcggctctttaaacaaactcgttcttctctgtgcccctgtgacctcagctattaagcgggctgatgatccatcctgttcacctcagaagactgtttcaaggatgagaggtgtcagcatttgaaagccatggccggcacatagtgtgcatcttataaatgctggtgctcactattattattctttgttacgggatcctctactctcccttctgaccttgaactagtatgaattagatttcagtcacttgcagctaagaagtcttgattacgatcatcagtttgacaaggaagttaaaagtcagaggcccaaagccactctatgagaaaatccttacaagtagtttctagattgaccctctaacccttagctttttcttcacccagtatatgcattatctctccaaagagatgataaattccagcatctcactaatattgctttgctctaacatcattcccagcacggagcctagctggagtaggtgcttaataaaaaccatgagttatgtttggaaaaa

SEQ ID NO: 248756 - DNA, 474 bp, Homo sapiens
ggtggcagtacagtaggccttcttcacgggcaacttaagttagtagtctaacttttctttttggacactaaccctttaggctgctgccttaatcactttccgagcagtctagaaataagttcacccccaccatggattagaaccccccactctttttatgcccgcaccccccctgctgctccccgtagctaagctgtcactcctgtcttgttttatgttctgtttgtgtgtattttcttgagcactttcttttgtggtcattttgggtgtgggatacctttacctactgctgttcagaataaaggcagtgagtctcatctttttacctagtcagagagtattttgttgaatcctggagtgcagtgggtgtaatcaaccttgaactactaggctcaagagatcttcctgcctcagcgtcccaagtagctgggagtacaggtgcatgctactatgcctagctaatttaaaaaaaaa

SEQ ID NO: 248757 - DNA, 672 bp, Homo sapiens
gggtcatgtacccctgtcgcctatcccagactctgggttaagaaggcttggactagatacaatcaaaacccatccaagtcctacaggctcagatgcaggctcagggcgagagctcgtgtgagaggcagggaacgccctggtatcctgtgacactgaagccagggcaagctcagggtggagagtacagatgtgtggcttggtgcttaaggccaccaatggtcagcctggtgaaggccactgggccccagcctttcttacctcattggccatccctacttcaaggaatgtggccttaaatcctcttttcagcagcctttcggggattttgatgagtgaagcgtatgatgatcttgtccacactgaaacagcctcctagggaacacggtctcctgtctgcgtcccacctcccccaaccacttctaccagcctccaagccccgcggtccccatgcggacctcagcgccagctgaggttcaaggtccaggttttcaaactgggttccggagcaccctagaggccccaagaaggtagggccacgtgggagatggagcagggagggttctgagggacccctccttcctgcggaccagatcagtgttgtcacttctgttttgtggcttacaattccatgttaagattttggtgtgcattttgaaagaaagtcattgtttt

SEQ ID NO: 248758 - DNA, 489 bp, Homo sapiens
gcagtttcagcaatattatcaacaaactcacaatcatataagatttccatttctactatcataactaatccttacaagaaccctgtaagtcatacagattagtcaattatcacatctagctgataaaggaacaaaaaaaaaatgtgtccattcatagccaagactacaaatcagactatctgactcatagtctcatgtttccttacaccttcactaataatctattatttaagttagatttttttttctttaaatagtgagctaagtatttgaaaaatttgtgaactttactatctatacaaaaattagtcaaagtatatgttactgaaaataaattagaagtatcatctttatatttatttaaatccccaaacatactacaaaatagtcgaaatctcctctcattgtttattgtacccttcataagagttagaaattttcacagaataatggtatgtctacaaaagtgttaagaaaaaaggttccatg

SEQ ID NO: 248759 - DNA, 457 bp, Homo sapiens
ggaccctctggatgcaagtgtcctctgattattttcattaaaatcacttaaacaatggcatacagaaaacatgaatcttttatacttcctaatctgagttttattagttccaagttattttggtactataacatatacgattattttaaagatgagctgcttacgactaatttctccttttcttttctctttttttttttttttttttttttttttgagatggagtctcgctctctcacccaggttggagtgcaatggcgtgatctcagctcactgcaacctctgcctcctgggttcaagtgattcttctgcctcagcctcgtgagtagctgggattacaggcacccgccatcatgcccagctaatttgtgaacttttgtagagaccggttttcaccacgttggccaggctggtctcaaactcctgacctcaggtgatccacccaccttggcctccc

SEQ ID NO: 248760 - DNA, 656 bp, Homo sapiens
aacccagtttcttaaaaaagaagggggaaggggcgggcatggtggctcacacctataatcccagcactttatgaggccaaggcaggagaatcgcttgaggccaggagtttgagaccagcctaggcaacatagtgagattctgtctctacaaaacaaacaaacagtatcaaatgtaaatcaccacattaatacaaaatgtaaaaataaattaatgtaaacacaaatgattattttcattaaaatcacttaaacaatggcatacagaaaacatgaatcttttatacttcctaatctgagttttattagttccaagttattttggtactataacatatacgattattttaaagatgagctgcttacgactaatttctccttttcttttctctttttttttttttttttttttttttttgagatggagtctcgctctctcacccaggttggagtgcaatggcgtgatctcagctcactgcaacctctgcctcctgggttcaagtgattcttctgcctcagcctcgtgagtagctgggattacaggcacccgccatcatgcccagctaatttgtgaacttttgtagagaccggttttcaccacgttggccaggctggtctcaaactcctgacctcaggtgatccacccaccttggcctccc

SEQ ID NO: 248761 - DNA, 394 bp, Homo sapiens
cccttacataaaatggcatggtgtttggatataatctatgcacatcctctcatatactttaaatcgtctccagattaattatataacatagtgtaaatagttgttatagtgtatttttaaatgtctttagtttttccaaatattttcaatctgtggttggttgaatcaatggatacagaactgggctgactacacactacagaacaaaagactatcaataaaacagaaggaaaatgaaacgttcctccatcagacaacctatgtaaaaactaagaaaataatctgctcccaaatcagaacactgtttctcattgatatttcttttaaactcatactatttttaggttgtgcattccccaaataaagcaatttaagttcagtgttttttcaaata

SEQ ID NO: 248762 - DNA, 214 bp, Homo sapiens
ttgcattcaaagcttctgagctcctaagatgtttttcacatctgttgggggtctgtctatccatctacttctcaagccccacctcctgcttcccgctattatccataatgagaaacttttccttcccagcctggaaggtccagctgtatcttcttgaaattgggagggaggggggcggatctcagagaagaaagaaagggaaaaaacccacatt

SEQ ID NO: 248763 - DNA, 685 bp, Homo sapiens
aggggaaggaataaaaactagttcgcgttccacaataatacgtttcaaagagacttataagaatttgttcactcttttggccaaaactggagaaaagggaggataaaattgtaaatttctaatatccgatgttagacctcagtaacctttttttttttttaatagaagaaagggtgagggggaaacaatctgcccacgatacgcatgggaagcaagcgctaggtgagaccggcaggtcctgggagggcctgggccagccctgtccccggcgcccccgctgcggcctggtgtggcccgtgggcccggcgtcccaggcggcggaactctgcctcggcggcgcctggggactcgctctgcgcggaggtcaggccgagaaacgcggccaaggctcccgagggctccaccctcccctctttcactccctccccttggcggtcccctgagggaaacaggcggggcgcatcgctcagagacaagctggggggagttgagtcctcaacgaaaaaagctccgccgcctagagtggcggccgcgggttattaataaactccgcttctgcccagacgccgctaccgcggccggcccataaaatcggcaaggcctgcggcggaggctgagcagcgggagccggagcccgggcccaagcgggcccgcgccgccgcgctgagggcggcggccaggcgga

SEQ ID NO: 248764 - DNA, 345 bp, Homo sapiens
ctccacatctatcttgttgccctcatccctcggtccagaacggctcactactagtccagccaatgaaaagcagtgcattgcactccagcctgggtgacaagagcgaaactccatttaaaaaaaaaaaggcgttgctttcccatcccaggttgcattccttctgctatctcacagtggtcacactggctactgtgtacacagctcagaagccacacactttctactttgtcttacatcccactgccagaactgagtcacgtggcaatacctggctgcaagggtgactggaaaatgaagtctatatagacagctaagtgtcttggccaatactctgttgctatttat

SEQ ID NO: 248765 - DNA, 311 bp, Homo sapiens
gacctcgtaatccgcccgcctcggcctcccaaagtgctgggattacaggcatgagacaccgcgcccagcctatctttgtttttaaaagggaaaataatcacgggtacctctccagaaagctctccttaggatccacattatagaacctcaccttatggctataaacacatcttttaggactttaatataatgattaaattaagataagacttaatcatcatgtagcagtggataattttctagaaatttaataggaaagttattgaaaggaaaaggtgtctttactttttgggattttttttttttttttt

SEQ ID NO: 248766 - DNA, 767 bp, Homo sapiens
agttaacctccatccctcctctcccctccctggaggtcaagaggtggagctgaaagttccacccctctaatctcatgttcagctcccctggcaaccacaccccaatccttaggggctttccaaaagttacctcattaacataaacccaggtgtggtcgaaaaggggttgttatgaataacagaaagtgctcttttcacttgttatgacttaagatgttttagggttttaggagctctggccaggagcagggaattaagactgaaatgtatatttcttatatcacgggagaaacttggtgatggcagaagaggggacaaatttaaatgtgaggatgttgttcaagagcaggaatattcaaagagaaaggcggtcatgtagagagactcagaaaggaagtgatgcacatgggaagaggatgtaagtacctagaggacaaaggaagggaaatgaaaccgtgaaaaggggtaaaagacaacaaaaataaccttgtcattaacagctcactttgattgaacatctactctgtggcggttggtttaatgctcatgacagccattggagattaatattacttatatgcctattttgcagataaggtaactgaaatccagagataccacaaatggagtttacatagggtcagatgaataaggaaaaacccagatgttctaccccagagcctgcattcctaaccctgtgctatccaggcaatctaaaaaaataaaaacagaaaaatgaaacaaaaatgaggaaatatttgcagaca

SEQ ID NO: 248767 - DNA, 442 bp, Homo sapiens
gggtcgacgacttacctatatggactacatcaatgagcttccttcccctttgaggttatgaaatttattttcctactcccgtctcatgggttgtgcccttagctgactctgtcccttgactgaaggtcactgcttctctaaatgtggtcctctcggccgggtgcggtggctcatgcctgtaatcccagtactttgggaggctgaggccggcggatcacctgaggtcgggagtttgagaccagcctgaccaaaatggcgaaaccatgtctctactaaaaatacaaaattagctgggcatggtggtgcatgcctgtagttccagctgctcgggaggctgaggcaggagaattgcttgaacccgggaggcggaggttatggtgagcagagatcacgccattgcactccagcctgggtgacaagagcgaaaccctgtctccaaaaa

SEQ ID NO: 248768 - DNA, 866 bp, Homo sapiens
aaaatctctcagatggagcctgaaactccacaatttaacaagcgccccaggtgatttgtgcccaacaaagataaaaaatgaatgggttgaaactcaagcaaaagacaatgaagttggagcagccagctggactgctgtttgagtaatccagttgattacaacacacagactacaatggttaccatggagattcaagggcaagggtaaacctgagaactatttcaaaggaaacatcataaagaggtaaaagactggatttcagaaatggaagagagaaaagagaccaggagaactaggattgctgcctcctgagagtcagttagtgaccaagagtactcattaggcctctagatatcagggatattcttggcagtgagagcagagagaacaaagctaaaggtgctgaagtaaggtgacagcgctttaaagaagaagaaaaaaaaaaaggaaaaagaaagatagctaccaagaaaaaaagtgacctggtctacaaagatgaagaaactgtcgattagggtggaataaacttatcatgcaagaagttggcatagatactcgtctcaccttaaaggtgctttaaaaataaagtggggtcaggcaaggcagataggtggcatagcagttaagctcaagcagagataatgaacagaaataccagaggaattaggattaaaagcaataaagtcttgaatattggcgagaaaagatgaagaagagagtgtataaggaggagttctcactccaaacaacagtggcatgcgaaacccaagagatcagaccttgaaagctatgcactaataggttatttagttttcaaaatcttaaattaataacaattggcaataaagctcattaaaattcctttt

SEQ ID NO: 248769 - DNA, 375 bp, Homo sapiens
aaacatgggggtagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttattttttaattaaaaataaatctttcaaaaggattgagtg

SEQ ID NO: 248770 - DNA, 718 bp, Homo sapiens
ctgtccccagatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtcccgtaagtgcaggccctgggggccgcttggctttggtgtggttttgaaggctgagggttgcaggtcccgggccaagatgagatgaggctgagggtctgtccctgctgctcggccgcctgctgacctccctgttgcgggaggtgagggtgcggcgtcacagcctggactggcctctcaggtgcacggggggctggctttagagtgaggagggaacggacgcggttgtgagcgcggcgggcaggggagcagccgagtgcttgctggaatgtttctcacaggagtcattggctgaatgcgagctcgtccgggtcgcgcaggggccgggggtctttgtgctccagagacgggctcgggcgccccctgccggcccctctgtcgccttcgtgctgagactcgtttcgcgcaagggagatgggggcggccgc

SEQ ID NO: 248771 - DNA, 442 bp, Homo sapiens
ctgtccccagatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtcccgagtcattggctgaatgcgagctcgtccgggtcgcgcaggggccgggggtctttgtgctccagagacgggctcgggcgccccctgccggcccctctgtcgccttcgtgctgagactcgtttcgcgcaagggagatgggggcggccgc

SEQ ID NO: 248772 - DNA, 895 bp, Homo sapiens
atttagaagacaatgagagggtaaaactgattactaagtttggaaacgcttggtgatacaggataaaaataaatacaatacactcaaatataggatgatagttcatgtaacaaacagagatatcatttgtcagattgcttacgcctgtatagagggggtatgatactctggccagcatatgcacacgaactgccaaaatatggtgtgaaggttggcttgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtattaagaaagctcatgctgctatacgagagaatccagtctatgaaaagaagcccaagaaagaagttaaaaagaagaggtggcaccgtcccaaaatgtcccttgctcagaagaaagatcgggtagctcaagaagaaggcaagcttcctcagagctcaggagtgggctgctgagagctaaaccaaacaattttctatgaggatttttcagataaagacaataaacttgtggacagc

SEQ ID NO: 248773 - DNA, 529 bp, Homo sapiens
gggaatttcacattggaaatggtcaggtccgacgcaatgcaggcggtggtgtttctggcaaaactcctccgacgggtttgcttttgtgcagtcccacagtaaccctcttcgatcgcactgctctgcgccccatcccgctcctcccccaagaaggcccttgctctctgcggggcccacccagcttcccccgccggctggactcgcagagctgcagactttgggcagagctgtgcagatgaggatccctgggtttgttccatgtagttttactgggcggcggcggtactaagagcctgtccctctttaacctacgatgggacttgaagttttcttacgatccgattattctgaaatacagggaatgtgacttgtgggggaccgaaggcttcgtgggtttgtggggttgtctgccaacttggtgctaattgggaataatctgagaagcaagtcgcctactcacctcccaccctatgtccctcctcccgcagcctttttccccagcctagtgcctccacagggccactttcaa

SEQ ID NO: 248774 - DNA, 377 bp, Homo sapiens
tcctttctccccctcccaccttacctcttatttctctttcccaagaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagtatgtagtcacggaagtatgtagtcacggaagtatgtagtccggaagtatgtagtccggaagtatgtagtccggaagtatgtagtcacgga

SEQ ID NO: 248775 - DNA, 640 bp, Homo sapiens
tcctttctccccctcccaccttacctcttatttctctttcccaagaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagaagtcacacgctgtcatataagatttaccttccgacacaggtcatctcaggaaaccagagataaatcggagcgagcatttggg

SEQ ID NO: 248776 - DNA, 680 bp, Homo sapiens
tcctttctccccctcccaccttacctcttatttctctttcccaagaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggaggtgcgcggcatggcccagaaatcctgctaccatcgcatccgtctttacaatcacgatagaattttggccgtatttcaattcttctttgcatcaggatgggtttgatttttcctgagaaaagaaatataaagcctgttaaatttgtgattagcagtgagcagtttcactaaggaagctatctagactcttctagactcttatttttatatttctcctgtgctaagaaatagctccagccact

SEQ ID NO: 248777 - DNA, 320 bp, Homo sapiens
cagggtgacagagggagagattagagtgatgcagctgcaagccagggagcacgaaggaaggaccccccccaaccgcccacagcattcagagggagtgtggccctgctgacaccttgattttggacttccagcctcccagccaagaagtttctgctgtcctaagcctcccggtttgtggtcctttgtcaagggcagccctaggacgtcagtgtcattcccatttccttctagtgactgcaagagcgatcagaagcagccactttagtaactccagctgcagagacccagagatgaaaagcttaaaataaaagcttctatta

SEQ ID NO: 248778 - DNA, 929 bp, Homo sapiens
gttcttagaattgccttatttcagaactgcagggctgaagatggatttgggctgcgtgtctgttggagaagactcatgagaagtttttgtagatcagcaaaattctggggcagtaatgacctcaggacttggggaagcagattcctgtggaaagattgtacctaatacagcagatgacttcatgacaatattgagtgtgcaaatctaggatcatgatctgctgtcgctagcagaagcagcagtcatctcaggggaggtgttgcctgagatgagtgtttccttgttgacactgtgcttagctacctgggcaactaagcactagagacaggattattccctgtttggatttctagcataacagttccatcaaaaacagaagaaactgcaaaagagcaagtacctttgcagggaacattcacaaccccagtgactttcctacccttcagaaatagctgtatttccaaactgttaaaatttttttctaaggaagaaagaaaaggtttgtagaattgagcatatgtatttttaaaagaaactttattgaaaaaaataaaattaaaggcaaacaacctgcaaaaaggttacatatagtacagatgaaagtttaatagcttttctcagttaaagcttttataaatcaataaaagaatgataaatagccctaatggaaaacaaaaacaggtaatttacaaaagaaaaacttaaatggtcaataaactttttaaaaaatttcatactatcaaaagaattttgatacagacgcacacacatgcatgcacacacacaccatcttttacctatacatttgaaaaagattagacatctttgtccttgatgagattgggcaaaaattggtcctgtatttcagttttgatgctaatggagatataaattcttcaggatagaaatagatagtctgaataaaaaca

SEQ ID NO: 248779 - DNA, 384 bp, Homo sapiens
aatctgggaatccaagggtcgtgctacatctagtcctctttgataaattctgccttcctgttcacatttttcgagaaaccattttgaattcccaaacagcaaaggaaatgctgcaggttcctggagggacctggtgatctggggcagagcacacggagtcgagattgctgcggggttcacgagcctcccctcctgggaccaggggcacctgggcagggtagtctgcaccacgcaggaaagcccagtacacgcagctgctcaacgctgcagacgccatagcgcagggctgacaaggcctccctctttatctgccctggaccacaagtggaaaatatcaagacaaagcaaaagccagtatcccttaagaactttccaattgttctt

SEQ ID NO: 248780 - DNA, 644 bp, Homo sapiens
taccttgaaaacaaaaatcaactttattgaggtctattttacaaaccatagaatatgcttaagtgtacagcttggtgagttttgacaaacatgtatatccatgaaaccaacaccacagtcaaaatacagcagttttccatcacgtatctccgcctactgtgcccgtttgcaaccagctctcttctctccgagccttgccttaggtaccactgctctgctctctgtccatatagattagttctgccttttcttgaattgcatactaatgaaatcaaattgcatgtccttctttgggtcttacttctttttgctcatcacaacatccttgagatacacagaaactgttttatgtacaagtagttccttcctctttattgctaagtaatactgtattatatagaaatactacagtttgtgcattcaactgttaatgggcatttgggttgtttctagtttggggctattatggataaagttgctataaacatttttgcaaatatgctttgttttgggacatgtgtttacatttctcctagctggatacctaggagtggaatttctgaattatagggtagatatatgtttaactttataagaaattgccaagcctgggcaacacaacatgaccccatctctacccaaaa

SEQ ID NO: 248781 - DNA, 646 bp, Homo sapiens
gggataggaactatactggaatagatttgatgagtgaatgggagatgaaaaactgaaggcagaaagtacaggtacctcttttgagaagtttggctgtgaagaagtttgcagagatgactgggtagctgggggaacaaacccaaattcagtgttagactttaataggcatactatttaaagcttcatctatcactagttcttttaacctttatttttttgagaaattctaagcatatgcaaaagtagaaaatgaccaaccctgccccatccacaatcctgtctacctcttcctttgcatcattttgaagcaaatcccatataatttcagttataaatatttcattatgtttccaaaagatgaacattaaaaaatgtaagcacaatgccattataacataaaaaattaatgataatttcttattaataaatatccgacttgtgttcacattttcacttttctcaaaaattgtcttagaattttaaaaacagattttaaataaggtccacaaattgcatatgggtgctatcttatttatttatttatttatttatttattgagacagagtctcgctctgtcacccaggctggagtgcagtggcacgatctcagctcactgcagcctcttcctcctgggttcaaacaatt

SEQ ID NO: 248782 - DNA, 534 bp, Homo sapiens
acagggaatgtctgtgtaaactcatccctgggaagacagagaagctgctctgacacctcaggggaacagaatggcaggggacagaccataagactgtgcaacatttctccttttccttgccttttcgccctctttcagaggccccacttctacaccccgttttcttccggagcacacaaatcccagcccttgggcgtcccctgttctcaggctgccatcgtgaggaaaatacctgataaactaaaccacacaaggatgaagagatgccctccagaaggtgcatacttttaaaaagaggaccccctagagagagcaatgtttaaaggaacccatctgatacagtagaatttcagaacctcaaggcaaccagagtttcccagtaccacttaaacatcacaacacacataaccttctgctctgctaggagtttatcaactgattagccgtaactcactttgtgtgcagatcttggaagaatgctaataataataactgatgtttactaaaatccaggtgttgtgtaaaaaaaattat

SEQ ID NO: 248783 - DNA, 816 bp, Homo sapiens
tacccattgggttagagaagaaaacaatttcaacctacatattattgagataaaaaggcagagaaagaagaacaagaccaggctcaaaatgaccttacagttgggtagttttgggtaacgcaatccttggtgaacctcagtttcctcatctttgaaatgggagtgtctatcttagcacagtgctgaacataggaaatattcaataccttgggtatctaccccagacgttatttttttcctagactcatacaacttacccttaatgtgcatgtgatttcttgttaatcagatattttgagctcaataatgtaaaactagggactattacagtcaaaatgattcatcctgaagccttctagttattttatttgtgactttgaatatacattttcatagaatacccttggtaaaactaaatttagaaaaacgaagccccacatttacttaataataccaaattaccttcttggattcaaattttacaaatgttggattgatagaattctgaagataatttggcagcagatatttctgtatcaatatgttgaaccatctgctcttttgaaataatctaatgacacagacaaaacattaaaatgtgtatatttgttatttggttggtaaataattgaaggctcattaatttttatgagattcaaaaatctctggtagactttctgattttagtataatttttcaatatgtttactttatggtaaaatgaattaatgttaagtgacctaatttattttgtatacattatcttcaacggaaacattattccttaataaactgctggaatagactgaccttttt

SEQ ID NO: 248784 - DNA, 670 bp, Homo sapiens
  misc_feature (670)..(670): n is a, c, g, or t
gttgtctttcactccagccccttctgctcaacatgcatcattctttgtttccactctgcagtcctttcatgctgcttacttaggtgttgtaaattttgaatgactctaatgtctacagcatttcctgaattttacatctggacagtattgaagggcagcggggcctcccaaagagcctgttttgcttgactaagttcttttgctgtattgatttagtataagaaattctgggataatgttcaatttcttcatggttcttaaaaatttcaggcatcaacaaaggctgtgtattccaggcaagagatacaatatgaagaattttcttaggattggttcccagaatgtgatgtattttcttctgtgggtgttcaactcatttgctcttacaactgaaaaaaacagcagtaaaagccaaattgaaccagtccagctgttatactattacttttaaagaatgcctcaaattcttagtgtttacttctagtttagttcgtaccggatttctcttcacatgtcaagctatgaaaaaacaagctgacaaatcaaaaggttgacttcccaatgtcttctgattatatttgactatttatctggacacaagattttgtttatagtagtccttggctttcctctttgtatttacactatggtggctctctctttttggttn

SEQ ID NO: 248785 - DNA, 258 bp, Homo sapiens
ctatggtgaatacaagacttagagaaatgaagtaacttgcctgaagtcacacatgggagctaggggctagcatttcaagccagatttgcctggttccaggattcatgctttgtggcaagagccttgttggaagcccgggtccttctgaattcacggtccattgtgctctgtcttcagtcaggccagattttaaacaggaatgaagaattagcaataatgtttccttatgcaagtcaatgaacttcttcactttagttt

SEQ ID NO: 248786 - DNA, 278 bp, Homo sapiens
ttatataattcctaaataatgttcaattaaaatgaaattataaaatccataaaactcaggggttctacactcacaaaggaatagaaataaaacaagggaaatatttaaaagatataagatctatcaaagttaataacattattgtgatattatactataatttgcaaatgtaaccatgaggaaaaactgggcgatatgggccaggctctttctgttttatttcctacaactgcttgtgaatctataattatttcaataaaattttcaattaaatagcc

SEQ ID NO: 248787 - DNA, 396 bp, Homo sapiens
gtaccatcgaacacttagcaagtactctcttaccttactcaactataaacatattttttacattagctattattgtgtatcattcatgttagaatctcagtgttagctgggtgcggtggctcatgcctgtaattccagcactttgggaggctgaggtgggaggatcacttgagtccaggaacttgagaccagcttgggcaacatagtgagatcccatctctaccaaaaagaaaaaaaattagccaggcatggtggcattcctctagtcctacctactcaggaggctgagatgggatgattgttttagcctagcagctcgaggcttgagtgagcccagattgtgccattgtactccatcctggttgacagagcaccctgtctcaaggaaaaaaaaaa

SEQ ID NO: 248788 - DNA, 611 bp, Homo sapiens
gctccataagcgtgtatcctgaggcagtagaatgtgtaaacatgtgaaatagagagaagaagcagttaattggtagtggcaggagaagtagagttaggatgggagaggtgttgaaaccctagaatagtggagcattaaggtggagaaccatcccactgaacacctggaaatattgatttgggagctgctctgacttctgaagaagcgtgtggttttgaagcctgctgaggcattttcctcttaacttctaggtatattcttgcagtattccctgtcatttcaggcaaccttaacacgtatttgtttcttttcttttcagacagattcttgctctgttgcccagagtggagtgcagtggtgcagtcttggtctgcagcttcaacctcttgggcccgggtgatcctgccatctcagcctcctgagtggctgaaccgcacgtgcatgtcaccatgcttacctaattttttttttttttttaagagatgaagtctcgctatgttgcccaggctggtcttgagctcttgggcttaagcggtccttctgccttgggctccttttgttgggattacatgtgtgagccaccttgaccagctgcatttgtttgtcatgtc

SEQ ID NO: 248789 - DNA, 783 bp, Homo sapiens
gagaatcgcttgaacctgggaggcagaggttgcagtgagccaggattatgccactgcactccagcctgggtgacggagcaagactccaagacttcatctcaaaaaaacaaaaaaagacaacaacaaaaaaaccagttactcaacatagtatcatagttgttacattaagtaacatgcagtagcaaagtaagcagtatcacagagtcatatatgacaagtgttttgagtccataacaagtcctcgttcttgtcctcgcagacttgttgatcccaggcaaggcacttttcctttctgggtcttttatcagtacgacttttgattcagcagcagtagtcttgtttagggggcaggggcagaggttaagggggacagggaagtatataaaggacttttattcttatgaatccaaacagagggcagagttgtctgtgctttgttttggtgccatggatgtttaaaaggataccattgtcttctgttcatttaagctacccattttatcttttctctgttacccagaatatcagtcctgtttaacaaatatgtaatgattcaaaattcatttgcaggtttttaaactttgacagtggtctcctctagcagagatttcagatactatgtattcagagacagaaacatcattctgtgcttatctcagtgaaagaaacccaggaaaggaatcccagcccctcctacatcctctccaagctacaggcatgtggctcatccaggaggggagaagggagcagagaagccaccctgggtgtcttctcacccatact

SEQ ID NO: 248790 - DNA, 423 bp, Homo sapiens
tctgattaaaggaggaagagttaggggagtgaatcttctgtctgccagctctgtcccctttctactcttggagttagcaccttgtctgtgtggtacacaagtggaaaagaggatacactcaacactaaaagttcttgaatgtggataccaagtctaaagcagataggtacctgcttgccaagtgtggtaagttctgggatgggagtcagaaaacttaggtctgccactgacctgctgtgtggccttgagcaagattgtcagcatccctagactcagttttctcatctctagaataaagggattgaataataaagtaatatttaaggattcttttcattctaaatattgcaagcagaatttatattttttaaaaaaagacttttattcttacttataagcataatattcttgttttaaataaaa

SEQ ID NO: 248791 - DNA, 498 bp, Homo sapiens
catacctactgctttaaggtactaaatctaatgcaaaaggctgttagtcaactagtttagcttgtcgaacaggtaaatttgattgacaaaatgcagctcaaattttcttctctaactcagaatatttttgtatacttacagaaataattcacttaacatttaaaaaaataaattatgtatgttagttgccaaactctgtgctacttgtgtcctttaaaagaacactaaagaagaaaatatatcataaatttagtcatagcgatctcgttacaaatcccattttaattaagattttatcgggaataagaaaaaatgatacatttacagacaaattgtacaatttaatataagaaagtatatggtagtaaaatatgctttatactgtaaagaatttttatattgcatgggattgatttgacctgtgaattcaattttgggaagtaataaaaacaaactgtatgtaaataaaggaattgatcagagtccaaaagagatcat

SEQ ID NO: 248792 - DNA, 933 bp, Homo sapiens
tattcatccaagtaactttctgtattgcctttaaagccctgtgcagttgagttacaaagctttgattcttgggtctaaaaaagggacattattatgttaattctcaccttaattctcttgaatagttaaaatcctttgcaacttcaaaaataactgctcaagattcctttcaggaaaagcaatttcagtcaccttgtgctcagtagttaaggtttttgtcttttcatgctggtggcctgggttcaattcctggcttagggaatcagtcttttctgattttatgtgtgtttgactttttgccatttattgcttcctttcctctttgtggacagcttctgatttcgtgtcttgaaattttctttttcctgaactacctttggggagattctacatctcataaaaattgcttgccgtctctttgcccatcgcttgccatctctttggagacacttcatgcatccaaggttaccatcctcttagttaagacttactgatttcatgtagaaggttgcctttagtaaaaaaattcaaaagccagaaatattggccctttgtcttggctaaaagctggtaataaaagatttttaaagaatcttaagatctctatacttaaaagttgacttaattaaagctgatatttggcctatatatgcgtgaatattgttttaaagaccccactctccctctaaagatttctttattgatgaaattctgtcttggatctccgtttttgtctgtgtattatgtgtgttacgtgtgtggtgtaaaagagctgtaattaattgtcctaaatataagcacttaaacatattgtcagaaaaaaatagaaactttaatggatttaggtcatgggactctaatttctttaaaaaagacaatgtaaaagattattggtaaaataaaataaatatattcaaaatttagacatttggt

SEQ ID NO: 248793 - DNA, 415 bp, Homo sapiens
ctgtacttgtcttctaggacattagattttgaatctaaaagcctctttaggatctgaccagggaactcctctttagactggtacatcttgagtgatagggcctctgggtcctccctggggttttgctatttgtgggccacgtgtggagtcaggagtttgaacagaagcaaagatgggatacagaagtcaagactaaggctgggtgtggtgtcccatgcttgtaatcccagcactttgggaggccaagacaggaggatccgttgaggccagggattctcgagatcaacctgggcaacatagtaagatcccatctctacagaattttttttttaaaggagaagtcaaagcttaaaaatgcatgttattcttctgagacaaatgactgatgaaataaacactgcttaactctcactgt

SEQ ID NO: 248794 - DNA, 140 bp, Homo sapiens
agggagaaaatgtttaaatttgtaagaattaaacagattctattttatgattcttttatatgtacaggataaaccagttttaaactcttctttggcaacaaaataaatatccaaataaaatcttaaattttgagccccaa

SEQ ID NO: 248795 - DNA, 341 bp, Homo sapiens
  misc_feature (40)..(41): n is a, c, g, or t
  misc_feature (212)..(212): n is a, c, g, or t
cggccgcgtcgacttttttttttctacaatctagatgganngatgactcagaacatgcgcaattatggaacaattcagagcctcgagtagtcttattttttttctacaatctagatggaaagatgactcagaagcatgcgcaattatggaacaattcagagcctcgagtagtcttattttttttctacaatctagatggaaagatgactcanaagcatgcgcaattatggaacaattcagagcctcgagtagtcttattttttttctacaatctagatggaaagatgactcagaagcatgcgcaattatgtcgaccgccgctaatttagtagtagtagtat

SEQ ID NO: 248796 - DNA, 166 bp, Homo sapiens
ttagagtgcagggctttcaggagagaaattgggaacctggaaatgggccacactcttcagtgaggaagaagcaggcagctctaggcacagccctgcattcctagtggcttccccttcatcaagcttgactccctgctttgatgtctgtcagggaatctacttcagc

SEQ ID NO: 248797 - DNA, 559 bp, Homo sapiens
gacatccccttcattaagatataaaactgcattgctcaagagagcatcagaattactgaaagtgttgtggctatctgccataggtcagagatcatggtgggcagatgttgcaatgaagttgagttccctgatttcagtggaaataatgggtgatggtatggtagagccctggtggtgatgcttagccatcaaaaacatgtttatacaaaattatcattatatgctgctggaataaaggctgccatggtctgaatgtttgtgtctcctcaaaatttaaatgttaaaaccctagcccccaaggtaatggtactaggagtagggcctttggaaggtgagtaggtcatgagggaggagtcctcatgaatgggattgtgcccttataaaacaggcctgagagaggacctctggcttcttctgccatgtgaggacacagaaagaaggagctgtttatgaagcctggccctcaccagacactgaatctcctggcaccttgaccttggacttcccagcccctaaaactatgaaaaataaatatctgttttttataagacaccaagtc

SEQ ID NO: 248798 - DNA, 744 bp, Homo sapiens
atcccttgggctgcaggcattcggtacgagccttattcatggttttcctttctgaggtttcagttacccatggtaactgtggtctcaaaatattaagtggaaacttccagaaagaaacacttcataagttttaaattgcatgctgttctgagtagcatgatgaaatttcgtgctgtcccatctgggatgtgaatcatccctttgttcggtgtatccacgctgtgtatgccacctgcttgttaatcattgagtagccatctctgttatcagacccactgtgatggtatcacagtgcttgtgttcatgtaactcctgttttacttaatggcacaaagcagtgatgctggcatattgttttaattgttctattttattattagttattgttaatttctttttgtgcctcatttataaattaaatatcacaagtatgtatgtataggaaaatacagtatatatagggttcggtactatctgcagttataggtatccattggaggtcttggaatatagctgctgaggataaagggggactattgaaattcatattgcaatcatgtgctaccactctcgtcattcctttaccctggatttttgtttaacatttaggccatttgtttgttatatgttcatttgtattttcggtatgttgttttataaaagtgtctttactttttcatatactgccactgccactaaatggtggtctctaagttcaggaaccttgccttctctcttcttgtg

SEQ ID NO: 248799 - DNA, 198 bp, Homo sapiens
tttcataatattttataacccaaatttatattcaataaaaatacactctctatctcattttatgatctttctggagacatttaaagggagtcatgttaacagtaagttatgactttataaaaagtattttaataagtttgtatattgcatttaaattctctggacatatgattattaaaaattatatttgaaaatgga

SEQ ID NO: 248800 - DNA, 799 bp, Homo sapiens
ttaaataaaagtcaaaaacccttagtgtgcacagcctgattcccagaatatacttgtattctacccgacttccccattgctcactggattctcactaggcttccttttacttcactggtcacagcaagcgtctctcttgttctgggtcctctcaactgcttttctcttgcttctgattctcccagctgtctgcagtgtgctgtcatttgcatcctgcaggtctcagttcaaaggttatttccccagaggagctgcctccatttatttttatgaatgaatgattgcttaccccttccaccctagttgagaaagggtcctaattgggcagcaggtacatcactggactaaatggtaggggcttgtgctccatttcttgatgctaataccatctcccactgactctctcacctaggagatcacacatgtgagtgttggcctggtttagcgttcttcaaattgcagctcaagagactcatgagtgtacagtgaagtctatttagtgggcatagtggactttttttttttttaattaaaaaagggtatagaagactatagaaaatattagcgtatgttgcacatagtagtgtttggtaaactttgttaatttacacgtatattctatgtagacacacacacatatgcacatagacacacacacagaaattgtggtcaaaattttggaaagcaagtctcctagatgacatctgaggttcattccacctctgacgttctaagatcaaatgcaggattactgaacaacctaaagcagataggctttttaaatgctgctttacttaaa

SEQ ID NO: 248801 - DNA, 394 bp, Homo sapiens
acccaggggttaaggatacaagtgaaaattctcagcctaggaggtcggaaggacttgccaggaagtggtggtaggtgaaatgcaatgatagataaaataaaggcatatcagcacatggtaccatggtgctcctgagagattagaggctaacccaaagagttactcagtattttgcattttggcaatgtagcttgaaataatttgtgcaataattttcttcagttctgcctccttccatctctgcatagacagaaagggcaggccctctctgccgtttctgctctcccgtcgttgacttgggaactttggcttgccaattataattagccgtttggtctgttcatgtgttgagttcaagatggtatttttagcattttgactgacaggcgtttca

SEQ ID NO: 248802 - DNA, 399 bp, Homo sapiens
agtttttcagattttggaatatttgcaaatttctctaagggaaaaaagatattttggcatgtaatgcataatatttgcataattataatccagtgttctaaaatgattgtacccaccaaaatctataaacaataaggaactgtggttgtttgctgcaaataactatgataaaccacactgtttgtatcacatgtattagcccattgtgacattgtcaattgaccatatgcacatacatgtatacatgagatatagtatcttggggatggaacccagatgtaaacatgaaatttatttatgttcacatgtacttatacacacagcctgaaggtaatattatacaatattttttatttttattattttttttaagtcaataaatttttattcatggaattc

SEQ ID NO: 248803 - DNA, 365 bp, Homo sapiens
cctgtcaaaaaattcctcaattctgtttgtttccaaagattctatgccttttagttctgactaatagcacatattgacttgcaccaaaagaatccccaaagcaagcctttatcagcctcctctgtatgccacgtgggtaatatatggagatggactttgatactattactgagagttcgcagtattttccaataaatgtctttcccccaaccaaaaataaatacataaaaacttcagtgaacaagagcgagtaagagatatggaagacagcctctttaagaaaatagaaaataatacttcccaaatcattttatgatgtcaacattaccctgataccaaaattcagtaaaggcagttcaagaaaa

SEQ ID NO: 248804 - DNA, 1667 bp, Homo sapiens
  misc_feature (443)..(443): n is a, c, g, or t
atgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgcagagcaattggagaaggtgcttcattttagtcatactgtagactcattaaaaccagggttcaaggactcacctaagtgcagccaagctggaagaattcattccgagtttggtgtcgaattctctcaaatcaaccagccagactctaactgtaccctcagcattgccaacaggctctacgggacaaagacgatggcatttcatcagcaatatttaagctgttctgagaaatggtatcaagccaggttgcaaactgtggattttgaacagtctacagaagaaacgaggaaaangattaatgcttgggttgaaaataaaactaatggaaaagtcgcaaatctctttggaaagagcacaattgacccttcatctgtaatggtcctggtgaataccatatatttcaaaggacaaaggcaaaataaatttcaagtaagagagacagttaaaagtccttttcagctaagtgaaggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctccccagattcaaacttgaaattaagtatgagctaaattccctgttaaaacctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttcctgttctttataaggcacactcataccaacacgatcctattctgtggcaagcttgcctctccctaatcagatggggttgagcaaggctcagagttgcagatgaggtgcagagacaatcctgtgactttcccacggccaaaaagctgttcacacctcacacacctctgtgcctcagtttgctcatctgcaaaataggtctaggatttcttccaaccatttcatgagttgtgaagctaaggctttgttaatcatggaaaaaggtagacttatgcagaaagcctttctggctttcttatctgtggtgtctcatttgagtgctgtccagtgacatgatcaagtcaatgagtaaaattttaagggattagattttcttgacttgtatgtatctgtgagatcttgaataagtgacctgacatctctgcttaaagaaaaccagctgaagggcttcaactttgcttggatttttaaatattttccttgcatatgtaaatagaatgtggtgagttttagttcaaaattctctgttgagaataataaatgcatgaaatacctta

SEQ ID NO: 248805 - DNA, 2079 bp, Homo sapiens
  misc_feature (443)..(443): n is a, c, g, or t
atgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgcagagcaattggagaaggtgcttcattttagtcatactgtagactcattaaaaccagggttcaaggactcacctaagtgcagccaagctggaagaattcattccgagtttggtgtcgaattctctcaaatcaaccagccagactctaactgtaccctcagcattgccaacaggctctacgggacaaagacgatggcatttcatcagcaatatttaagctgttctgagaaatggtatcaagccaggttgcaaactgtggattttgaacagtctacagaagaaacgaggaaaangattaatgcttgggttgaaaataaaactaatggaaaagtcgcaaatctctttggaaagagcacaattgacccttcatctgtaatggtcctggtgaataccatatatttcaaaggacaaaggcaaaataaatttcaagtaagagagacagttaaaagtccttttcagctaagtgaaggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctccccagattcaaacttgaaattaagtatgagctaaattccctgttaaaacctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttcctgttctttataaggcacactcataccaacacgatcctattctgtggcaagcttgcctctccctaatcagatggggttgagcaaggctcagagttgcagatgaggtgcagagacaatcctgtgactttcccacggccaaaaagctgttcacacctcacacacctctgtgcctcagtttgctcatctgcaaaataggtctaggatttcttccaaccatttcatgagttgtgaagctaaggctttgttaatcatggaaaaaggtagacttatgcagaaagcctttctggctttcttatctgtggtgtctcatttgagtgctgtccagtgacatgatcaagtcaatgagtaaaattttaagggattagattttcttgacttgtatgtatctgtgagatcttgaataagtgacctgacatctctgcttaaagaaaaccagctgaagggcttcaactttgcttggatttttaaatattttccttgcatatgtaaatagaatgtggtgagttttagttcaaaattctctgttgagaataataaatgcatgaaataccttaaagctctgtgaagacttgtaacatggcagcaatcaaatggcttataaaaggatactttgaatgtggataaattgaattcagtcaatatttcagtggaatttttggctaattgcttgaattgaattgaattatactactcaattgaataatattttctcctcctccttctccccttccttcttccttctcttcctcctcctcctcttcttcttcttcttccccttctcctcctcttcctcctcctcccccttcttctacttccttctcttcctcctcctcctcttcttcttcttcctcttctcctcctcttcctcctcctccctcttcctcttcttcttcttcttctcctcctccttcttcttctccccttcctcctcctcctcctctgtcctcttcttcttcctcttctttt

SEQ ID NO: 248806 - DNA, 425 bp, Homo sapiens
ggcctgtggcaggggtccgctccctgcgcggagctccggccggcccggcacatttggggctcgcctgccatgccctgggcgcaccgccccgaaaaccctgcccttcagagagatggagcaaagtgatttgcttggtgacttttgagccgttatgcctgtcgatcagggaggagagcgagggaagcctccctcctccgcagcctggacagggggccggggcttcagtgtcccctgcacccgctgacagcctctggggacgtacgcatcctcaacccagcagacaattattcccttgctaacactgggacccagaggcagaagttggtttttttttttttttaaggtgtgtgaaatcgttgcagagatctgtatctgcactgccttgagaaatcctttgcaggcagcggactgaaactgtagactcg

SEQ ID NO: 248807 - DNA, 724 bp, Homo sapiens
tttttttttttttttttgatacagagtcttactctatcactcaggctggagtagagtgtagcgatctctcctcactgcagcccctgccttccccaggctcaagcgatgctcccacctcaacctcccgaatagctgggattgtaggtgcacaccaccacgcctggctaatttttgtttcatgttggccaggctatcctcgaactcctgacctcaagttatctgctggcttcggccttccagaatgctgggattataggcgtgagccggcgcacacagcctgtttttccatttttaatagggtggttagggtaggactccctgggaaagtgagttttgaacaaaggcatggagggaggtgagggagtgaatcaaggggatcagaagaggaagaagtggagaccttcccaggaagagagaatagcccgagtggagattcctccaggtgttcaaaggacaagcaaagagactgacatagctgcggggcactgagtgagggggaaaagaagaagcgatgtcaggaataaatttacagaagggtacagattgagtaaggcttgaaggctattaaaaaataaaattttacgcctggcgtggtggctcatgcctgtaatcctagcactttgggaggctgagaaaggtggatcacttgagctcaagagttggagatcagccttggccaacatggggaaacctcatttctgctaaaaatacaaaaattagctga

SEQ ID NO: 248808 - DNA, 235 bp, Homo sapiens
ggcgcctggaccaggttcccctggggaaattgggcccctccctgagccacccggggcccaccgccccctttccacctgggaccgagcatcctccagagggtcagccctcctgagggaacaccatgcccagccccaggaccctccctcaactctccagcaaggctgcactgtgggcggcccctgcacataccccagcagtccatgctgtgatgtaacatgacatggtgtgacgtgg

SEQ ID NO: 248809 - DNA, 499 bp, Homo sapiens
ctggttgacagttctggaaaggactcgaagacaaattacttccaccatggaggcaacattcaggcagcttggagaggaggccaatgctcaggcatcacatctctcaacccagcagagcccatggctgcctagacaacgagaaggccctagcacaggctctggcacatgctccaggcagcagggttaatgcaccctggagccgggatgccccagcatgaggactgtcttcctgggagctggcatcctggccagcactcaacacatgctgctcagtgacggaacccatccgtcatcagttatcagcataatttattacccactgacacagtaaggtctggaaggacttttgaaataagatgacttttaaaaactatacctgtaaaccctgtttaccctgacgtgattattatgcattgtatgcctgtatcaaaatctcatgtaacccataaatatatatacctaatatgtacccacaaaaataaaaaaataaaatgacaaa

SEQ ID NO: 248810 - DNA, 336 bp, Homo sapiens
gggtctggaggcaggagttatcatctgcatttcctggagaagaaaacagaagctcaaaaaggtctatttacttctccaaatcatggaatccataacccatctactcctcacctctacacaggggagcacaccaattaacagctacaaaaaaaaaaaaaaaaaaaaaaaaaaaagctggggtttacactcagaaaaaaagttaagtgagtttccttgaaagtattcttcaatgggaaccagtttggggtagatgtggattggtaaaggtgacagagagtggggcaaaggaggtgtgacagatcttacccgctcattatattcagcaaaaactgaatc

SEQ ID NO: 248811 - DNA, 368 bp, Homo sapiens
ccctgtctcatgacttcaccactcacgcctcgaccaatcagcaatccccacactttagcccatcacccatgcagactccctaaaaacatgtccacacctgtgatcccagcactttgggaggctgaggtgggtggatcacgaggtcaggagatcaagaccatcctggctaacacagtgaaaccccgtctctactaaaaatacaaaaaaattagctgggcgtggttgtgggtgcctttagtctcagctactcaggaggctgaggcaggagaatggcatgaacccaggaggctgagcttgcagtgagccgagatcacgccactgcactctagcctgagcgacagagcgagattccgtctcaaaaaaaaaaa

SEQ ID NO: 248812 - DNA, 733 bp, Homo sapiens
gaaattcatcccggatcctcacatttctgatgtgattagaaactgcaaagcagggccagttttgcagagtggtgaataggagatctaagaatcagctttgatagcatgtcttaattcagtgaggttttcttcagacttttttcctaacaacagtttaccaattgcatttcttcatattaaagttattattttacagctaccatgtcataaccaacaataaactaaatgacttagtagtgcaggttatgactaatgaactttcgtctattccacaagaagttatggagtgcctgctatatgccagatcctagagatacaaagtctgagcttcaggatcagggagggctgcaatctaataaataattctaatacagtgtaagaaatagaatcatatgtctgctaaatgaacagcaggaacagagagttgtagccacctccatgggcaggaaggagttaggagatcagttcatttggaaggctttgtaaaggaaagggtatgaactgggttgaaagattcaaaggtgagctgtaaacctcctggcgtgctgttggagaaggcgtgctgagcgccgagcgtgtgcgatagcgtccaagttgaaaggcaccttggacgtcctctgattccgtatcccagtcaggatgtccctgccagggaagcagtgtgctagcacattggttttccaagagtgatctgggacatagtttcacattttccttccaaaattagggatgg

SEQ ID NO: 248813 - DNA, 377 bp, Homo sapiens
tcactaccacatattattcttctcctttacttaatattacttgatgatcctcagttatgtgcaaggcattatattctcaggaaattcctttattcttgacctattccttttgctcccttttatgatatgccaagatacattgcctttataacatccatataggggctttgagaatctctatctggaagacggactacattatgtttaccaatgaatgttttggagagaaggaagaaaccatcttatttcaggagtgagtgggctcccctctgtgaataagcactgcttccaatgtgcacatacacagctaatgatccagcaggcaaaaataattttaataatttcattaacagtgggaataaaaaaattgctgaata

SEQ ID NO: 248814 - DNA, 473 bp, Homo sapiens
attcatttcacaaaacaagttgttctctgtgtgtaagcctgttctctttctaatcatactatttcctccttctttcctaccttctggtcattagtatgcaaatgttaaaaattcagagtaagataatgtttcctgctcatggcaaataggaaaaaccaatatttatttaatgttcctttacacacagattttcattttatcttctggtaactctgaacaaggtataattattttcagatacattttatttatgagaaaactgaagctcagataattaaatgacttggctctgttgatatctgagtctagagagtgaaaccatggagatcttttagtagagccacctgtcaggaccaatatatcactgaggcatattgttttcacacttgtctccctgatactcttcccattctcctttggcccttcttcaaagcttcatttgagaccctggattttggcttccaaatcctgat

SEQ ID NO: 248815 - DNA, 119 bp, Homo sapiens
tctaaagccaagtccatccatgagtttgtaccctcaaatacttgtgagttgggtaaacgcctctcttcctgagatcccaagaacatgtgggtcctgggcctgttggaaagtggcattct

SEQ ID NO: 248816 - DNA, 503 bp, Homo sapiens
cagtggcagtgagttgtgctatgggatggtgtcccctttttctactcccttccctgtgtctaggagaatgccaccatttggggctagcttctctccaacactattaagtacctgccaacctccctttttaacaaagatcaggtcttgggccaccatgagtaggcagtcaaaagtcattggctagcatgcaaaaacattttttgatttttaaaatattattactggcaattattgcatcaatcctgatttcctatttataagaaatagaaaatgtatgttttaatacatttatgtaagttcagtttatggagagctctgcgataagttatggcaccaacagcaaccagtcatgacagcagttgccaagaggggacaggcgcagtggctcacaacagtaatcccagcaatttgggaggcccagcacttggggaagcccaggagttcaagtccagcctgggaaacatgacaaaatcctgtctctattaaaaactaaaaaaaagaaa

SEQ ID NO: 248817 - DNA, 567 bp, Homo sapiens
tggatcagggaagcacaccacttatgatactaagatcagaaagaaatttgtcctaagttgtgcataaagattaatgatatacatatataaatcatggtatctgctcaacttagtgtgtttgatatattttagttcctctcctgtcccttttttcccctatggatttctgtggaagattgtagtatatttgaaagttctttgaaaattgtaaatactattgttagtttataattaaaagaaagcggccgggcgtggtggctcacgcctgtaatcccagcactttgggaggccgaggcgggtggatcacgaggtcaggagatcgagaccatcttggctaatatggtgaagccccgtctctactaaaaatacaaaaaattagctgggcgtggtggcgggcgcctgtagtcccagctactcgggatgctgaggcaggagaatggcgtgaacccgggaggcggagcttgcagtgagcccagatagcgccactgcagtccggcctgggcgaaagagcaagactccgtctcaaaaacaaaaacaaaaacaaaaacaaaacaaaacaaaacaaaa

SEQ ID NO: 248818 - DNA, 876 bp, Homo sapiens
ccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaa

SEQ ID NO: 248819 - DNA, 1895 bp, Homo sapiens
accgcttgaccaggtggcttgagcaagactccagtttggttactgtgtccggagaaactgtgattatacaccgcttctcgttccccttcctgtgccctcagtgttaattcactttataaaaatataaatatataatatatttttctttttacaaataagccaatggagataatttagtattactaacatagtatttataggcttaagacaaatgtacttgtgggcgatcaaatgtaattactgttacagactttacaaaaccatacgtggttctcaggcaacacaaagtagagagggaattctgtgttttaaaaactgtcaaaaaggaaattgagagtcatcctagacttaacatgcttgcgtcctcaactcctgcttttcgttcccaccccaactccccttttttgtctccttaataaatggctttatttttttaatttttaaaattctatattaatcaagaggagacattaactttactgctgacgcaaaactgtattcagctagatccacaatatgaaaatgtataagctcaacatcaaattatttacatcttctcttttttaacttaattagagttttagctcctgtgcctcattttttacaatgtatgagaatctagatgtttagctaacatcttttctttttggggggaaagggtagaaggagggaataaaggtgccattctttttgggagatacatgattttaaaataatacccaaagtctaatattttggctaaaaagactgttacatagctcattttaactattgtgcttgaacctggaaagaatgtttctttttttgtccctaagaaatgggtataaatgaagtttgacaggaaatttaaagctaccaaagctttgaaaatgttgccaagcattagattgcctataaagaaggtaaaaggtggaaagtcttactaaaaatctagaagcagtagtcgagacaacaaaaaaactcatcctcttcaaagttcatattccctgaattatttacttagaagcattaaacagtctcttttctcctgaggcaagggtgtgtattcgactctgtgattgagatccaaggaatattggcactcattttaggtaacaatattttgttaccagattttgctgaattcaaagcattcttgaaaatgtgcgagatttttctatagtaaatataaatgcgtttatctgtgatatcctgcaattattataataattttggttaaacatttgtggcagtttttccaaggtctttgttttcaagtcttgatgcctgtggtgaattattagttaagatatttcaaaaataaaataaatttagactttagagccacaataaagctgagctaggttcctattctgtataatcagcaacacacagaaactccaaatcttgattgttttgttggacccgtgaattctattgggaaatatttgttcttcaaggcaacctcataattcacattagctagaaaggtaggtggtattttgtacattaatttagtgtataaccaggacaaatttcattctgaattgctttgctaaatcatcacagagctgagctctcccatggtcagggaactccttccaacaccaagtcataagcacataaagacccgttcctctaagctgtgacctttcatctggctaaggagtgggaagtcagccatggactttgtgtcgtggagttaacctcatgttcatgacttttcctccatagagaaatattcatttatacatccagaaacaagaagaaagggcagagaatgtcttgctttatgtttttgtattgatagtgatgagagctgccatttttgagccagcatgcatgccagcactgtgctaagtgacttacatggatcacatatgtaagtcatagttactaatcttaaaaaaaaagaa

SEQ ID NO: 248820 - DNA, 386 bp, Homo sapiens
acactcacctgtgatggtcctctggccctgctttgtgagtcacagcactgagtgagccatcacagagggcaagaggagtactcctgggagccgttcctgcactggaagagctggtaatgacttcactagacacggatgtgactatgaaccacacaaatattcacaactcaacttctcctttatttgagtccaaaaatgtccagagccactcccagaaccagccatataactcacggggcccagtgcaaaatgaaaatatgggtccctgctgggggtagtggctcacgcctctaatctcagcactttgggaggcccaagcaggtagatttcttgagctcaggagttggagaccagcctgggcaacatggtgagactccgtctctatc

SEQ ID NO: 248821 - DNA, 524 bp, Homo sapiens
ggtaaagtgtgccgtgctcagtgggccgtccagtcccctactttctcattgtcttacagccaactgctatcctgtctgtgccctgatttcctcatttgaaaataggagtaatagtagttcctacctcctggggttgtaaggagaattaacagagataacttatgagtagcactcgaatagcattcagaaatgtgagctattactgttattgctgttattattgatattgttattattattaccttgccaggctttgagtttgtgtgaggatttcagaaagctggaagatgatcataacagggattgagaggtgagtgaagcttcccttaatcaatgatggcaccaaaccagaaagcaggagagacggaagcacagctcccagacacagaaaattgcgtccgcctgagcggtatcagccccacaaatcagagttaatttctcttcttctgcagagctcggcacagtggcctggatcacacagtgactcatctaatagccctgtgagtttgcccagcttgcggcat

SEQ ID NO: 248822 - DNA, 865 bp, Homo sapiens
tttgtagaaactgggtctcactttgttccttaggctagtcttgaagtcttgggctcgagcgatcctcccttctcagattacagtaggaagcactgggattacaggggtgagccactgtgcccagccttctcaatttttttacccctatatttgttctaaggatatagacagggtaacaggaaaaactcaatatttcttttggaataaattgccctctaatcacttgataagcatctctatcattattctgtgcctaaaattagagaattatctgctcagtccttattcctgcagaatacaaatgtcacattctaacctgttaagagattgtcttcaaaataaaactgttattaactacattaatgttagacaagtacactttagggcaaaaggcattattagggatagatttcataatgatagagttctatagtagaatatagtaatgcaactgaacaaaatgaagctcattccactgcatggaagaatctcacagatgtgatgctgaacaaaggaagccacgtacaaacacttactatataattttatgtacatcaagttcagaaacaggatagttacctttgggaaggaggtaactgaaagagtatgaggaggggtttctggtatctggttaatgtactttgtaccagttacccaggagtgtttcaaaaattattataattgagcaaggagctagcaaccaattcttttcttaagtcagcagattattctagccaataagtaaggccctcttataaagaacccaagataccatggactgagtttcaacatgaaactcttacatgtgcatatattgcattgtcctgaccacggcatatctataggaaaaatatttcactgacca

SEQ ID NO: 248823 - DNA, 468 bp, Homo sapiens
atctcactgggtttctttaaagtcctgttgctgctaactttatcttatttggagagggtagaatcaactaatctctgtagaccagctatgtatctaagctctgttaaccacaggaagatcatgtatcccttttttataagtgggtttatttgcaggttgaagtcttagtgaaagatagtatcctgtagaatgctgttcaccactagtgatcatctgttaagtacaaacttgaaagaggtctctaccaataaatttttcttaaatttcacaaaacaagtcatctgggttagctgatagtgaggtgcagtgagacttttatcactgaatagacaaatcatttgtgccgaaaatacatctggaatattaaatggctatgtttaaaattgttcataatacctatgcaagttgttacctcaactgttacacacttcttaatacctcattaaaaatttacatggtcaagataac

SEQ ID NO: 248824 - DNA, 571 bp, Homo sapiens
ttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccagggaaagaaatgaatgtttggggcagggtagcagagatactttacaatataactctttttttttttttt

SEQ ID NO: 248825 - DNA, 580 bp, Homo sapiens
gggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacct

SEQ ID NO: 248826 - DNA, 323 bp, Homo sapiens
atcctgttaagtcagagtactgttggagaaggtttttgctttttatatttgggattaaatcttgggattgggtgttgtggctcacgcctatgatcccaggactttgggaggctgaagcaggtggatcacttgaggccaggagttcaagaccagcctggccaacatggcgaaaccctgtctctgctaaaaatacagaaattaccaggcgtggtggtgcatgccggtaatcccagctccttgggaggctgaggcacaagaatcgcttgaaccaggaggcagagggtgcagtgagccaagattgcatcactgcactccagcctggg

SEQ ID NO: 248827 - DNA, 442 bp, Homo sapiens
aatataattacatcatcatctgaagtggtattgtgttagatctcgatgtgaattttgcatccaaaggggaagacaggtggtggtagaatccagcttcctaatacgctttgcaaaggctttgtagtattagtttgtggtttatgaattagagatgctaattttataaaattagcataatgggaaaagaataatagcatgtcagctgttaaactttgaggcaatagtggttgcttgtttgctattcagtgagtgtccttgagtagtttattttatcaatactatacagtattaggaaataactttttccttctagttagtggtatagctagttttttgtctcttaagtaaaattctagaaaagccaattgtatccttaaatgtttttgtattctatttaagaaacagtttctttcttgttgctttcaggacaaaagaaagaaaa

SEQ ID NO: 248828 - DNA, 489 bp, Homo sapiens
ctgttgtcatgatacaggttttaattttgtatttttttatttatacagccatgcatcacttaatgacaaaaatacatctgaggaacttgtcattagtctgttttgttattgtgggaatatcatagacttacacaaacctagatggtgtagtctaccgtacaccttcactgtatggtacagcctgtagctcctaggctacaaagttgtacagcatgccactgtactgaatactgtaggcaactgcaatgcaatgttaagtatttgcatatctaaacatatctaaacatagaaaaggtatagtacaaatacagaattataatcttatgggaccaccactgtataatatatgcagtttgtcattgaccaaagcattgttatgcagcatatgactgtgcttaatattaaaagacttttccaaatcattccagtatttttaagaactgcctaatttacttaagcctagtgcattaatattgtcatgcactactg

SEQ ID NO: 248829 - DNA, 666 bp, Homo sapiens
tggaggtgagaaaacagagcagcgtatggcaaaatagtctaagaacaagtagtaaaagcatcagcatcaaaaactccaggctataaaagactaggctcagaaagtgcagttttccacccacagctggggtgcttccaatagcatccttgagacagactccgctctagtacctccagcgaggagttcactactgcaacaagcagcccattcttggatttttattttttttaacttccattttttcttatacatcaagttctcactcctttatatttgatgacatgcacgttcagaactgctgaatatttccccttttatccatgccttcactgctcaatcacctttatacagtttctttacggcagcagtgaaagaagtgactcagaagacccgtctttgaaaaaacaaactataaaatgtatccactctgaccaaagcaaaaaaagacatattccttcccctctccacacagaaaaattcgggatattgagatctccctaaaggaggtcctaaaaagtcagtatatgttggggtaagaagagaagatgcacgccctaagtagagataaaaagagccagattttaaaactctttgttccctaactccttgtatgtaatgctcttattgaaaatgttaaccgattattttgaatgattatttttttgg

SEQ ID NO: 248830 - DNA, 270 bp, Homo sapiens
gtgctttttggtctcctggtttgagtttcagtcccaagctgaagttgaccactgggtatgtccatcaccatctacccctcagacaaaggtagatgggtggattgtgtggggctcagtagagggggattggggcctggacagagggaattagaaatattgtggctcacacctgtaatcccagcactttgggagaccaaggtgggtggatcatgaggtcaggagttcgagaccagactggccagcttggtaaaaccccgtctctactaaaaa

SEQ ID NO: 248831 - DNA, 533 bp, Homo sapiens
gggcaacaagaatgagactccatctcaaaaaaaaaaaaaaaaaatgaaaatgtgtcgttaatcatcgagatagtctttcagtctgcactcagtaatattaatgccttctcattgaagtcatctattctgttcccataaagatcaggatagtttaggtagtggtgaataaataaggttctcaatggcctattagtttttttaaatgttcaaaagatagtagcatgttgggaaaagagatgaattccacatttcttttggtacagtacaacttactgaaattgctttcttatttcaacaaggatttaccaggttgtgtgtagtggttaaaagcatggactttacagccacattacatgggttcaaatccacttactagttatgttaaccacaggaagttagctaatgtctctctgcctcagttttctgtttgtaaattaggataaaaatctccgtagatgtgaatatgtatagctagatagtagattgtattcaaaatcccaatcataacataataaaaatattaactattatta

SEQ ID NO: 248832 - DNA, 459 bp, Homo sapiens
tgtcatttccagatctgccagagcctgatctcatacacactgatgtggtacaggaaatgccacctgaaaatatggtaccttggcatttgaggaaacagtagaaggaggtcatagaaactagaaagaattcctccttgctctttgtcccccaaaggagccataaaacctgggccgagtttcttctgaaaataagttataagatccttattccagaggggtcctgccctgtgcctggaggaaaagaatgaagacacagagatgccttgaagaatctgaacaaacagcccttgctaagttccccccagtttattgacattagattagaccttttgtcctccaattatacttctgtgttcctgaaaatacacattttcccgttttttcttttgtttgctttttttgatcttcatttctgaagattcccatgtcatgtaaaatatatgttaaacaaatgtgtat

SEQ ID NO: 248833 - DNA, 592 bp, Homo sapiens
tactatacagctagcaatatcgttgttaggtatatgccccagagacttgaatacagttacatgctccatcagatacctgtacccaaatgttcctatcggtattactcatggtagccaaaaggtagaaacaacccaaatatctacaaatagatgaatggataaataaaatgcagtgtatccatatggaatattacttggtctcaaaaggaaggaagtacttatgcaagctacaacatggataaacttcaaaacaatatgccaagtgaaagaatccaaatgcaaaaggtcaaacggtatgcttccatttagaggaaatagtcagaacaaataaatccatagacaccaattaggttggtgtatcccaggggctgggcatggagtggggtggagagaggaggggggcctgcttgatggatacagagttttctttgggggcgatgaaagtgttttggaactagatagagggggtggttgcacaacattgtgaatgtactataataaatgccacagaattgtgtactctaaaatggtttaattgctgtgcatggtggctcacgcctataatcccagcactttgggaagccaggatggg

SEQ ID NO: 248834 - DNA, 544 bp, Homo sapiens
tactatacagctagcaatatcgttgttaggtatatgccccagagacttgaatacagttacatgctccatcagatacctgtacccaaatgttcctatcggtattactcatggtagccaaaaggtagaaacaacccaaatatctacaaatagatgaatggataaataaaatgcagtgtatccatatggaatattacttggtctcaaaaggaaggaagtacttatgcaagctacaacatggataaacttcaaaacaatatgccaagtgaaagaatccaaatgcaaaaggtcaaacggtatgcttccatttagaggaaatagtcagaacaaataaatccatagacaccaattaggttggtgtatcccaggggctgggcatggagtggggtggagagaggaggggggcctgcttgatggatacagagttttctttgggggcgatgaaagtgtatatggcaccaatcactaatcgactacctgcagaccgggagatcccactagttctagagcggccgccaacgcggtggcagctccagcttaaggtacc

SEQ ID NO: 248835 - DNA, 534 bp, Homo sapiens
cactaaattgcacgtttaaaatgtatacataaattatatctcattataaaccacacacacttagaagaggttccatttgccctcttaagaaaaaaatcaataagcttatttaggccacctcctaccttctgctaaattagccttatattcattacattcttcgattaaaacattttaaaactctaaatttgagactttaaaaggttaaaactagtctctccatgggctggattttgaggcacagaatggttctgggcttcctcctatttttgatgctcccgttgagtctatttggaagctcctcttctgctatatcttgatatccctagccctcttctcagtccacactcttactagatgatttcattccacttctacagccacaaataacatcttaatgttgatgattcttaaatatttccagacagatctctctcaggtccacacacaacttttcattagacatctctactgggtgtcttacagacactgaaatcaacatgtctaaaacttgactcatcgtcactcctccca

SEQ ID NO: 248836 - DNA, 326 bp, Homo sapiens
tggaaaggaagacagtaagaagagaggaacaaaggttctgcaaaacaagcagagaacaagttgataatatggcagcatcaagtctttacctattaataattaacttgagtgtaaattgattaaattcttctttgaaaagacgcagagtggctaatggatagaaaaataagacctaactatatgctgcccccaagagactcacttcacccttaagaacatgtgtagactgaaaatgatggatgggaaaaggtattccacgcaaatataaactaaaagaaagcagaaattcctatatttctatctgataaatggaatacaagtaaaaa

SEQ ID NO: 248837 - DNA, 455 bp, Homo sapiens
ggaatatggagctaaaattattctgcctgttaagacggaagttccaatagaagctcaagtgaaaaatgaataaaacataaacagtacagaacagtaatacttatagactatacatacgatgattaatatagaacgtaagtattattactctatacaactggcctatgaattgttttttctaaacaataaaaacttgcagatatgtgaattaaagaatgaagaatcttaaaatgaagaaaaaaccaaacttcctctgaagaggctatataccagactgcgtctccctcaccttttttaatgcagaccttactgccagtggtggcgctagaaaatcgaaggaagcaacagaatgtgtagaaacttgttaactagaaaattcggtgaaaacgaaagcagacattctcctattcagttacaatgtaggcttctggtaatacggtttatttattctgctt

SEQ ID NO: 248838 - DNA, 268 bp, Homo sapiens
cagcaccatcagatcatgccgccgtctgctgttttgctgtccaccgcctgctgtagcatgtgtgcccccttgcagggtggagagcaggacgtgggggctttattatttcagaaaaatgcgttgcttctctttgttactgccttgtatttctattttaatctgtcatccttgccctttaagaaagcgatccagtaatataccctagctgttttccagttagagtaaattgactagatttgatgctcacattaattatgtaagagaaacc

SEQ ID NO: 248839 - DNA, 220 bp, Homo sapiens
gtgggacgttgcccgggagagctgcgtgcctgctctgtgtggtaagggtggcgcttcccgaaggcccccttcccttcgtggagcgtacatggtgcctgcgagtgtgggccatggtgtctgttctccgggagctggtatcccaggctgatttcattcctgctgagtgagggagctcactggcctagtcactgcagtgacatcctgtgagccccaaggtgca

SEQ ID NO: 248840 - DNA, 461 bp, Homo sapiens
acaaatacaaaaattagccgggtgtggtggtatgcatctgtagttccagctactcaggaggctgaggtgggaggatcgcttgaactcaggaggtggaggttgcagtgaacagagaacgcaccggtacctggacaacaaagtgagaccctgtcataaaataaaatagttaaacccaggccaggaggggtggctcatgcctgtaatcccagcactttggaaggccaaggtaggctgatcacgtgacgtcaggaggttgagaccagcctggccaacatggtgaaaccccgtctctactaaaaatacaaaaattaaccaagcgtggtggcaggcacctgtagtcccagctactctggaggctgagacaggagaattactagaacccgggaggcagaggttgcagtgagccaagatcttaccattgcactgcagcctgggcgacagagtgacactctgtcgaaaaa

SEQ ID NO: 248841 - DNA, 519 bp, Homo sapiens
gcaaaaccctattagggattctttccttatccttaggggtaaaggaacttcttttgagcttggtgtctgttaatagccactgggatagtataatctatatggcctttcagctgaatattttaattatgttttaaggaataatgtttcatgagatgatcagagttttccaaaggaaaaataattgggtaagttcgggatatgttacattcagcacatgggtgcattctggagaatagatgatgcacattggcatattaaagcatctctaggcagggctctgtggctcatgcttgtaaccccagcaatttggtagtccaaggtaggcagatcacttgaggtcagcagtttgagaacagcctggccaacatggtgaaatcccacctctgccaaaaatataaacattagctagctgggcatagaggcacacccctgtaatcccacctactctgtaggctgaggcatgagaatcacttgaacctggaggcagaggtttcagtgagcccctccccaccccccgcc

SEQ ID NO: 248842 - DNA, 1474 bp, Homo sapiens
cagcaaaatgccgtgactgggtagcttataaacaaaagtaatttgtcaccattcttgagtctcagaagtccactcaaggcacagactgtgcctggtgagggcccactttcaggttcataagtgatacttggctatatcctcacatggtggaaagaacaggacagcactctggagtctcttttatcagggcactaatcacattcatgagggctctaccttcctaattgaatcatagccccacctcctaatactatcatattggtaattagacttccacatatgaattttgtgggggacacaaacattcggagtatagcacaggttcacaggaaaaacgtaaggaaaagagtactcagaatatagggtgatagatacatataattttaaggtaattcaaaggagggagtgattaacttgtgactgaatcaacaaagactttttgatgagtttgtagctgaggttaagcataaaacagttttttagtggaaaatttgaagcatgtcattgttgggcagaggaattgacatgtaccagaaaatcagaagtatgaaacatcagatgctaacagaaagagacaggtacatcaatatttgtaaagcaaagaaatgaggatgaaaatcagtaggaacaagccatattaagaaagtatattgactattttaaagtaacagactgtgtgttcatttattcttttgttcattcttggagtttcttattcacataaggaaagccactatataatttttaataagatggatccattataatagaaattaaatagcagaaatacatataagagtgaacagtgtgacagtacctagtcttggtaagaatatggagcaccgattgtgaatacatgaattgttcaaaccacctcaaaaatcattttcattatgagaactggaacatatgtatatcctgtgacccagtatttctattctttgtcttctagagaaactttttgtcatatataccataaggcctatacactattattcctagcaacatttattgaaatagcaaaaaattagaactgcccaaacatccatagacagagaatagattaataaattgtagtgttcttatccagactctgccgcctagtaacatttattttaggcaagttgcttaatccctttgaattttagtctcttcatacggagtaggttgataatactatgtacctcaaaggattattgtgaagattgagttaacccatgtaaagtagttgagactgtctgatacacagaaaatgctcaatatattttagctatcattggtacacagaggtcaaaatgactgattattgctacacatgtcaaggtgaatgaatttcactgaaaaaaaattgagcaaaaaaatttcagaatgtcccatgatatcagtcagttcaaaagcatctataactaaatattgttcagggatatttgtgtagtaaaactgtaaagaagataagaaaatgaaaaaaaatatg

SEQ ID NO: 248843 - DNA, 513 bp, Homo sapiens
cagaaaaatagaaaccaaagaaagatctggtttgatgtattcttacaacattgggctgtatggatgagagaactatggcagtggaggaaggaaagaagtagatgtaagagatgtgatagggcaggattttaagggtttttaatccagggtccatgacagggttgggggccaaatcttgcatggacttcatagaatgtaaaccctttaatttgcatacaaagttgtgcatgtgtatgtatataaatcctattgctgatgtggtccatggctttcatggggtctagaaatgcactgtccagtatggtagccactagtcacatgtggctattgagaacctgaaatatggctggcctgaatcaagatgtgctgtgtgaaataatacgtgccagactccaaagacttactaccaaaaatgaatgtaaaatacctcataatttttatattaattacatgctaaaatcttttttatatatactgggttaaataaaatatattattaaaattaaaatcacc

SEQ ID NO: 248844 - DNA, 930 bp, Homo sapiens
gccgggggtaatcggccgagggccagacctgatcacctgtctggaacaagaaaaagagccttggactagaaagagacataggatggtggccgaacccccaggctggagtgcagtgactgcagcttcaaccttcagggctcaagtgctcctttcacctcagcctcctgactagctggaactacagagatgcactaccatgcctggctaattttttgattatttgtagggatggagtcttactgtgttgcctaggctcgtctcaaacttctggccccaagagatcctcacatcttggtctcccaaagtgttgaaattataggcatgagccacagcacccacctggtattcctaaatttaataagacttgttgtgtatcctaacagaatacaccaggtgcaaataagaatattgtgtgttttcttgcttttaactggaaagtagtttacatgtctgttaagcctagtttatctatggtacaacctgaatgttcacgttccccaaacatcatgctgcaacgcagtcctcaatgttggatgcagaacctggtgggaggtgttctagtcatgggggcaaatttctcatgaatagcttggcatcaccctcttggtaatcaaaaactttaccctctgttaatttaaatgagagctggctcattaaaattacctggcttctttatttcacacttgctctgtcccttaccatgtgatatgttcacatagtactcacataagttactctttgtgtttcaccatgattgtaagctttgtgagaccctcaccagaagtcgatgctggcatgcacttcttgtacagtctgccaaactgtgtaccaaataaacttttccttttctctttttttggttttgagacatagtctcactctgtcacctaggctggactgcagtggcacaatcttggctcactgcaacct

SEQ ID NO: 248845 - DNA, 171 bp, Homo sapiens
aacatggctctataaaaaatacaaacattagcccggcctggtggtgtgtgcctgcatttccaactacttaagaggccaaggcaggaggatcatttgagcccaggaggcagaggttgcactgattcaaaatcacggcactccagcctgggcgacattgcgagaccctgtctg

SEQ ID NO: 248846 - DNA, 960 bp, Homo sapiens
gcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaa

SEQ ID NO: 248847 - DNA, 471 bp, Homo sapiens
gtaaatatttaattaattattaaccattgcccctaacattaaggatgcatgaagcaaaagttaaaacccgcagcggaacccgagagcgtttcttggcaccttgaggtgctggaggctttctggccgcgcaagttctgccccactgagatttgatcagtgaataagtgcaatcctgaagcagcagcatcagagaatacggcttacggattaaggcctctagttttggattcagaaacagaacattgcatccgtgaaggaatttgtgaagtttagttgtgcaggaaatgtttttcatgtctgcgtttcttgactaggatctcccatttcttgtgggttattgtctgttttaattgaggtaacctttagaagtatacaagtgtgccccactgtcagaaaatgctgtgcaggtgttcctcagtgtccttgggggactggttccaggatgcctgcagatgccaaaatccacggatg

SEQ ID NO: 248848 - DNA, 538 bp, Homo sapiens
cctccttcccctccttttcctgtccttccccctgaggcctcaaagcccctgtgcctgagctgtggacaagaaacacgcctgcctcagaagctgcctggagctgggtgaaggcttccattcagctcgctgtcatgctctcactcagaggagagatcatgcagaaattactgaagtaaaatgctaatgtgttgagttaatgatcacaggtttacgttttataaaagacatcttaataatcaaactattgttgagctaccttgcgttttatcttgaattctctggagttaggtaatttacatacgtgtttcagagtacacactttgtttaagctgtcttagctgtcaacaaacactctaaattatgaattatgagttttatatctaaagctaaacattttgtactgtaaaatccagtgctacttactatgccctagagtaacactacaagagtaaaatctgatctcaatgatggatgtttgtttttcttttatgcagtacacattttggaactttatacccaagaatttatttgaacaatt

SEQ ID NO: 248849 - DNA, 382 bp, Homo sapiens
ccggccgcgttctgttcttatgtacacgccctgagctgtttccactggcagtcagctttgaagttcactgtgtggctctcacaggagcgcagaccctcctggtgctcaccagaagaccttggcccatgagggctgcgtaagacagggtggctcgggcctggggtgctgggccccaggtctccctgcagccctgaacgatgctctcagcagcaggtacaggtctccgttccgacgaacgtgcctcaaggcaacactctgggcaagagcttttgatgcaggttctgaggcagctgcctaacaccgctctcctttccgcagtgtgcaggagaagagaattgggtggacagcaggaccatctacgtgggacacagggagccacctc

SEQ ID NO: 248850 - DNA, 462 bp, Homo sapiens
ttcacattattgtaagaggacaaagaggtctttgtgggataaaactgtgaagaattaatggctgaaaatgtatcaaatttctcaaaagatataaaccagatttttaaagttcagtaaatgtcaagcaggataaaccaaaagaaacccattgcaagacatatcataatcaaactgcggaaaattaagaaaacacaaaacaattttgaaagcagccaaagggaaatgaaagataaaataccaaatgaatgattgtagatttctcatcgggaacccaggagccagaaaaaaatgtcataacattcagtaaataccaaaggaaaaatacattatcaacccagaatggtatgtggagcaaaagtatcttccagacataaaggcaaataaatgcattctcattggaaggtaaataaatacattctcagtcctagcaaaactgctggaaaagaattagcaaaggtttga

SEQ ID NO: 248851 - DNA, 395 bp, Homo sapiens
caagtgacggaatctgcaaaatatccttaggcacaactttactgccagttgagtcaatgacaatataaaagcaaggatatttgcctttgctttgttggtgtaaacaaaataatcaaaaggataaccttgtgttagttcccagtcaatccaatccagagtatatttgccctgtgcacattgggagatttattttcatctcagaaattatgggagagcttggctagaacaatgctacattatacattatatttcttaggttgattttttaaagacggagagaaggttacactaacaacgcacttgtccctggctgtcatttcacatttttaactgcccttttttcctggccctggcccaagtcttacgcagcctggcttcacatggaaggaacctga

SEQ ID NO: 248852 - DNA, 704 bp, Homo sapiens
ctgtaagtccaaaagggctaagaatgatttctaagactgaactaattttaccctactacaagacgattaagtccactagaaagtgattttacatgtaattataaaggtctgaaatggaaacataagtagacaaaaaggaactaaagggagggaaaaagcaattcttattttctagctaaccttcaaataaggcaaggaacaagaaaacagggagaaataagaaaatagtggacaacgtactgagacaaagtatataattcaatgtgtactcagaacactctggcccctgctccccagcttttgataaagacataatatgaaagtttggggagttcatgggggaaggattctatttctgcaagcaagaacaacaggaaattaacacaaggtataagtgataaagaaatgtttttaccttgatgtattctgggattgttaaaaatatttcctcagcctttttttctttatttaacttccattataaacattttcaaacatacaaaatttgagagaacagtataacgaacctaatcatctaactctaacaagtatcatcatttattgtgggttttttcctttaattgccccaatcaaatattgattttccccaataacagtagagatatcaatacagtatagcgttcttttcttatttttatgccagaaaaagaaatcaaaataagatgtgtcccccctcccctcca

SEQ ID NO: 248853 - DNA, 338 bp, Homo sapiens
agcacagagcacttcgtgcggcagcagcacaccgggagtcccactccctttcctgctgcgtttggatctgccgtgacaaggactatcagaaccactcacagtaaggtcgggtcgcgtttctaaatccactgtttatggaccgtcttttcactgagaagaagctcgtcagttcaggggtttctagaacttctccagactcttcaaaaactcatgactttctccaagttggtaatcccagcactttgggaggcccaggcgggcggatcacgaggtcaggagatcgagaccatcctggctaacacagtgaaaccccgtctctaccaaaaaatacaaaaaaa

SEQ ID NO: 248854 - DNA, 538 bp, Homo sapiens
gaccttcagacgggcaaagatttttactgttaaatagactatgttttagagaagttttaggttcacagcaaaattgcacagaaggcatgagattgcccatctgttccctgtccccacacatgcgcagcctcctccattagtagcatccccaaccacagtgggactggttacaatcgatgaacctacattgacacaacattgtcacacgaagtccagtagttcacactaggtagggttcactcttagtgttctatgagtttggacaaatgtgtaattagatgtatccaccgttatagtatcatacggaagagttttactgccctaaaattcctctgagctctgcctgttcatcacctccaccccctaacagcagacattttttctttttagcatagaaactaaataattttttagtttaagaaatttttttaacttaatctaaatttaaaactttgggtcttcaaaagatctgttaagatgaagagacaatctatagtctaggagaaaatatttgaaaaatatatatctgattaaaaaa

SEQ ID NO: 248855 - DNA, 379 bp, Homo sapiens
acttgattttcagactacattagtcgacactgtggtattaccacaaggatagacatggggtcaatcacagacactcacacttataattccagctctttggcagaccaaggtaggaggattgcttgaggtcaagagttcgaggctgcaatgagctatgatggcactgctgcactccagcctgggtaacagagtgagaacctgtctaaagacagaaacaaaaaatgatagacacagattagtggaatatattaatgagtctagaaaaagacctatacatttctctctaattggttttcaataaatgtaccaaggcaatttattgggggtaacagatgtcttttcaataactgttgctggatcaagtggacattcatgtgca

SEQ ID NO: 248856 - DNA, 348 bp, Homo sapiens
tttgaatataaatgaaatgagtggaaatatgactgcaaaaatatatgggttactgttgatgaaaccatttacaaccaaactggtttgttctgggtagctgtaattttttcgaaaggtactatgtacaatttcaggtgtgtgtcagatacctcttcaccctcatttctctcttaacaccttttatcataatttctgaagctcccttttgtagttaagagttaaaagtcccgaggcgagctcttcagaactctaacacctgcttagggctcaactggcagggggagaaattgaaaagcggtgaagagtcttttcagcaaagtacttagcattttaaatagtagatgtttg

SEQ ID NO: 248857 - DNA, 485 bp, Homo sapiens
ctcgattccagagttatcaaataattttcctattgtttcttcttgtgtttttagtttctttttttaatatttaaaaacctgatatacattatttggtagaaggtaagaagtatggattcaacttgagtttctttctagatgactactcatttgtttcattatttattgaaaatgcaatctttctactcatggatttgatatgccatctttattatataccgaattggcatagatattttagggttgtttctggaaattctattctattctggaaattctattctgttgcatgtctgtttttgtgccagtagcatacttttgattattatatcttgataatatctgttagaactaatcctactcctactctctgcccctccccacaacacacacatatgtaccttgtcacacttctttttcattatgacatttggctattgtgccttcttccccacataaacttaagaatcagcttatgtggttaa

SEQ ID NO: 248858 - DNA, 481 bp, Homo sapiens
agtcatctaatgactatcagtttattaggaaattatcaaaagagtttgattcccagccaaactgaatccctgcctctctcccatgtaactcagttccaaatcaaatgctcagtccagtacatctgagccttttgccagcagagaggggggcccgaatgggttgcttactatgaggccacttgggggggttttatggactggaaacgggaaggaatgtgcttagtttgccggctgttttggagaatgcgtgatttaggttggcctgggaccttggcctgggactaattagaaagcttggcccgggaccttagcctaggacctcggccgggaataattaggggcttaagtgatgatttgtagaggctgctttgcttggccctagacctattaaggaactgaagtgaaagcttggctcgggaccttgcccaggaccaattaggggctgaacttgtgatttatagaggctggacttgcagtttaa

SEQ ID NO: 248859 - DNA, 302 bp, Homo sapiens
tcttaggcttttgtcttaggagaactcaggggaacacgtggcctatgctctggcaataaaatcttcttgcattgtcagaagtcacctcactatttgatgtctccgtatactccctctgctttaatctcacttacttcccccaaacctcaatctggcccctgtttaaatgtcacctgttcatgaagctttccttcatctccacaacaaagctggtttctcccttctctgtggctgctgtaccttgtttattcctccatgggcgcactgagggctctcaatacatttggttttatatctgatac

SEQ ID NO: 248860 - DNA, 957 bp, Homo sapiens
ttatacctttcaattggaaaatgaggcagtgcctaagttacagacagccattaccgttattgatttccatttttaaaatcagtgtttttaatattactttaaggagagacaatgatattctaatattcttgtgctgtctctacttaaaccttgttcccaaggaaacagctaatgtctcaatatcagatcctgcataatcatgactacaaaggaagtatgctacaataagacatttgcacttttagcagagtgaaaatgaccagcttcttctgccttcctagcaaacaaaagtctctgattttcatacaaagaccagccctttctactagacatatgctgacaggaacaggttacagtattaacatgatctcatgtacagaatgttactattttcagtggcattctgttccagatgaaaacaaagacacaactgaaatcacctttatttttaggcattagtgactgtctcttttggaagaggctcagttttgaagtcaggcttattaaagcataggtggagataactgctcataaaccattatggatgaacatatttcccaaggccaaaaggcttgaaattaaaatgacttaaataaaaacaatgttacagatttttattagccaaaacacccccacaacaaataagcatggatcttcttaaatgtatcacataatttttttaatactgagtacacttctttcaccttttataaccagccctttttccagatgaagcacttaaaattttggcatggcaaaagaaaaaaatgatagatgaatcatttgcagttaggaaaaaatagacgaagtatggacataatcactggcacaacctcgaatttacacttctgaagaaatgcttttcgttaaggatttacaaacattcaaaccagacagttctaacattattggtattgagcctaaaaatataacatgcatggacattttatcttgccc

SEQ ID NO: 248861 - DNA, 410 bp, Homo sapiens
gaagactcaatattgttaagatgcctgttcttcccaacttaacctatagattcaatccaattcaagtaaaatcccagcaactgattttgtagatatcaacaatctgtttctaaaatttatatggaaaggtaaaaaaacctagagtagccaacacaatattaaagaggaagaatgagttccatcactaacactaccagacttcaaggcttatttataaggctgtaggacagcatggtattcatgaacaaatagacagatagttcgatgaaacagaataaagagctcagaggtagacctacacaaataaagtcaactgatattttaccaaggagcaaaggcaagtaaatgtagaaagaatagctttttaaaaacaaatttatgttgtaaaaagcaagcgcccacaggcaaaa

SEQ ID NO: 248862 - DNA, 626 bp, Homo sapiens
tttaaatttagttaagggcactacatcaactgatttagctcccttgctcctggtgactttgcccatgtttctatatccaattagatgatgatttatgatcttttgatttagatgctttctcatttctgattcattctcattttctgcagcctacacataagtgttaggaaccaaggaagttattggcgataatgtctggttggaatttgtgggagcttccttgagagtcatgaaaagtctgttcttagtctgttttgtgctgctataacaaaatacccacaaccaggtaatttataaaaaacaaatttatttctcacagtctggaggctgggaagtccaagatcaaggtgctgacatctggtgagggctgctccccgcttccaatctggtgccttgaacactgcattctacggaggggaggaatgctgtgtcttaacatggcaaaaggtggaagggcaaaaagagaaataaactccctttatcagccccctttataagggcatctaatcccattcaggagggaggcgcctccagggaatgatcacctcttaaaggccccacttcttaatcctatcatattggcaatacctgaactttggaggggacacattcaaaccatagcagcc

SEQ ID NO: 248863 - DNA, 446 bp, Homo sapiens
cgttcaaaatctttcccgcccaggcgtgacgcgaggaatgaaaacaatcagcggcccccgagggccggggcctgggcccgggagggggcggccggggcacccgggcacagcctcccgcgcagcgcctgcccgagccgggcggaccggcgggctggggcccggaggtgacacaaagaacccagagagacaaacgccacccgctggcgctcgctccaatccccggagcgccccgcccgctgacaagtttacggcgccctccgcgcaccccgctctccccacccgagcaaagtttcctgtggcccggctcggaccccggcatcgggtcggttcccgtctcccgccgcccccgcccccggctcagagacctttccctctctcgcccccgccccttcccctccctcccactctctccggggcgcaccggggtgctggggccccgcggccgc

SEQ ID NO: 248864 - DNA, 140 bp, Homo sapiens
gagatgaccttcaacctccattttttgaacttgtttgaccttttgcctcttttcccaggcatccaaagcctctgggatgtgttctgactgtaaaaactctgatgttgtgaaaaaagcttacgctttgcctccactcaaac

SEQ ID NO: 248865 - DNA, 397 bp, Homo sapiens
tactaatcgcggcgctcgacgggaatactgtattctagcatttccaaaggcaagagggtgttattcattatttgaggtgttctgtattcaaataaatatcagctgaagaaagttaaacagctggtcgggtgtagtggcttatacttgtaatcccagcactttgggaggccgaggcgggcggatcaccagaggttgggagtttgagaccagcctgaccaacatggagaaaccccgtctctactaaaaatacaaaattatctgggcatggtggtgcacggctgactcccagctactcaggaggctgagataggagaatcacttgaacccggcggaggttgcagtgagccgagattgtgccattgcaccccagcctgggcaataaaagcgaaattccatc

SEQ ID NO: 248866 - DNA, 597 bp, Homo sapiens
cccatgttgtgcaggctggtcttgaagttcttaactcaagcaatcccttgcctgcctcggccccctaaagtgctgagattacaggcattagccactgcacccggcccctaacataattcttaatgatgaaagagtaaatgcagtccccttaagatctggaacaaagcaaacatgtctacttgcatcgcttctattcatcattgttttgtaggccccagacagtgcaataagaaaaagaaataaaagagatacagattggaaagtaagtaaaacatatggacaatacaatagtgaagaaacctaaggaatctacaacataactactataactaatcagtaaagataacaaagtcacagaatacatagtcaatataaaaagaatcaactgcatttctatattctagaaagtaacaattagaatttgacattttaaaacataccatttatgatagcatccaaccaaaaccatgaaatacttaaggataaaattaacaaaatgtgcccaataactttacactgaaaactacagaacaatgctgaaataaagaaaacctaaataaaagtaaaggtgtactacattcatggactgggagccat

SEQ ID NO: 248867 - DNA, 382 bp, Homo sapiens
atttttttctttcttatttttagccacttatgctaccagaatgtttgcattttttgatcagtagacatattacaggacaccctaaatcttcttgtgaacagagaaaataaaatgataagcctgccagtgaaagaggtgacattcactagcaaatgtccagagcatatcactgctcacaagccatttttcttcctggttgctttttcccttgtcctgtttttcaagcactttcttaaaactaataatattgtagaccttgtatttctgaagagcagtgggcttatatgggactttggctttccatttttatcttgctgaagtttttgagtttttgcaacacaagtattttttgttatcagaaataagataaaacatttaaaag

SEQ ID NO: 248868 - DNA, 362 bp, Homo sapiens
ttcagctacctgaggaggtccgtattttatagcctttgtttaatatatgggaaaatgggagtcaaggaaaattagagtccttgccttggtaatacatccaggacacaggaaaattggaattggaacacctgcctgtgacaccagtgcatgcttttaacaacgaccttgataacttctcacttttactcccttccttgtttacccagtctgtccacctggaaatgctagttcattaagactcagatcaaaggtcatttcccatcagaatgtttctctgactattccagacacagtctaatgcatcatccttttctgatctgtagagaacattaaaaggttgtttaattttaagcttttatata

SEQ ID NO: 248869 - DNA, 589 bp, Homo sapiens
gttcatataggaaaggaaggatgaatgcttgattctccctctttatttaccaatttttaaaataatgaattggtttcctggcatcctcctaggataatcaattaattttttttcatttttaatatcattatgaacaaggcctagaattttttagtatcattttaacatatttactatatcaatccattgaagttattatccttaattagtattcaaattactctgtttttggcctgtgggaggcctgtcaagtagacttcttgatccatttgacatgagcctagtatttgatagcttacttgctatctgctatgtccaaatattccagattcatttctatattttttgttttagacctggaatcagctatttctccaatagctttacttttagtaggaaaaagtatttggagaacacaatctaggatctagggtgctcactgctaccaggttggtgattgtttctaggcttttatagtggacagagcataccctacagatagagaacttcaactgggaaaattggaaggtcacaaggaccccagaagataattatcaatcccattcattgtttgtcaactaaaaaaaaa

SEQ ID NO: 248870 - DNA, 474 bp, Homo sapiens
tatcactatgaggctagactcaaactcctaagtccaagtaagactcctgccttagccttgatctcaactagctgggactacagatgcatgccaccttgctcagctgaatcttatagtatttatgactgaagatataacttatactataattataacttataatatctataactaatatctatctatccagggaacacttattctctcgaagagaactagtatggacagttgtgatagctagctttttacagtatcaaatatcaaatgtaggccaggcacggtggctcatgcccataattctaacactttgggaggttaaggagggaggactggttgaggccaagagtttgagaccaggctgaggaacatagtgacaaaaaatgtttaaaattagcgaggtgtggtggaacatgcctgtagtcccagctacttgggaggctgaggcaggaggatcacttgagcccaggaggctga

SEQ ID NO: 248871 - DNA, 848 bp, Homo sapiens
tttttttaagaaaagcattggcaccgcagcagcctcccccgcttcttccctactaggacgcccgcctgactcgccccattgcacaattcttaccgtggaacagccgcgtgactcggcgggagcccaaaagtttcccaggtttcctcagcctagaaaagcgtgggtgggtgtcccggcctggctccaggcgccctttaagttgtatttcttcgggtaactgggttgccctttaaaatgtggagattgtcctttagaaagaaagaaaatctcacgagctcgctggcccgccaggtctaggttggcgccgggtgactgcaatgaaacgcgtttcttttcccatgtacattttcagacggtaaaagtgtttcgatttgtttgggggagaagtcaggcgctggttttaaaggaggaaggggaatgatgcttaaaagcagagacacgatttggagctctccaagaatcatagtgtttattaacaatgattgtgcttagtagacactgagaaaatatcgaacgaatgagtatttggaggagggatttaaatgggtgtctataggccaacgctttcattctgctgatgagaaaacctagaggttaagtgatttgcccaaagtcacctagctaattaatgtggaaggcaggaatggaatctgtctcgttttgactccaaattcttgttatgagatgggtgcgttttcccctctctatgaaaaaaaaaaatgccttctgtagtaatctctgtaaagccttactccactccctctgtctacgcatctaaagcaaacatacaaaacaaaaaagaaaacagcaatccccaaatgcaatccatgcactcaaataggctaaat

SEQ ID NO: 248872 - DNA, 361 bp, Homo sapiens
acttttccagaaacatcgggataagaacaccaaaacagacaaagaaaatatgtttcacaccttcctcaacaaacttcaaaatctcatcacactgattaaggagaatcatcactctgtaatcttgtataatgcatttaagctgtccctcctctattctctcataaaaacttgtgtatacaactatgattgccctgcaaatattattgcttcttaattcatgcaaatctatttcttcttcaatgtgtgggctacttaaggataggaactatgtcctaatcatctgtgagtgacaaatcagacaagcaataaatactgcctgtattaggacatgcataaataaactcagatgggtagaacctga

SEQ ID NO: 248873 - DNA, 504 bp, Homo sapiens
cagtacactagaaatgcaaatgaatgtgtagtgacaggaaacaggccagtggttgtttgggtgtagacacctccttggagaaactgcttgtacctaggacaagagatggtggagagctggacaaatccagggttgtaaaacagagatcataagactgatggaatggagtctttgtggcttataaattatgaaattataaataagactaaggccatgccaggcaaaagtcacatacccctacactaaaataataaatgttctaacttaccaattgtcagatgctaactgatgcccccagactccagactccattccacaaagcataactacaggtttgattgaacaagagactgacttcagtaattttctcctgataagacaccactgaccatgggctggttctggccagtttatagaggctgcgcactgagtacctttgtgttcttttttttttgaggcagacctgtactccagcctggggtacagagggagaccctgtctcaa

SEQ ID NO: 248874 - DNA, 434 bp, Homo sapiens
catttgcatatatttggggttaaacaaacactttttaatataatttatgtattttgttcaaactataatttattaagccatattttagatatttaatactctgaatccatgttgtcagttttccaaaagagtccctatttgtaccacgtatccatccttttcctatgattcgtaatgctgttcttgctgtgctcacaccggcaataaatactaatcaagctaaattcaactgcattttatataggttttctttctttctctctctctctctctctctctctctctttctttttttttttttttttttttgagacgatgtctctctctgtcgcccaggcgggagaatcacttgaactcaggagggggaggttacaatgaaccaagatcatgccactgccccctccagcctgggtgacagagggagactccatctc

SEQ ID NO: 248875 - DNA, 447 bp, Homo sapiens
aatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaagggcatcata

SEQ ID NO: 248876 - DNA, 495 bp, Homo sapiens
tggggacccctcccatccctcttagtgttgtcagggaattgcatccttctcgggaccccttccatcattctcactgtgcctgcacagtgtcagggacccgcatcccctggggacccctcccatttctcttagtgttcttgaactctggtcaaagacttgcatccttcttgggacccctcccttccctctcagagtccccgcacagtgtcagggactggcattcctcttagtgttcttcaactcctgccagggacctgcagccttctcggggcccctccaattcttatcagtgtccccgcacggtgtgagcgaccggtatcctcctagcgaccccttacatacgtctgtgttcccgcagtgtgagggacctgcatccccctggggacccctgccatccttctctgtgtcatcgcgtagtgtcaggggcctgaatccccctcagagcccctccatccctgtcagaggcctcgcatccgctcaggaggccctcaacac

SEQ ID NO: 248877 - DNA, 431 bp, Homo sapiens
accattttccattataaaagaaattcttccaaatcacacaaaacactctgacacttctccaattccccctatcatggggctggcagcagccgctttgcgtcctgaatgtcatgacagtgatggtaacagtaatgatgataacagcaatgatgaagtctcacatttaaaattttcaagtcactcatcacatcccaagtcactcccttcattaccttttatttatactggagtcatcctgtgtgcctcagtcagaccattttgtatgtacaatgaccgacaatgagatttaacatgcagtttgcagatcctcccttctctgggtcacctgaaaataagccacaaacaaaggaatgaaattgttgatgaaaagggaagaggcaagactccatatgaagaatacaactgactcacctgtctgtacatgcctctgt

SEQ ID NO: 248878 - DNA, 503 bp, Homo sapiens
gttgagtccaaagcatgatacacaaacctaaattcgtaactaaaataatcatagtcgaaccacagaacatatcagactcagggaagatcctaacagcaacactaagagattaaaatgtctctccaaagagcaattggacagagaactggtttcacaactggaacaacaaaagtccgaagatagagcatggcttcaaattactgagagaagtgcagtctagaattctgagcccacctcatctgtaaaaggtaggacaagccgggcatggtggctcccgcctgtaatcccagcactctgggaggccgaggcgggcagaggtcaggagtttgagaccagccggaccaacaaggagaaaccccatctctactagaaatgcaaaattggccaggtgtggtggcgggcacctgtgttcccagctacttgggagactgaggcagacagaattgcttgaaccagggagacagaggttgcagtgagccgagatcgcgccactgtactccagc

SEQ ID NO: 248879 - DNA, 391 bp, Homo sapiens
gtatgatggttggttgctatatttctaaatgtcaggtacaggttttggtcagaaaggaggggggtgctgggcatggttgctcgcacctttaatccctgtgctctgggaggccaggcgggaggatcgctcgaagccaggagtttaagactggcctgcgtaacaaaacgagaccccaagaaaagtctctaaaatatatatttttaaaaattagcagccgggcacggtggctcatgcctgtaatcccagcactttgggaggccgaggcgggcggattgtgaggtgaagagattgagaccattctcgccaaccaacatggtgaaaccccatctctattaaaagtacaaaaattagctgggcgtagtggcacatgccgtagtcccagctactcggg

SEQ ID NO: 248880 - DNA, 433 bp, Homo sapiens
ctcagggtcggcttagcaagaaaggaggcgctggggagacctctggggtcccagctgccaaggtactcgccgctccaaggagatgcggacgccggataccagctctgcccaagattgctgggtcccgccgcggcctttaaaggcccaccacgtggctgcgcggccagccctggtccggaggcggtgcccgggtggcgcctgcgcactgcctagcagaggggctggggttccgagaaaaagcgtctggagaggaaggggaggctgcttggggtgggacgccgtgggaggagtcggctccttatgcaaatcacagcggagcgcgcacggtccggaggcggggcttgcgatgcaaagacaggtccgtctggcgaacagcgagggggcgggccgcaaccctctgcctctttccgcgagcgctgacgtcgccgacgtg

SEQ ID NO: 248881 - DNA, 164 bp, Homo sapiens
gattccccccatctgggtgtatgtcagactgttcctcacctggtgctattccatagggaaaaatgcaacactgaagagtcagcccttttcattttggcctcttgtttatcctatagcagtaagttaacagtttgactgttaatttcactttgactcattggcct

SEQ ID NO: 248882 - DNA, 372 bp, Homo sapiens
tctcactctgttgcccaggctggagtgcagtggctattcataggtgcaatcatagtgcactgcaatctccaactcctggtcagccgctacttcttaaaatgtttctctgtctggttcatgtttcaaagtctggttcatgactctgctacacttcagtttcaaaagctggtagcaaaggaaaagaacatgccaagagctgacgttctgctgtgatgagaccacccaagctccccgtatctataccaagggatctgttgcccaggctggagtgcagtggtgcggttttggctcactgcaacctctgcctcccgggttcaagcgattctcctgcttcagcctctcaagtagctgggattatagatatgcactacc

SEQ ID NO: 248883 - DNA, 513 bp, Homo sapiens
tctaaaaataagaaaaaattatattatgttagcataatggtatatgtatataattcatagagaatgaaacgtacatatgtttagaagcaatgctcaatttgtatttattttctttttttacttaggagagtacatgactaaaaatgtctggagataaccagtccatggtttttactggttagtatgtttaattagtcccttaggaagttacaaaaacagtgagtccaccttatagtcagtaattattttatgaatttttaatatgtaaatagttctgtgctaaactttgcaatagaaacaaagaagtgtaaatgatggcccttgtcttcaaggcactcccataatggggaagaataagaagactgttgaattccaagttagttgatgtgggctgggatcatgcatccgtattttcatgccaagttgagatgtgtcgagcttcaccaagtagcgtgggatacttagcgaagggatggagaacaattggtggagtaaaggaataagggactgagt

SEQ ID NO: 248884 - DNA, 478 bp, Homo sapiens
gagtctctagcagagaattgctccttcccttttccagcttctggtggctgccagcatgccttggcttgtgactgcatcactctatcttcaaggccagtatcttcaaatctctatctccatcttcatgtcatcttctcctgtgtatgtggtcaaattccctctgcctccctctcataatgatacatgtgatttaggacccacccagataatctggccatctcaagatccttcacttaatcacgtctgcaagactacatatgaagtagcatttgcagattctggacgttagggatgtggatttaggtatggggccattatttagcctaccacactgggtgtctcctcagcgtttctgaggttccccccacccttaatcagccattgtgtggtttttatctgtgtatttcttgaacatatgtctatttttcaacctgtgctatttctcagggtaaataattaaatataatttgtttaatcc

SEQ ID NO: 248885 - DNA, 440 bp, Homo sapiens
ttgagatggagtctcactctgtcacccagcctggagtgcagtggcgtggtcttggctcactgccagctccgcctcccgggttcacgcaattctcctgtctcagcctcccgagtagctgggactacaggtgcccaccaccacgcccggctaattttttgtattcttagtagagacggggtttcaccgtgttagccaggatggtctcgatctcttgaccttgtgatccgcccgcctcagcctcccaaagtgctgggattacaggcatgagccaccacgcctggcccattttaaccatttttaagtgtacagttcaatggcactaaatacattcatatcattgtacaactgtcaccattattcatctctgtaactgaattttgatgacatacaggaacaccaatggtttttaaatatactttttataagtggccactattctc

SEQ ID NO: 248886 - DNA, 422 bp, Homo sapiens
ttatgcaagtaaattgtagactctcttgaatgagtggggactctcaacttcaagagttagcttggaaatggatccacatttgactccatctctgcctgagagcaacttccagaattgtgtctatagagaattatggagcggactttttccattgaattcaatttgtcagtatgattaataaactgcataaattaaataagtttcttaaggggaattttcaataattgtgaatagacagatttatagaatttactaaaacttgatgtgtgcagagaggtgtcatctcctcccactgctccatatgtgccaactccagttatactgagttgcctacagagcgacacagctatggcacgtcacgtgcacatctgaatgcctttgtgcctctgcaaatgtgttctctcacttaggggcctagaatg

SEQ ID NO: 248887 - DNA, 402 bp, Homo sapiens
cagtatatatgtattctactgcagcttaattgtattcagttaacataattgaagagattaaataagaaatgtagaaataagtaagacgtagatcttaaggatctctctggttaactgtaagtgaaagactatctcaccacaatgcttaatgtaaatggtctgattggttagtgacaacctcatcaattattgcagcatgcaaagggattgatttttaaatttttatttattattcattatttagtatgtacttgcttgtttgctttcttatttagttgcttatttatttgcttattactttcctaccattttaaaagaggaagaagatactatctaagtgattttgccaagttcttacattttgttggtttatattgctttaaaatacatgcttgaaatcac

SEQ ID NO: 248888 - DNA, 339 bp, Homo sapiens
gagacggagtcttactctgtcgccaggctggagcacagtggcacgatctcggctcactgcaacctccacctcccgggttcaagcgatttccctgcttcagcttccagagtagctgggactacaggcgtgcgccactacaccctgctaattttttgtgttttagtagagatggggtttcgccatgttggccaggatggtctcgatctcctgaccttgtgatccgcctgcctgcctctgcctcccaaagtgctgggattacagttgtgagccaccgcacctggcctagattggttctttagtttgtactttgatcctgtggtttattgtttaatcaaggtt

SEQ ID NO: 248889 - DNA, 340 bp, Homo sapiens
cataaaataaatgctcagaaggtgttgctgctattattattagagtcatcttaaatcatgagtttgaatgttttgttaaaatcttagaaagtccttgatatgaccgggtgtggtggctcacacctgtaatcccagaactttgagaggctgaggtgggctgacctcaggtgatccacctaccttggcctcccaaagtgctgggattacatgcatgagccaccgcacctggccaaaataatggttcttaatagtggccctgaagtatcaggaaaagattaaatgttatttaatgctgtctttttaagaatgtggaaaactatgatatgctttaaaaaaaaaa

SEQ ID NO: 248890 - DNA, 332 bp, Homo sapiens
gtttgttttattttgatttggatctcaggtgcagacagttgagttaagtgtagtccccagttcatgtcacctctggagaatgtgaggtctgtgtaagatctctcatttctttattccttttcttttcatatttacagtgaccatatatttaccctaccaacaagagcactttttagaagaaaaggaggcaatttaatgattattatgctgaggctgggcgcagtggctcatgcctattatcccagtactttgggaggccgaggtgggtggatcacctgaggtcaggagttcgagaccagcctgaccaatatggtgaaaccccgtctctacta

SEQ ID NO: 248891 - DNA, 288 bp, Homo sapiens
tcccacagatattctaagtcatcatcttcttcctcctccttaacctcctcttcttcctcctctaattccacctcttcttcctcttcttcctcctcgtcatcatcatctggcaaggccatctcctccccacctccttggtaggtcaccaggcaggaacttcgcttggtcccatctcggtttgctctctggcccccagaggccatgctgtctgtcatactgtccatgtcctgttctgctattatgtcaccacaacctgtcaatgaatcaaagcttttcagggatgtcaca

SEQ ID NO: 248892 - DNA, 498 bp, Homo sapiens
aatcccactaaaggttccagctctaaatatgctcctttgtccttcctccccattggccccaatctctccccttaccctgagaatgttagaattactttcctaggtctagaccataggtcttctgcaaaatttttttctggaaagaaccagttggaaaatatttcaggctttgcaggacatacagtccctgttgcagccacttgactgtgccatcgtggagcacaaaaacagccatagacaatatgtaaatgaatgggcatggctgtgttctaataaaactttatttacaggcttggaaaacatagcaagacctcatctctacataaaatttttaaaaattaactgggcatggtggtacataccagcagtcccagctactcaggaggatgaggccaaagatcgcctgaacccatgagttcgaagttacggtgagctagggtcatgtgactgcactccagcctgggcaacagagtgagaccccatctctttaaaaaaaaa

SEQ ID NO: 248893 - DNA, 2091 bp, Homo sapiens
  misc_feature (2088)..(2089): n is a, c, g, or t
  misc_feature (2091)..(2091): n is a, c, g, or t
tgcctggctctgcgccccgcccgccggcccgccgccccgccgcttctcgggtcgccctcgggctccggcctcgccctcccttcgacactctctcggccacttccgtcctgggaacgtcccccacccgcgggcggcgccctgggcccgcgctctatggtcgcggggggcaggcaggaagctgctctggccccgttctcgatgctcgggagccgccaaagcccggcagcccctccctggcaggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248894 - DNA, 921 bp, Homo sapiens
  misc_feature (918)..(919): n is a, c, g, or t
  misc_feature (921)..(921): n is a, c, g, or t
tcatgtctggtacgcccggggtatgggatatcgtcgaccaggccgtcgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248895 - DNA, 1673 bp, Homo sapiens
  misc_feature (1670)..(1671): n is a, c, g, or t
  misc_feature (1673)..(1673): n is a, c, g, or t
tgcctggctctgcgccccgcccgccggcccgccgccccgccgcttctcgggtcgccctcgggctccggcctcgccctcccttcgacactctctcggccacttccgtcctgggaacgtcccccacccgcgggcggcgccctgggcccgcgctctatggtcgcggggggcaggcaggaagctgctctggccccgttctcgatgctcgggagccgccaaagcccggcagcccctccctggcaggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtatccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248896 - DNA, 1603 bp, Homo sapiens
  misc_feature (1600)..(1601): n is a, c, g, or t
  misc_feature (1603)..(1603): n is a, c, g, or t
ggagaagctgaacggcacggaccccgaggatgtgattcagcaactgacctttgcctgcttcgacgaggaagcctcaggtttacatccatgtaggatccagccgtccgggagctgctcactcaccattgggtgaccgctttcacacgatgaggaatgtggagcgcagatgtaccgaggagtgcacccattgagtaacgaaaggcaacttcaactacgtggaggttcacccgcatcctcaaacatggcgccaaggataaagacgactagtgccaccgcacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248897 - DNA, 2023 bp, Homo sapiens
  misc_feature (2020)..(2021): n is a, c, g, or t
  misc_feature (2023)..(2023): n is a, c, g, or t
tgcctggctctgcgccccgcccgccggcccgccgccccgccgcttctcgggtcgccctcgggctccggcctcgccctcccttcgacactctctcggccacttccgtcctgggaacgtcccccacccgcgggcggcgccctgggcccgcgctctatggtcgcggggggcaggcaggaagctgctctggccccgttctcgatgctcgggagccgccaaagcccggcagcccctccctggcaggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248898 - DNA, 1610 bp, Homo sapiens
  misc_feature (1607)..(1608): n is a, c, g, or t
  misc_feature (1610)..(1610): n is a, c, g, or t
ttaagctctgaggaaatgttaagtgccttaaaatagctaaacagggtttattctatttggccccagagatactaggtaagtccaacggatagaaattataaggaggcagctgttggttcaggataaggaagtttttatttgcttgtttgaagacaggttcttgctttattgcccaggttggagaatagtggcgagatcatggctcactacagcttcaacctctcaggctcaagtgatcctccttcctcagtctcctgagtagcagggaccacaggcatgtgccaccacacccggctaattttttatttttagtagagacaaggtctcactatgttgctcaggctggtctcaaactcctgggctcaaccggtcctcctgtcttagctccccaaagtgttgggattacaggcatgagccacgtcgcctgaatactgcccgaccagttttttttttaatagtttaaaatggtctggcttgttagggttaacacctggtccgtggaggcattcagaaagaatctgaatgcctgttggtcagggaagctgtagaagggatttctgtattggaaagagattgatctcagttgcgtttcaactcctttttctagagttcctctaatgatatccctttccctgtttcctttcagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248899 - DNA, 1458 bp, Homo sapiens
  misc_feature (1455)..(1456): n is a, c, g, or t
  misc_feature (1458)..(1458): n is a, c, g, or t
tgcctggctctgcgccccgcccgccggcccgccgccccgccgcttctcgggtcgccctcgggctccggcctcgccctcccttcgacactctctcggccacttccgtcctgggaacgtcccccacccgcgggcggcgccctgggcccgcgctctatggtcgcggggggcaggcaggaagctgctctggccccgttctcgatgctcgggagccgccaaagcccggcagcccctccctggcaggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248900 - DNA, 1306 bp, Homo sapiens
  misc_feature (1303)..(1304): n is a, c, g, or t
  misc_feature (1306)..(1306): n is a, c, g, or t
tttttttttttgctttccatttgattgttagatcttcctccatccccttattttgagcctatgtgtgtctttgcacagagatgggtctcctgaatacagcatattgatggggcttgactctttatccgatttgccagtctgtgtcttttaattggggcctttagcctatttacatttaaggtccatattgttaggtgtagatttgatcctgtccttatgatgttacctggttattttacctgttaattgatgccgtttcttcatagccttgatgttctttaccatcctggcagagtttttttgttttgttttgtttttgctttttgttgttgttgttgttttaatgaggaacttcaggcattttgtccagagaggaagaagtcgtttgcaaaaatagaatgaaaagtaagagagaggatccagtgcagagatggaggaggtggcctgaacaggagtttcactgtgtctcaggatgctaggccaggggatgctcactattggcccctctcttcctctaggtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248901 - DNA, 2160 bp, Homo sapiens
  misc_feature (974)..(974): n is a, c, g, or t
  misc_feature (2157)..(2158): n is a, c, g, or t
  misc_feature (2160)..(2160): n is a, c, g, or t
tgcctggctctgcgccccgcccgccggcccgccgccccgccgcttctcgggtcgccctcgggctccggcctcgccctcccttcgacactctctcggccacttccgtcctgggaacgtcccccacccgcgggcggcgccctgggcccgcgctctatggtcgcggggggcaggcaggaagctgctctggccccgttctcgatgctcgggagccgccaaagcccggcagcccctccctggcaggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctaggagtntgaaataagtttgcggggaggacagggttcatgggcctggctattcatactttcccttttgcagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248902 - DNA, 2010 bp, Homo sapiens
  misc_feature (2007)..(2008): n is a, c, g, or t
  misc_feature (2010)..(2010): n is a, c, g, or t
tgcctggctctgcgccccgcccgccggcccgccgccccgccgcttctcgggtcgccctcgggctccggcctcgccctcccttcgacactctctcggccacttccgtcctgggaacgtcccccacccgcgggcggcgccctgggcccgcgctctatggtcgcggggggcaggcaggaagctgctctggccccgttctcgatgctcgggagccgccaaagcccggcagcccctccctggcaggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccatgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248903 - DNA, 2854 bp, Homo sapiens
  misc_feature (2851)..(2852): n is a, c, g, or t
  misc_feature (2854)..(2854): n is a, c, g, or t
tgcctggctctgcgccccgcccgccggcccgccgccccgccgcttctcgggtcgccctcgggctccggcctcgccctcccttcgacactctctcggccacttccgtcctgggaacgtcccccacccgcgggcggcgccctgggcccgcgctctatggtcgcggggggcaggcaggaagctgctctggccccgttctcgatgctcgggagccgccaaagcccggcagcccctccctggcaggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcaggtatgaaagggagagggactctgttgtaagtattaggtttttgaagggaggatacaggccatatccccgtatctttgttatttcccccagggtcttgaaatacacagcccagaatatggagcttcagaacaaagtacagcttctggaggaacagaatttgtaagtatccctccaaaccattcccttcctatgcccctcatttaatgctttctcactctttcccctgccctacacttgatttctaactgggcagctgccttcactaggtctctgattccaagaagctcccagtagtgaggaatacatttacaagtaactaagaataagttaagtaccaagaaaaagaaagggggtaagaaagacgtcatgggctttcatagtagttaggattctggggttgggttgggaaagcattctaggcagagagaaagcatcctaggcaagaggactagtccagcatagtcatcttgggctggaactcttaacacacatgagctgggacagaaggtagagaacatagaaaatgcctggtgaggattatgtgcatagctgatcagacagtggggaacgactgatgatattcgcaaaggaggttaagtcctggcagagtttttttgttttgttttgtttttgctttttgttgttgttgttgttttaatgaggaacttcaggcattttgtccagagaggaagaagtcgtttgcaaaaatagaatgaaaagtaagagagaggatccagtgcagagatggaggaggtggcctgaacaggagtttcactgtgtctcaggatgctaggccaggggatgctcactattggcccctctcttcctctaggtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248904 - DNA, 1166 bp, Homo sapiens
  misc_feature (1163)..(1164): n is a, c, g, or t
  misc_feature (1166)..(1166): n is a, c, g, or t
tcggtacccagttcgacggagactctcactctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248905 - DNA, 1700 bp, Homo sapiens
  misc_feature (1697)..(1698): n is a, c, g, or t
  misc_feature (1700)..(1700): n is a, c, g, or t
ttaagctctgaggaaatgttaagtgccttaaaatagctaaacagggtttattctatttggccccagagatactaggtaagtccaacggatagaaattataaggaggcagctgttggttcaggataaggaagtttttatttgcttgtttgaagacaggttcttgctttattgcccaggttggagaatagtggcgagatcatggctcactacagcttcaacctctcaggctcaagtgatcctccttcctcagtctcctgagtagcagggaccacaggcatgtgccaccacacccggctaattttttatttttagtagagacaaggtctcactatgttgctcaggctggtctcaaactcctgggctcaaccggtcctcctgtcttagctccccaaagtgttgggattacaggcatgagccacgtcgcctgaatactgcccgaccagttttttttttaatagtttaaaatggtctggcttgttagggttaacacctggtccgtggaggcattcagaaagaatctgaatgcctgttggtcagggaagctgtagaagggatttctgtattggaaagagattgatctcagttgcgtttcaactcctttttctagagttcctctaatgatatccctttccctgtttcctttcagacagaggaacaaattctgaaacgtgtgcggaggaagattcgaaataaaagatctgctcaagagagccgcaggaaaaagaaggtgtatgttgggggtttagagagcaggtatgaaagggagagggactctgttgtaagtattaggtttttgaagggaggatacaggccatatccccgtatctttgttatttcccccagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgannan

SEQ ID NO: 248906 - DNA, 691 bp, Homo sapiens
tgaccaagatggtaaaaccctatctcttagtaaaaatacaaaaattagccaagcgtggtggcgttagcctgtaaccccagctactcaggaggctgaggcaggagaattgcttgaacctgggaggtggaggttgcagtaaactaagattgtgccattgcactccaccctgggagacagagcaaaactctgcctcaaaaaaaaaacaaaaacaaaaaaaacaaaacacacgcccaaaccgaagctagagatagcacagagttaatgagttcacacccctaaacacagccctcaacaaacaataggtgggatatggtgaacaagtgccccagcctccttgtggtgggatgactctaagctgcatgttctcctctggctccctgagttcctccgacagcctgaactccagttgcccgtggaataacctggttgaagctccttttatcggctgctttcccttccctgtctcacttccaagtgtttcctgaaattctgtcccaaataaaccatttgcacttaaatctttgtctcagggtttgcttatgggggaacccaaactaagacgccatgaagctcctggcacacctattgcctgaatcactgaacacaccaggcatatggaaatgcacgtgtcagaccactctgattaacttcaagaggcagctcctatcatccccactagacagagatggga

SEQ ID NO: 248907 - DNA, 1834 bp, Homo sapiens
ctggcgtgggcgaggcggggctcggggctcgcggtcgctgtagccgcgcggggatctggggtttctctgggacagcggcggcggcggtgggcggaccgtggcgcggggacgagcggccggttagcggcgtgtcggagccggtgtcacctgcgggagaggaaggcgagagagggcagcggctagtcagccttcggagagccccacggcggcaggggagacctcgccggggccgtcacctgctgggtgccttggaaagttagggtcaccgggaaggttagggtcacgtgcctttcaggttgcgggcccttcccccacatccatgaccccacacgccacaggcagcacagcttggccgccttcttgttctggttgagccccagcttggtcgacttgaaggactccaggcgcttccgcatggtcctgtggaagatttcccggtcctgtttctcgtcctccgtgggcgtgagctcgtgtcggctgtacagatgcttgtactgcgggatcaggcacggaggtcacagctgtgcccagcgccggacattctcgccctcctgccgcaggagctgagcacggatcccccgtggtcccaggaggggacgaggaagccgccccacggggtccctgcggggtcctccagcccccagcccgcagtgcccacctcctgccgcggcttgtacaggccaggagccaccacagccctgtctgtgactctcagctcccgaggctgggctcttccccagggaagctgcatgaccatggccacatacaggaggagaccctaaaactccattggcctcatgtccagaactgaatcaggttcagctcgtggaagacattcaggatccggtctcgagacttctgggccgaccgtctcatgaggaccctgctgaggaacttcctgtcgaagtgggaccacctgtagggacagaccttgggtgtgagcctcaggtgacaggcgccctagagcccgccggacgcgtggcccggccccttctctcctgaattttgtttgctatagtgaccctgtaggcgcgtttaaaatgagggaagcagcccctgccacacgcccaggccgtccgccgttctcccgcctgtcctgttggatggaggccgttagacgcatatgaaactgcatgccgcctcctccagagggtggctcaggacacggtgggtgtcaggcctggtcaggcaagggggctttggccacatggggggcaccttcaggtgcacaggaggaagggcaggggcggacagacaccctgagcccttagacttgtgggagccaagctgaccagagtgaggttttttttagcctaacggaattagagtattcgctggttatccggatcagaagggacggtggcctggccggacttagaggaaactctggggcacaaggaggtgatgcctgtcacttggacatgggtgcagccgccagagccgccctccagggcacagggtgggcccgggtgagcttgtgtgctcacacctgggcaggccccgcggcagcaatggcagctctcctgtacaggctgagtttcagccacaccaagaagtcaaagctaaccgaggctgtgccttccgagacccccgggatggcccctgggaggccaaggagtcggggactgggtacccggagcagagtcactgtggccacggagaaccgcagctgagctttatgaagccacgtggccacacctcccggtgcctccaccccaagcaaacacagatcgctcagaaaatgggaacccagggcaaattgtatgtgctccttactgggtttattataagtgtcacatgttttttataataaaacataggtgatttcacctta

SEQ ID NO: 248908 - DNA, 2145 bp, Homo sapiens
ctggcgtgggcgaggcggggctcggggctcgcggtcgctgtagccgcgcggggatctggggtttctctgggacagcggcggcggcggtgggcggaccgtggcgcggggacgagcggccggttagcggcgtgtcggagccggtgtcacctgcgggagaggaaggcgagagagggcagcggctagtcagccttcggagagccccacggcggcaggggagacctcgccggggccgtcacctgctgggtgccttggaaagttagggtcaccgggaaggttagggtcacgtgcctttcaggttgcgggcccttcccccacatccatgaccccacacgccacaggcagcacagggctctccatgggcagcttcccattggggatgctgctgtttctctgcggagcaaacgtgaagctgctcacaccccgacacagccacacccagccctgactgcccccgctccaggccccagccccgccaagcctcctggtgacccagccttacccgcttctgggcacgctcccgcttgtacagcttggccgccttcttgttctggttgagccccagcttggtcgacttgaaggactccaggcgcttccgcatggtcctgtggaagatttcccggtcctgtttctcgtcctccgtgggcgtgagctcgtgtcggctgtacagatgcttgtactgcgggatcaggcacggaggtcacagctgtgcccagcgccggacattctcgccctcctgccgcaggagctgagcacggatcccccgtggtcccaggaggggacgaggaagccgccccacggggtccctgcggggtcctccagcccccagcccgcagtgcccacctcctgccgcggcttgtacaggccaggagccaccacagccctgtctgtgactctcagctcccgaggctgggctcttccccagggaagctgcatgaccatggccacatacaggaggtaggagacagaggcctccacggtggacgatcgtggcgtgaagtccacgttgaccacgttgtcggtgctgggggagcggatgaaggccagggacccgcggcgctctccctgtggtcaggaagcagcccggagaccctaaaactccattggcctcatgtccagaactgaatcaggttcagctcgtggaagacattcaggatccggtctcgagacttctgggccgaccgtctcatgaggaccctgctgaggaacttcctgtcgaagtgggaccacctgtagggacagaccttgggtgtgagcctcaggtgacaggcgccctagagcccgccggacgcgtggcccggccccttctctcctgaattttgtttgctatagtgaccctgtaggcgcgtttaaaatgagggaagcagcccctgccacacgcccaggccgtccgccgttctcccgcctgtcctgttggatggaggccgttagacgcatatgaaactgcatgccgcctcctccagagggtggctcaggacacggtgggtgtcaggcctggtcaggcaagggggctttggccacatggggggcaccttcaggtgcacaggaggaagggcaggggcggacagacaccctgagcccttagacttgtgggagccaagctgaccagagtgaggttttttttagcctaacggaattagagtattcgctggttatccggatcagaagggacggtggcctggccggacttagaggaaactctggggcacaaggaggtgatgcctgtcacttggacatgggtgcagccgccagagccgccctccagggcacagggtgggcccgggtgagcttgtgtgctcacacctgggcaggccccgcggcagcaatggcagctctcctgtacaggctgagtttcagccacaccaagaagtcaaagctaaccgaggctgtgccttccgagacccccgggatggcccctgggaggccaaggagtcggggactgggtacccggagcagagtcactgtggccacggagaaccgcagctgagctttatgaagccacgtggccacacctcccggtgcctccaccccaagcaaacacagatcgctcagaaaatgggaacccagggcaaattgtatgtgctccttactgggtttattataagtgtcacatgttttttataataaaacataggtgatttcacctta

SEQ ID NO: 248909 - DNA, 1395 bp, Homo sapiens
attggcctcatgtccagaactgaatcagccaggagccaccacagccctgtctgtgactctcagctcccgaggctgggctcttccccagggaagctgcatgaccatggccacatacaggaggtaggagacagaggcctccacggtggacgatcgtggcgtgaagtccacgttgaccacgttgtcggtgctgggggagcggatgaaggccagggacccgcggcgctctccctgtggtcaggaagcagcccggagaccctaaaactccattggcctcatgtccagaactgaatcagccagtgcccgagcctgctgcagccccgacccggcagagcaagcggctctgctacctcagccacgtagctgatggcatccttcaggttcagctcgtggaagacattcaggatccggtctcgagacttctgggccgaccgtctcatgaggaccctgctgaggaacttcctgtcgaagtgggaccacctgtagggacagaccttgggtgtgagcctcaggtgacaggcgccctagagcccgccggacgcgtggcccggccccttctctcctgaattttgtttgctatagtgaccctgtaggcgcgtttaaaatgagggaagcagcccctgccacacgcccaggccgtccgccgttctcccgcctgtcctgttggatggaggccgttagacgcatatgaaactgcatgccgcctcctccagagggtggctcaggacacggtgggtgtcaggcctggtcaggcaagggggctttggccacatggggggcaccttcaggtgcacaggaggaagggcaggggcggacagacaccctgagcccttagacttgtgggagccaagctgaccagagtgaggttttttttagcctaacggaattagagtattcgctggttatccggatcagaagggacggtggcctggccggacttagaggaaactctggggcacaaggaggtgatgcctgtcacttggacatgggtgcagccgccagagccgccctccagggcacagggtgggcccgggtgagcttgtgtgctcacacctgggcaggccccgcggcagcaatggcagctctcctgtacaggctgagtttcagccacaccaagaagtcaaagctaaccgaggctgtgccttccgagacccccgggatggcccctgggaggccaaggagtcggggactgggtacccggagcagagtcactgtggccacggagaaccgcagctgagctttatgaagccacgtggccacacctcccggtgcctccaccccaagcaaacacagatcgctcagaaaatgggaacccagggcaaattgtatgtgctccttactgggtttattataagtgtcacatgttttttataataaaacataggtgatttcacctta

SEQ ID NO: 248910 - DNA, 240 bp, Homo sapiens
tggagggtccccagaggggaaggtcctgagaggggaggttcccgagccgggagggctggggctgggaggtggtggctcccagtcccagcgttcctgcagggcccccagcgcacctttctccttgatggtgaaattctgcgcagggctctccatgggcagcttcccattggggatgctgctgtttctctgcggagcaaacgtgaagctgctcacaccccgacacagccacacccagccctg

SEQ ID NO: 248911 - DNA, 2679 bp, Homo sapiens
  misc_feature (130)..(130): n is a, c, g, or t
  misc_feature (280)..(280): n is a, c, g, or t
  misc_feature (437)..(437): n is a, c, g, or t
  misc_feature (584)..(584): n is a, c, g, or t
ggggatttgagggtcattggttctgagggccctccgcctgctcttttgcttctaaatccagcatcttctgtatgacctttgtcccgctcctgccaccccacgaagacagacgtgagggtcaggggagccncggtgctaactgccactctgggcgggcacaggcgagggctgtgcagcacccgggcacgtggggtcttcggaggggctgctccccacaccacttcccctgcccctgccgagccctgccgtggggtggggggcgcagggagagaaagcagcngccctgggtgagagccaggagggacactgggcaggcagatgccaccccaggtgtggggacccccgctactgagtggccgggaggagcccacaggctccccacatgcagctgagcccagggttgtggtcgtgggtcgtgggtcaaggatggtggctgntgtggttgggggagaggctcaaggcccgcctgccaaccttgtcacctatgtgggggtgaggggagcccgccagaggccagagcccccactgtcccttcccaccctccagccaggctccaggcctcctagggccagagtatctgagcnttctctcgcttgccgggcctgtggtttgggggtttgtgtggagcctggtccaggagccctccttcctgatctgcactggctggccctcctgacagccccaggcccccgtgccctctgccaggaggtgccttgccacttggcatggcccgtcacgggtggcacatctggggtgaatgcacgtcagtggaggcagaatcattctgtctgaatgaatggagtttccaggcccccactggccctctgtgtgagggtctgcagggtttggcaggacaggtctttctctccggcgagagcacccaccctgaccggctgctggatgagggcaccaaagctcgctagggagggctctgtccttagggaggagctgcggaatccctgcagctgtgcccccaggccctgccttgcacacttcctgcagccagggcgcccctggggaggtcagggcaggccggggaggctgaggcccacctgccatagtgggcaggtgcgggagccagggcggcagtggcctcggggctgggtggggcgcctggcctctggtctctggagtagtcaggggctctgcagatgctgagaggcctgctcatagtggactgggagatgctggagcagcctcagagccatggccggcccacggcgggagacggccctgctgctgcccctctgcctgtgcgtgtgcacctgtgggcacctgcgtgtgctggggcaggcagggctgtattgggaccaggtcccgtaacagcctgcctgcttaccgtctgctcccatccctggggaaagcaagggagctcggggtcctaggacctgacctcagcgctcacccccaccagcaccacagtcaccaggactctgtgactcagtttaccccacgagagcccctgggattcccagggcatcagaaggcccatcagcctcccgtgaactgctggggtgggcctggccttgggacgcgggtgcaggggcctctcctcactgcccccatggcacccacagccagtgcccgagcctgctgcagccccgacccggcagagcaagcggctctgctacctcagccacgtagctgatggcatccttcaggttcagctcgtggaagacattcaggatccggtctcgagacttctgggccgaccgtctcatgaggaccctgctgaggaacttcctgtcgaagtgggaccacctgtagggacagaccttgggtgtgagcctcaggtgacaggcgccctagagcccgccggacgcgtggcccggccccttctctcctgaattttgtttgctatagtgaccctgtaggcgcgtttaaaatgagggaagcagcccctgccacacgcccaggccgtccgccgttctcccgcctgtcctgttggatggaggccgttagacgcatatgaaactgcatgccgcctcctccagagggtggctcaggacacggtgggtgtcaggcctggtcaggcaagggggctttggccacatggggggcaccttcaggtgcacaggaggaagggcaggggcggacagacaccctgagcccttagacttgtgggagccaagctgaccagagtgaggttttttttagcctaacggaattagagtattcgctggttatccggatcagaagggacggtggcctggccggacttagaggaaactctggggcacaaggaggtgatgcctgtcacttggacatgggtgcagccgccagagccgccctccagggcacagggtgggcccgggtgagcttgtgtgctcacacctgggcaggccccgcggcagcaatggcagctctcctgtacaggctgagtttcagccacaccaagaagtcaaagctaaccgaggctgtgccttccgagacccccgggatggcccctgggaggccaaggagtcggggactgggtacccggagcagagtcactgtggccacggagaaccgcagctgagctttatgaagccacgtggccacacctcccggtgcctccaccccaagcaaacacagatcgctcagaaaatgggaacccagggcaaattgtatgtgctccttactgggtttattataagtgtcacatgttttttataataaaacataggtgatttcacctta

SEQ ID NO: 248912 - DNA, 1689 bp, Homo sapiens
ctggcgtgggcgaggcggggctcggggctcgcggtcgctgtagccgcgcggggatctggggtttctctgggacagcggcggcggcggtgggcggaccgtggcgcggggacgagcggccggttagcggcgtgtcggagccggtgtcacctgcgggagaggaaggcgagagagggcagcggctagtcagccttcggagagccccacggcggcaggggagacctcgccggggccgtcacctgctgggtgccttggaaagttagggtcaccgggaaggttagggtcacgtgcctttcaggttgcgggcccttcccccacatccatgaccccacacgccacaggcagcacagcttggccgccttcttgttctggttgagccccagcttggtcgacttgaaggactccaggcgcttccgcatggtcctgtggaagatttcccggtcctgtttctcgtcctccgtgggcgtgagctcgtgtcggctgtacagatgcttgtactgcgggatcaggcacggaggtcacagctgtgcccagcgccggacattctcgccctcctgccgcaggagctgagcacggatcccccgtggtcccaggaggggacgaggaagccgccccacggggtccctgcggggtcctccagcccccagcccgcagtgcccacctcctgccgcggcttgtacaggccaggagccaccacagccctgtctgtgactctcagctcccgaggctgggctcttccccagggaagctgcatgaccatggccacatacaggaggagaccctaaaactccattggcctcatgtccagaactgaatcaggttcagctcgtggaagacattcaggatccggtctcgagacttctgggccgaccgtctcatgaggaccctgctgaggaacttcctgtcgaagtgggaccacctgtagggacagaccttgggtgtgagcctcaggtgacaggcgccctagagcccgccggacgcgtggcccggccccttctctcctgaattttgtttgctatagtgaccctgtaggcgcgtttaaaatgagggaagcagcccctgccacacgcccaggccgtccgccgttctcccgcctgtcctgttggatggaggccgttagacgcatatgaaactgcatgccgcctcctccagagggtggctcaggacacgcctaacggaattagagtattcgctggttatccggatcagaagggacggtggcctggccggacttagaggaaactctggggcacaaggaggtgatgcctgtcacttggacatgggtgcagccgccagagccgccctccagggcacagggtgggcccgggtgagcttgtgtgctcacacctgggcaggccccgcggcagcaatggcagctctcctgtacaggctgagtttcagccacaccaagaagtcaaagctaaccgaggctgtgccttccgagacccccgggatggcccctgggaggccaaggagtcggggactgggtacccggagcagagtcactgtggccacggagaaccgcagctgagctttatgaagccacgtggccacacctcccggtgcctccaccccaagcaaacacagatcgctcagaaaatgggaacccagggcaaattgtatgtgctccttactgggtttattataagtgtcacatgttttttataataaaacataggtgatttcacctta

SEQ ID NO: 248913 - DNA, 453 bp, Homo sapiens
tggagcatgccttggagaaagagaccaaaaaatctccaccaaatgacacctccacttttgtatgggaaattttgaaagcacatttgctgtcgtggtgactgagttgcagtgttcaaggagagagggagagacaatggctgcccatgagcaaagagcctgaatgcttcactggtgtgtctccagggccaaccctgggggtgctgcatatggaactttgggaaaaagacattcttttcgtagttaaagagcacaggatccaaaggacctaggctgagccccttctgggtccagcttgattgtagggccgatttcatcgctttggtctcatttcccacatctggtaaatgtctgtctcacagaaatactgtgacaagtaaataatgtgcatagaaaatactagaatctaaatatatgaagccctatccagatgccctcggcctcaacactttatct

SEQ ID NO: 248914 - DNA, 564 bp, Homo sapiens
gagatggagtctcactctgtcgccaaggctggagtgcagtggtgtgatcccagctcactgcaagctccgcctcccaggttcacaccattctcctgcctcagcctcccaagtagctaggactacaggcgcccgccaccacacccggctaattttagtagagatggggtttcaccatgttagccaggatggtctggatctcctgacctcgtgatctgcccgcctcggcctcccaaagtgctgggattacaggcgtgagccactgcgcccagtcgtgaaagaactagcttctaatcttctatagttaggatacaattaaaaagtatttaaaagtagaaaaaaagtagaagtgctttactatttaaataaatggaagtaaacactgaaagaaacagctattaagagtttaaagaagttgtctctggcgagggggaaatttaaaaaataggagtgaaataccatggagaacttctatttttgtaataaacttaataaatacaaagcgaaggacacagaagaatagtatatattgatacctgttatgaaaactaagctcacctggagaaa

SEQ ID NO: 248915 - DNA, 638 bp, Homo sapiens
ttttcctttctttgattgtttttccttcttttttaaaaaacaaaaacaagaggaaaacagatgggggaagagaattgccagaaggaagatggccccagagggtcagaagagggatggcccagacctgctgtctccctcttagtttggccccacccaccaccaaaaaaagaaagaaagaaaaagaaaagaaagatgacaaggaaaaaaaacctcaatcgtcctcctggtcctaagactcaacatgtattttgaaaacgagtagcagaggtggtacttcagctgagccatcacggaggagcaggaaggctgtaactccagaaagaggaatcaaacttgacagcggtttgtgggtttgtttcctggggaccattgctcagaggaaaaaaaaaaaaaggaagaaaagagagagcgagaagtgggggtgaggtttgatttctcatcgtgaagtagctttccttctttcttttcttgaattgacagcacattgccaggaagcaggcctgtagtgtaaattgttaaattagcacattcctaattttggttaagacaattttttagcactggtagcaaagggggaaatctttaagtcaaccaatttaaccccacttatataagaaatacagcttatagctataatg

SEQ ID NO: 248916 - DNA, 265 bp, Homo sapiens
ctgtttaagaatgcaggtttaggagaccaggctcaactcctcaccctgccagactgcattgtgtgacctgaggcaagctgtttagcttctctgtacctcagtttcttaatctgtgtatgattattcactgaattaaatagattaatatatatatatatatatatatagtataaaattgattagtacctggggcatagagtgcttgtaaaccattgaaaatgtacctattgtttatgtttttaaataaatagatgtataaagagta

SEQ ID NO: 248917 - DNA, 383 bp, Homo sapiens
tcccgctactcaccactcggctttctctattctccagccacactgatctacttaaccatccttgagtagtcaacattagtgtgccttcatgctctgcattccaaattccttttatcattcctcattgtctgcgccctctcaagtcttcccacttaatactgcttcttcaagacagttcaaacatgcctgaacttcccaggctgatttaggccacccatggcacccttaatgtgcttctattaaaactcttactatatatcacagcatactttcttgcataagagtgtgttttattcatcagtttgtccctagcacttaactcagtgcctggcatagagtactcaatagatatttgttaagagaaaaagtaactgtcttcaaca

SEQ ID NO: 248918 - DNA, 648 bp, Homo sapiens
accaccttagtgcaggtaaaccagggaaacatttcattggaataagaacttaggttgtcttcctagcgtgtggttcacttttttcccttttttaaaaattgtggtggccaggcaccgtggcttttctccttttttattatttttataaagatggagtctcaccatgttgcccatggctggtctcaagctcctgggctcaagcgatccccttgcctcggcctcccaaagtgccgagattacaggtgcccaccaccatgcccagctggctttcttttttaatgaattgcttctttgtgtcctttggccatttttccattctgaaataatccctatatttcttattgatatatatataacagctctttatacacacacacgcacatatatatacattaaagttatcaatctcttgctatataagctgtcagctttcttactttttttgactttcacatattatggaatagtcatcattttcttttatacagcagtctggtttccacatcagttcatctctttcagatcactgtatacacttaataatgttgaagtgttgatcagtcccattgattctcattccttggcactccccatgagcctcgcacctttcggctggcttctctccatctcctctcccacaaggggtcc

SEQ ID NO: 248919 - DNA, 416 bp, Homo sapiens
gttccaagccatgccacacccttaggagtaggctggggccacaccagttgtctgcaacccaaggtttacagccaggggcacacaacttggagggaagagcagccctttcttttcttcattgtggttttccataggccctctctgtccttctccgttttgattcattgaccctaagagtagcattactttcatatgcagcattaggtgaatgtcaagcatttccagagacctccctaagaagttgttgttagcattcttctgaagaagctgtagaaatgaagtagcagagactttagactagtgacaaaagcaactacctaacaaaagttaggtattgactgactgaagggctaggccatagcccaaaatattactttcctggggcagtggttctttaacattaaacattcagctca

SEQ ID NO: 248920 - DNA, 407 bp, Homo sapiens
tcatcccaaactgaaaccctgtgcccattaaacaataactcatccccctttcctccagctcctcttaaacatttgtagtttgcctttaatattttaaattattttataattagtatatatggacaacttatagaaatctggtttatgttttggaggaaactgtgattggatatgggttgctgatggtcgcataagaatgttgaacagtattgtaggctgccattgaggtattctaaatacctgatgtgctttagagaagactataacatgtaagtgggttgagagggaaaagaggacatgagttttccaaagacaaattcaggtagagtcttttgaagtagaggaatgttgtagattggaatgcagttcagaagtgatttgtgtttcaggcaacaatctagatttag

SEQ ID NO: 248921 - DNA, 431 bp, Homo sapiens
gtgcaaactatctctaataattttacattgattacatgttgacacagtatttctgatatactgggttaaaaaaatgtacaatcaaaagtaatttcacctgtttctttttgcttttttaatatggctactaaaatattttaaattacatatgtgacttgaattatttctcttttatataacactgctaatgtagggaatctaagatactacctgctccaaaattctataatactagcataaagagataataaattaactttattgaactataagaactcaattttatagtcgggcgtggtggcatgtgtctgtaatcccagctactcaggaggttgaggcatgagaattgcctgaacccgggagacagaggttgcagtgagcagagatcatgccactccactaggcaataaaagtcagactcttgtctcaaa

SEQ ID NO: 248922 - DNA, 352 bp, Homo sapiens
gctcaatgcgcgacgcttccatcaaagattaattcgacattctgggcttgagatactgaataagcaacacctggcctcatccgaaccctgcagatggattttccacccaagatgtttcagatttcaacgagagtcccgttctcctggataacgacgtttctggggaagtgagcacccacagaggtcatcttgtaatggaacccagggcaacccctttgaccatgctccgtacacgactatgaacagtcccaacggcagccggctcccttcagtttccccaccgtttgtcaacccggagcctcttttcctttccaaggagactgagttctacattgatggaagcgtcgctcct

SEQ ID NO: 248923 - DNA, 430 bp, Homo sapiens
gttcatccaatgctatccaggagagatgtcccagtgagacaaatgtgcagtcctctccacaagtaaaaagaagagaagctgccttcgggtggtggagtctttaacccacttctcttctgccgagactgaaaaggatccaaatctcatggcattaaggaacaggaagcagggaaattctgcgcagaagagggcagttccctgggcttggccagcagagaaaggagaagcagctggacaacgaggactatggttggaagttggagagaagcagcttgacttcagagggacagcttgatggcatagcttcagagaggagtctgactggggatagccagacttcaggggaagattaccttcctgctccatcccctctttggctccccttcctgctgagagccacgttcattggcaataaagtcccctgcattta

SEQ ID NO: 248924 - DNA, 488 bp, Homo sapiens
gcgtctccctcgcaagtttcggtcgcgtctcccgagccccagtgggcaggacccgggcaaacttcgtgcctttaaatgactgccttgatgccgcggaactttgtttggaccaggcgaggggaggatggggcgaatgagagatctgcaagtcttggaaatccgtgcgcctttgcaaagtttgcaaaatagtttggcgctcacaaccctaggctggtgcggcatttgtaatgcgtgaaaacggttcctcgcaggtgttttactgctagaaaatgcgggacgcgtaggaatccatgggtgcacgtttctgtaatttgaaaatgttgtctctccccacccccaacccttatccctttctttcccaacatttaatccgcagatagatgctttttagaccgtagacttcagcatgccttctttggactgggaaggcttgttgaattagggccgtacccagtgattggaaatagtgcgagacgaatggaaaaaaa

SEQ ID NO: 248925 - DNA, 483 bp, Homo sapiens
tgcctaaagtgggccttaaaacaagggtccctgtccccacgttctctctaaaagtctgcatgatgtccctcgtcatttctacgggttataagtgagcaagacgtttaccacgtatcacacttctgggggctatttcaacgcccaagctggggctgcagaatggtttctgttctaatcctcccccgcgatttccacctctttacactcaactcacagaaaatagagtctgatgcattctgtgtttcatcaccggtcaaaagtgactttgagggtagggtggaggcctgagaagggcagcttcaggcaatagtaatcctgaaatttatcattgctcaaaataaatgtgctcaccttattaaaaagtacaacggaaagccacctttaagataagtagcaaccaagtcgttaaacagcagtcttcaaggaagaactcctgatctcataaggctggagaaaaaacggggttagcctttgctggtgaaa

SEQ ID NO: 248926 - DNA, 173 bp, Homo sapiens
aatgcatcttcttgcttctaaaggtcccgttggagcaattccagcatatacaggtgtagttctcgtttcccttgtgcactatataatacgaactgcctgggctgtgagtcatcctacgatatcataaattctttctgaagagtaatactctgccaattttaataataatctta

SEQ ID NO: 248927 - DNA, 405 bp, Homo sapiens
ttggtagagaccgggtttcaccatgttggccaggctggtatccaactcctggtctcaagtgatccgcccacctcggcctcccaaagtgctgggattactacaggtgtgagccaccatgcctggccttatgtgtcagtttgactaagtcacaaggtgcccggatatttggttatacactattctggatgtttctctgaggatatttttagataagtttaacattcactgagtaaggcggatggtcctccttgatgtgagcaggcctcagcccatcagctgaaggcctgaacagaatacaaggctgatcttcctccaaaccagccggcatcctcctgagtaactgccttcgggcttgagctaaagcagcatctctgggctccagcccaccggcctttgaaaaggaat

SEQ ID NO: 248928 - DNA, 231 bp, Homo sapiens
taccctgaacagaccaataacaagcaaccagattgaaatggtaatttaaaaattaccaacaaaaaaaagtccaggaccagacagattcacagctgaattccaccagacattcaaagaataattggtaccaatcctattgacactattccaaaagatagagaaagagggaatcctccccaaatcattctgtgaagccaatatcaccctaataccaaaaccaggaaaggacat

SEQ ID NO: 248929 - DNA, 891 bp, Homo sapiens
ggtacgcccgtcccgctccgcaggggcagagggggaggggatgaagctgcccggcgccattttgcttgtgggctgccgcccgccgttgcctctccgcggaggctcgaagatagcaaactggaggcggtgagggggacggaatctctgtctttctgacaacagatgcattcaacaatccaccgaaggtttgaggaagtgtcggtattcggtgggactggttctttccccctttcccccagtggccctcaagtctggatataggtgagcttgggcatgccagtattgggtgcacgaacaaggacagcagggcttgggaacgaactccctcccgtcaccctccgaaagcgatacaccttctccccctcccaaacaaccccagtcccgtctccccgttcctctccccctcctcccccagcccagtctggcctccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgggaattcctttatatggcggtgattaaacgagggagggacagacagtgatctcgaagaaaaaagggggagaccaaagaataaaagaagggtttccccactaaaatgacacggcgattccggctcttgttttgggggtct

SEQ ID NO: 248930 - DNA, 949 bp, Homo sapiens
ggtacgcccgtcccgctccgcaggggcagagggggaggggatgaagctgcccggcgccattttgcttgtgggctgccgcccgccgttgcctctccgcggaggctcgaagatagcaaactggaggcggtgagggggacggaatctctgtctttctgacaacagatgcattcaacaatccaccgaaggtttgaggaagtgtcggtattcggtgggactggttctttccccctttcccccagtggccctcaagtctggatataggtgagcttgggcatgccagtattgggtgcacgaacaaggacagcagggcttgggaacgaactccctcccgtcaccctccgaaagcgatacaccttctccccctcccaaacaaccccagtcccgtctccccgttcctctccccctcctcccccagcccagtctggcctccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgattttgtacggcacagtctagtccactgtggaagcgtcgaaggagtctgttggctaattcctgggatgactgcctcaaagctgtcttatcaaagttacgagctcttgatacatacgcttactcgatcttgatcttttaccgcgcatgtttcatcctctgagtcgcttctattttatactaccgctctcctgctgtcc

SEQ ID NO: 248931 - DNA, 863 bp, Homo sapiens
ggtacgcccgtcccgctccgcaggggcagagggggaggggatgaagctgcccggcgccattttgcttgtgggctgccgcccgccgttgcctctccgcggaggctcgaagatagcaaactggaggcggtgagggggacggaatctctgtctttctgacaacagatgcattcaacaatccaccgaaggtttgaggaagtgtcggtattcggtgggactggttctttccccctttcccccagtggccctcaagtctggatataggtgagcttgggcatgccagtattgggtgcacgaacaaggacagcagggcttgggaacgaactccctcccgtcaccctccgaaagcgatacaccttctccccctcccaaacaaccccagtcccgtctccccgttcctctccccctcctcccccagcccagtctggcctccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgtaagctgtaactgcatcatactgaggtccttacaccactgagctccagcctgcgcaacacagcgagactccatcgccactgaatactataaggttttccaactcacgtgac

SEQ ID NO: 248932 - DNA, 370 bp, Homo sapiens
  misc_feature (43)..(43): n is a, c, g, or t
  misc_feature (63)..(63): n is a, c, g, or t
attacggagcatgtggacagaggctcactcccacatctttatncaatactgctgacctagatnggttcttaaaactacacagcagaagcaggcaaactcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaa

SEQ ID NO: 248933 - DNA, 1048 bp, Homo sapiens
tgcatagcgccagcgactacgagagctgctgattcggcagcagatccagcgcaacaccctgcggcaggagaaggaaacagctgcagcagctgcaggagcagtggggcctccaggcagctggggtgctgagcccagcagccctgcctttgagcagctgagtcgaggccagaccccctttgctgggacacaggacaagagcagccttgtggggttgcccccaagcaagctgagtggccccatcctggggccagggtccttccctagcgatgaccgactctcccggccacctccaccagccacgccttcctctatggatgtgaacagccggcaactggtaggaggctcccaagctttctatcagcgagcaccctatcctgggtccctgcccttacagcagcaacagcaacaactgtggcagcaacaacaggcaacagcagcaacctccatgcgatttgccatgtcagctcgctttccatcaactcctggacctgaacttggccgccaagccctaggttccccgttggcgggaatttccacccgtctgccaggccctggtgagccagtgcctggtccagctggtcctgcccagttcattgagctgcggcacaatgtacagaaaggactgggacctgggggcactccgtttcctggtcagggcccacctcagagaccccgtttttaccctgtaagtgaggacccccaccgactggctcctgaagggcttcggggcctggcggtatcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaa

SEQ ID NO: 248934 - DNA, 313 bp, Homo sapiens
gagatcctttctctgaaaaaacagcaacaactacaaaacaaaacaaaacaaaacaaaaaacaaagaaaaaaatctgtgggactttgtattaggccaggatttatttattaggtaggacacaaaaagcatgaatcattagagaaaaaatatgttaagaaaatgaaaaaaaaaacccaagactgaactgggaaggaattgaatccctcaatagaccaacaacgagctctgaaattgagtcagtaataaatagcctaccaaccaacaaaagcccgggaccagagagattgacagctgaattctaccagatgtaaaa

SEQ ID NO: 248935 - DNA, 298 bp, Homo sapiens
ggtccctttgatctcattcctcccaagcactacaggtttttcagcactttgacaacatgactatctttggaaggttacatcaccctccaacttcacccaaatggccttccacggctatagaggtttgcggctgagaggcttttttactaaaaaggagacaggaataaggaggagggtggggtggtaaggctaaggggaggttgaaaaaacaaaccaaggaacaaaaatagactttgctctgaaatcccctggctgctgctggaaatccgtcttgccagcacatctccacagtgaccag

SEQ ID NO: 248936 - DNA, 290 bp, Homo sapiens
tagtaacccccctgcctggtgtcagccacccccgcccctggcctggtttgctattgccgggctgacctcgccccgtctttcagttctccgtgtggagggtgctgatccgtccgtctccatctgcttgtgaagcaataacagaacagcataggctgggtaatctatacagcacggaaatttctgtcctcatgcttcaggaggctgggaagtccaagatcaaggcaccagcaggttcaggtgtctggggagggctgcatcttctggaagggagaaggaaactggagggcaag

SEQ ID NO: 248937 - DNA, 386 bp, Homo sapiens
taatcacacttgacattgtcctgagtggctccagaccccttggcacttctattactaatgggcaacctggaagaaagttttgcagtcatcaccagaggacaaagtcatcctcaagcctatttaaagtgagacagtcagagggtaaatgcaactttataaaactatttatgcacttatttccttaataaaagggatgcgtatgcactgtaagtgattcagaagatgctcccgcaacccacttctaccttcaccttcccacaaccttatatcgtcatccaagcacaaccaccaagaacatgtcactctatttccatctagtcattactttgctatacattgggaggttttatcatttttatctcattaataaaacatgtttaaaaaaa

SEQ ID NO: 248938 - DNA, 299 bp, Homo sapiens
ttttttgtccagagaattaggcattcattcagaaagagtattctcagattttctgcatgctgaggtgtgaagattgtcgtgttcttgtggggaagtagccacctatcatgctgtagaaccaggcctaaggtacataatcattacactcctctcagacagtgccagcacttattggatcgtctaaattgaaatcgtctcctttccaggaaagtctcctgcatgttatatgtactctgattacaatcacaattctagtgtttaggtttctaagtggcataacttcacccggataatttttg

SEQ ID NO: 248939 - DNA, 814 bp, Homo sapiens
cggagtttggttttctgtccttgtgatagtttgctcagaatgatggcttccagcttcatccatgtccctgcaaaggacatgaactcatccttttttatggctgcatagtattccatggagtatatgtgatgcattttcttaatccagtctgtcattgatggacatttgggttggttcccagtttttgcttttgtgaatagtgctgcagtaaacataagggtgacagagtgagactccgtctcaaaaaaaaaaaaaaaaaaaaaaaagtggggggaaggattccacagcaagaaaacgctctaaaataaacaaaagtgcccgagggagtgagaaggtgctggctaccctgtggaaaccagaggatgacaggggtgacatttggcctgagacttcatcggaacatgctggttcacccctgtaatcccagcactttgggaagccgaggcggcgagaagatcgcttgagtgaggccaggaattcgaggctgcagtgagctatgatagcatcattgcactccagcctgagtgacagagcaagactcttgtctctgaaaaaataaaataaataaaatgaaatgaaattaaaataaaattattttcccagtggaggaaaggggcacaaacaggttcagctcaggcaggttcagctgccccccttcccccctcccccacaaggttacacagcctttgtagagctgggcagaaaccaaggggtggaactcccaggagggggcccagggaaggtctcttcctcatctgctgggaattttgggggtcctttgtctgggtctacattggaacctcagtcctaggaa

SEQ ID NO: 248940 - DNA, 482 bp, Homo sapiens
acgaatcatcatgcactgcactccagactgggcacagagctagactccatctccaaaaatataataaaaaattatctaagatgactctgaacctttctggctatccaaatcaagatgtgcaaactgttcttaggtatgtattcttttagtttatgctctcatcaaaccagcatatcttgcagtaattcttcctgcttagcctaataatattttttctacttgccagtgggtaggacttacactaataaccatccacctctctgttatagtagtttaagcatttatcctcactagtaacctttctttattaaaatcagttttcataacctaaaatattctgcaatatgacaaatcttaggggataaaataggctggattggtttgagtttaaacaaattggatttacactcttgagctgcatgtaatagatggtgaaacataaatgggacacatatcagttgtgcagtatacagtgatgagac

SEQ ID NO: 248941 - DNA, 376 bp, Homo sapiens
tggtcaatctagccttttatttggggagatagtgacttcttgtgacatagcacaagaagtatccatgttctgtgcaagaaggagacacattttcagttgaggttccaagcaataataataaaaaacaatcaaaatgtatggaatacttaccatgtgctaaccatagtattctatacactgatacatacacacatatacagtcgcatctatcagggattagtttcagaaccctgagggataccaaaattcatggatgttcaagtcccttatgtaaaatggtgcactatgtgtataaaacctacatattaatgtatcttctatgctttaaaacatctctatattacttatgatacctaatacaatgtaaatgctatga

SEQ ID NO: 248942 - DNA, 868 bp, Homo sapiens
ggaaaagaaaaaaaaacaaatggcaaatgaagaacattcactggaaaaatgttgccacaaaattgtgccaagtagatgccacagttcaaaaagtgtaatgaagctgccacttgtatataactaaagcttaaagggcagataagagagaaggtgggggaagtttggccagaccacagaagaaggtaaaacatgggcaggtagaacaagaggaaataaaaccattgcagaactgaagtctcagttggaggagagtgtatattggtgtaacctcaagggaaggtaaaatttcaatattgacaaattaaaatttcatatgccctttgattcagcagttccacttttaaggatttatcctacaggcatttccttgcaaatgtgtgaaataatatgttcaagtctgttaattgtattgacatttataacagcaaaacttttgaaatgacctatatattcccttatagagactcattaaataaattatggttatctctacaatggagtattatgcaaccataaaacataagataactgcatgtgactctatatgtatctcaaaataaaaagcttaattaaaaaataataaggcagccttataaatactgttaatctctaaaatatgttgatggtgaaacaaattaacatgtaagataatgtgtatagaatgttagcattgtataaaaaaataacagactatgctgaccttcttttatttccttagtctatctctggagggacatataagaaactggtaaagcagttgtctctggacaaggaaactagctggtttcttttgagtgttgtaacattttataccattgtattattacctattcaaaacaataaattaaacaatttatttaacaataaa

SEQ ID NO: 248943 - DNA, 314 bp, Homo sapiens
tttaatttaatttaattgttatagaaacaagttctcactatgttgcccaggctggtcttgcacttttaggctcaaacaatcctcccaccttggctgcctaaagtgctgggactaccagcatgagtcactgcactggcccttaaaattgaagttacctgtttctttttgctgtttttaaaggtggctactagaaaatttaaaaggagtggcttgtatatggcttgtatttcatttctatcggactgcactaggcaatctcaaagtctccagctcctccggtaataaaacaccaacaatccctacaaccctcacca

SEQ ID NO: 248944 - DNA, 392 bp, Homo sapiens
acctgcctagactttcttacagtggtgtcctccctagcttgggctccttgggcagtgaggtgggctggggcaggtgagcctctccaacagccattgaaacacccgcaaccctggggcctggggtggtggctcacgcctgtaattccaacactttgggaggccaaggtgggaggaccacttcaggccaggagttcgagaccagtctgggcaacatagtgagaccccatttccaaaaaaaaaaaattagccaggtgcagtggtgcacacctgtggtcccagctactcaggatgctgaggcaaaaggatggtttttgccggagttcaaggctgcagtgatctatgactgggccactgcactccagcctgagaaacagagtaagaccctatctcaa

SEQ ID NO: 248945 - DNA, 423 bp, Homo sapiens
caaaaggccctgtgtgcagaccgggaggcctgagtgcaaggccgtcaaatgccgtacttgaaaccagttggtcacccagggaggccaaagccccgggaggtgccaggcctgctttgtgccagggtgacattgcccaaaggcaaaccagagtcccccagcgcagggcggaatagggggtgctgaggtggtgcgacgctggccccagcctccaggcatctggtatctccagggcccaggcctgcgtcctgcctcggcctgaaggagcaggaggtggccccgtctgggctcccagccagaatctgcctctccccctggtaacagccacctccctcctctgcctggcctctgtccagccaccatacacggccccacgtggggcggctgcccagccccaccctctgaatcttccagggttatgtgacc

SEQ ID NO: 248946 - DNA, 510 bp, Homo sapiens
aggtataaggtctggaactgagtcctgtttctgctttgatgaacttgggtattgtccagacattggggaagggaaaacctgctgggccctggataccaagattacacacctaattaaaaaggtcagtgaacaaggtggacagacccaattctagatcttttctggggaaagacaccggactgcttgtccattaggtagacagaatgactcttaaaatgtatgttagatgccaggagtggtggttcatgcctgtaatcccagcactctgggaggccgaggcaggtggatcacctaaagtcgggagtttgagaccagcctggccaacatggtaaaaccccgtctctactaaaagtacaaaaattcgctgggcatggtgacacacgtctgtgatctcagctactcgggaggctgaggcaggagaatcacttgcacccgggatgtggaggttgcagtgagcccagatcgtcccactgcacttcaccctgggtgacagagtgagactccacctaa

SEQ ID NO: 248947 - DNA, 447 bp, Homo sapiens
agatggagtctcgctctgtcacccaggctggagtgcagtggcgtagctcgatctcagttcactgcagcctcccaggttcaagtgattcttgtgcctcagcctcccaagtagctaggattacagatgtgtaccatcacagacggctaattttttgtacttttagtagagacagggttttgccatgctggccaggttggtctcgaattcctggcctcaggtgatccacccacctcggcctcccaaagtgttgggattacaggcatgagccttccgtgcctggccaatttacctaattctttttaatcgatgcatagtattccactgtataaacatacatgtagtttactcaaccatttatctattggtgaatgttttggccgttttagttcttagctattatagactatatatatgatacacacacacacacacacacacacacacaca

SEQ ID NO: 248948 - DNA, 192 bp, Homo sapiens
ggggtttctccacgtggtcgagctggtctcgaactcctgacctcaggtgatccgcgagaagtgggcctttttatggatccagcaacaaactcccaacctcccaggaaaggttgcttcctgtcatctatataaaactttgtgtctcaggcctttattgcttttttaattgaaataaattatatatatatggtt

SEQ ID NO: 248949 - DNA, 83 bp, Homo sapiens
ccaatctcagcattacccagagcacaggaacacatggtccaccactgcagtagaacaagaatcttcagtgttgcttcagttta

SEQ ID NO: 248950 - DNA, 141 bp, Homo sapiens
agggagaagatatttttacctgtgaatcatttaaacaatatgctgctgttcctgttcctcagtcttttatgataatggaaaactaacatatatccaataaaaggatttagaaagacctgttacttgattcctcaaacctga

SEQ ID NO: 248951 - DNA, 354 bp, Homo sapiens
tctgcatgggccattcagggctgttgtatgggctgtgcactggccttatagtgcctgcccaggctaactcccatatagtctctgtgatttcatcatgtcccacccttgcaggtggtattgctcagcacctctactcacggcagggctggaaagtgtcctggtgtccattttgcattctctgatcacaggttcaccacctaactctccgtcagaattcccctgcatttgtttgtgggtcaggcctgataagttatctactcccaaggatgtattctgggatgggagcaaactataattagtctacaaaatgttgaccatttaaataaaaaattttctaatgtattagttgtaaaa

SEQ ID NO: 248952 - DNA, 492 bp, Homo sapiens
agaaaatacggcacgaggattaagagtgcacattaaactagcatgagatgcaaattccctgctgctcttaaatgtgccaaagccaatttcttctgtatgtgtatttttgagaaacttatgtcacactgaactgactgaagggatggcattgaaatctagcttgccctgatttatgtgtctatttcacagagactcagagatgtagttcagaaaatgcagggcctggcagggctggagacttcagagttcaaactgaagctttcagttggggaataataataatcagatgccctcacccttgtctaggtaatggccgcaaaatccatccgcatgtattattctgcactaatatggttaggaataacaacctgaaatggaaatgtctgcctcagagcaattacagttaatgcttattcaggttttagttgtttttccattaaaatgcaatgagctagtgaaagaacagcatctctgttcactgtttgatttttg

SEQ ID NO: 248953 - DNA, 247 bp, Homo sapiens
ctcagtgaggtactgtgatattatgagatatgtatttggtcttcctctggtttcctggcatacaacttctaaaatccttggaatctccaaagagataaacgtgtttttataggctagagagttgactgatggccaggcgtggtggctttggccttgcacggcggctcactcctataatcctggcactttgagaggccaaggctgactgatcatttgagcccaggagtttaagaccagccccgtctct

SEQ ID NO: 248954 - DNA, 372 bp, Homo sapiens
cgagatcatgccattgcactccagcctgagccatagagtgagtcttggtctcaaaaaaaaaaaaaaaccttgtgttggaaaccatctccaatgaagcagtgttaggagatagggcctaatggatataaattacagtgtctaagatggatactttactcttttcttttgagaagggagagagtatgttatgcactgagaacttttcagatttcttgcagaggtcataatgttccagacaagctggcagcaatcattcccatcccatcacagatccaggcttatttgtagaatggttacacaaaccaagcaaaaccttctgtaaagtttctaccctttgctctaaagttacataaaaacaatttccaagtttgt

SEQ ID NO: 248955 - DNA, 2046 bp, Homo sapiens
  misc_feature (889)..(889): n is a, c, g, or t
taaaacatcaaaatttgtatttatttttcaaaggaatttgagatacctttcaatatttaaaaatgtaaaacagtacaattgtcatgtattgatgcattactgatgaactcttgatgggagaaaggggtacaatctttctgggaggtcactgggcaataaatataaaaagtttttcaaatgcccacactctgtcccagcaattccacttcttggaatttataccaaggacctaagcaaacatatatgcacagaatgagtaacggcggtagacacagagatgccccataggagtgtcatatgaggacttgcttcacaggaggacttgctacttgctgcccagccttggagagtgtggtcaacagatacccccagctatcagctccttcaaagttggcctcagctgcagagtgcagcctcacgtgaggtccttcccctcccaggacagccctcatctggtcagtgaatgacttaagattataaaagcccagccatttccacccaatgggacaacactgataggcctttacagtagaccctggggtctgctgaggctgcaggactgtaccacagttcacctccctcacccacccctgcttcttccctcttcctttcacagggatccagccctagttaatatcttatacctccaatgccatttctgtcagcttctaaagactcaacctgtgatggcatcaagcatgacatgttaagaatgagaatcccaaagctaccaaaacccccaacaatagagatgatggagtaaattatggttcctccatagtgagatattgtgcagtcattaagaatgtaaaaggaggccagttgcggtggctcacacctgtaatcccagcactttgggaggccaaggcgtgagccactgtgcccagcngccaacagtggctatttccaagtggagattttgtacttctctcttttttccaagtgtttttacaaaagacatgtatattacttttataaatgagaaaatctgtatgatacaaaaataaaactgggtttccatatctacaggttctatatctgcagattcaaccaactatggatctgggtgtagggagtaagggaaacaatgaaaaattacaacaattaaaaataacacaaatgttaaaaaacacagtataactacatagtatttacattgtattaggtaatatgagtaatctaaagatgatttaaagtatatgggaagactgtgtaggttttatgcaaatactatatcattttatatgagggacttgagaatctgtaggttttcgtatgaacaggggtcctagaacaaattcccccaaatcctgagggatgacagtatgtccaaatctgacttctacctcatcccacaaccttcaatcccctcctgcctttcctgatttggtaaatggtaccatgcctaaaatttgagggtcatgcacgactttttggtctctcatgccaaccccattccctgtcttgtcaattttatttctactaccttagttaagtctctcattagcgctcagctagatttcagaaacagtgatgaccttcttgaaatctaactcttaaaccaccaacacactccccactcctgccccaattaacccctctttaaaggactcccagtggcctttaaaaaccatctgacaattgccagcacattaagtggtgtccttcaggatctgctccttcctgcttctctaaccacgacttgacctgtgcttctcccttttccagaaatgtgtttctctcccttcctttgccttgctttctcttacctattcttccaggctcaattcaggcctcttccttctcagaaatcaaaaagcttagcagatcctcctgagcgaggtgaggcatatcttctttatgcaatcatagcccctttcacaaggtattatattgcctcttttcctcactgaaccataagcaatttaagagtgcctggcttggtgcctgacacatatctagtattcaacaactgtttattaactggagtgtgtatatgtaaaacctataacttaatgtacagaattaataaagcattgataacag

SEQ ID NO: 248956 - DNA, 541 bp, Homo sapiens
gaggtggtcacctgatgctggtggttgagcagtgactcagggaagctgagtcattatagcgggtgggcaggaggtagatctgtaaccgtcaacaggaaaattacccagttctcatgcagaatcagaaagggaaaggagaagcaggaaattcagactccatgtgcctgagatcaagaaagacaaaaagccagcctgcagcaagcactttgaagagcgaatctgtgcagagagtaacgcggagtgtcaagaggtgtgcagaaaatccaaagaaggctgaggacaatgtgtgtgtcaagaaaataagaaccagaagtcatagggacagtgaagatatttgacagataaatcgaactgggaaaaatataataaagttagttttgtgataagttctagtgcagtttttgtcataaattacaagtgaattctgtaagtaaggctgtcagtctgcttaagggaagaaaactttggatttctgggtctgaatcggcttcataaactccactgggagcactgctgggctcctggactgagaatagtggac

SEQ ID NO: 248957 - DNA, 324 bp, Homo sapiens
ggtaatggcctgttgacggttacagatctactcctggccacccgctataatgactcagcttccctgagtcactgctcaaccaccagctcccacctccaacattgggaattacagttcaacatgagatttggaggggacagacaccaaaaccatatcacctgtctagttcaaaagtcatgcctgcaactaactcttttcatgggccctcagggtatctctctttggtagggaattcctaaagaggtatccaggtataagattcagtcatagtgggagatgacatttcttgaaaataagggttttagctaagctggaaaacattta

SEQ ID NO: 248958 - DNA, 340 bp, Homo sapiens
gagactccgtctctaaataaataaataaaataaagtaattatgaaatatgactatgacaaggtaaaaaataacaggaatcttttaaacccaatttttttaacaatggggaagtagttgggctgcatatgtgttcatccctgaatgttttctcttgttagaaaaataagaggctgcttttcctatcctcttcacactggctttgcaaagactaactgctccatcatccagtcccaaactggccagcaactttacttcatgaggcacagctgccaacacatgtattgaattctctcatggaaatcaccctgacactgaagtcaggacaaacattgcagcttt

SEQ ID NO: 248959 - DNA, 314 bp, Homo sapiens
ccctctcaagattttgatttagtgaatcttggtgggttctgtgagtctgtatattaaaaaaatccaggtgattgttggtcatcaaactttagtaaccaccaatcttgttaatgaagagatgagatgtacttaacttctaagagttatatgcagtgcatctagtctgaggtgaccaacaccctaggaaaagacctgcacagtccagtacagcaggcacgcaggccacatgaggctgttaagcacttgaaatatggctgggctgaattgagatatgctgtaagagtaaaatacattagatttcaagggtttaatac

SEQ ID NO: 248960 - DNA, 408 bp, Homo sapiens
gaaacactttaccactcatttggtttcatgtgttttcttaatgtgtatttttatgtatagagatggagtcttgctatgttacccaggctggtcttgaactcctgggctcaagtgatcctccctccttggcctcccaaagtgctaagattatagccatgaactaccactcctagcttaatgtgtgtgttttttttaatctttactaccttcatcctgagctgcactgcctacccttccctcataggcatcttcttaataatcatatttcatattttccatgtctatttgcatgcatgtagattcttgaaaatatatagaattgattttgtgtgcttttgttttttacacatttcactctgttgtagaaaaaaatctgcaattaaactgaaacttctgcattatctattg

SEQ ID NO: 248961 - DNA, 442 bp, Homo sapiens
agtatatccattagtgttttccccttgtttgctcgactccagggcacaaggctcctctgttacatcagacacaccccctcccacgtcagtgccttgcacttgctgttccttttgcctgggatgctttccacacagctatctcatgagtcattcccgctcccctccctgtcacagtcagctccttcaggtcttttctcaaacacctctgcttagtgagtccttctctagccacctgattaaacttgcaacctacttcttaactcttttcaccaatgactttttatatatatttaaataatttcttattgtctgtctcccttcacttcagatgtcagctccatgaggagagagttttgtctgttttgttcactattatatcctgcatgcctacaggccctgctttatatacaccatagaatactatgcagccataaaaagaacg

SEQ ID NO: 248962 - DNA, 419 bp, Homo sapiens
tgtattcctttaattcagtcataaatcaactctcaattctatgagatttttcacagaagaacggagcgcctcaaaagtggatcaaggcagaaatggatgtggaaattatcatcctgtacctttgaggtaaagaggcttctacagctctggcatgagctaccacaggtcataaccattaggaaagaaactggaatgttaccatgccaggctttgtgaataaactaaagttttgctggtggtggcacaggaaaaaaatgaagaaaccaagaggacttgaaccaagtgggtatgactccaaagcccatgctttaaatgaacaaattggcctaccctctaaggcaagaaccctttaatagtggtctatgtcagaaaaatatcaaaaagactcaaggctcttaaataaataaggaaatgaatga

SEQ ID NO: 248963 - DNA, 430 bp, Homo sapiens
ctgtttggtttctggaaggatcgcggatgaaacctttgcaaagaggcctacctcttggtccattggggagggacaagcatctggtgactggataaattcccttatggcatagaaatgggtttcacccaggtatgcaaaataccttgtctatactaggagatcattttctcaggctgattgaattcctagtatgaattgtgtgagagctttaataaaaatatctttgcagttcttacgggttttgataagctgacattgcacgtgctcaagaaaatgaaggtgataatttacagcacagtatcttatttcagggtatcaaattgaacttggttatttaaccaagtgctagcattaacatagatgagtaaaaattacatttttagcagctgcgttaagaaggaatttaggacttgagcttactcattttcta

SEQ ID NO: 248964 - DNA, 397 bp, Homo sapiens
ctcgttgctctggaggcaatcaaatattaatattagttcccttcttcctgtaacaccaaaatctgatttgttaggaattattgcgctaacagcaggaatctcattgttatatacttttctgaaagtcttataagtagtccactttccacactacacctacaaaaaatatctactaaaaaacatctactttggacaaataaaaagccactccccccatcacgattttaaagttaaattgctactgatgtttgtccttgagaagtgtgagagaaatgacagctgaaagaaaaatgttaagacaactcaaagataatgtgaatgtgattggaagggtccggataagaattttggaagatggaaattttgaagttgtccttggcagtcattttgtttaaga

SEQ ID NO: 248965 - DNA, 335 bp, Homo sapiens
gaaaaagcctccggtctcccgcacagccggctctgcgtgaattgctctttctccattgcaatttccctgtcttaataaatcggctgtgtctaggcagcaggcaaggtgaacccgttgggtggctacagcaatgccctgggtccaaaatctggctcagacattgctaaactgcaaaaggcaaaggctaaagaacttgccactaaactgggttaaacgtccactgttgagttttctgtacataaattctttttttaattctccttcaaaaaaaatactggtctatcaaagtggctcctgccagtaatcccagcaatttgggaggctgaggcaggaga

SEQ ID NO: 248966 - DNA, 541 bp, Homo sapiens
acacctcttctgtatgataaatcatgttattgcaatttatgtgacactagtatctactgtacagtaaccactccaagtcctcttaagcggaggcttctcaatatactgatttctaatgccccacaagtgccataaagtgattgctgttgaccattgtcttgttttaatgtcccctaaataataataaacttgaatgctaaaaaaaattattgtcattcaggaatatatttcttgtaaaccattgtatgatgaaaaaaataaatttccctcttggcaacttaatttgtagataactgaggttgtttttagataggagtcctacactgaatttggaatctaggtgactgtttaatgtcattaagggaatattgtattggctacaatggctcagtaaagtaactggtttctatgtggttatatcaatctatttctgtaacaccgtacactagttttccccctagagtactccttgtaatgctgagaaagtgtcagaaataatgactgtctacctatatctgcaataaaacgtagagcatggaaa

SEQ ID NO: 248967 - DNA, 305 bp, Homo sapiens
  misc_feature (89)..(89): n is a, c, g, or t
  misc_feature (125)..(125): n is a, c, g, or t
ggtttgttctaagcaaaactggacaccaaaaaaatcaaccagtaatttttataagtgcttctccccctctcccagatgtacttcccggnaataaaggattcaaaagataaagacaaaagacgctncaagttgttaaccaagaaagtcctggcttgctttctatatttctattaaaaagtaaagagagctgggtaagtggctcacacctgtaatcctagcactttgggaggctgaggcaggaagatggcttgaggccaggagttcaagaccagcctggacaacatagtgaaacccccatctctaca

SEQ ID NO: 248968 - DNA, 560 bp, Homo sapiens
tacaaaacaatttacaatgttcttttgttccagaattttttaattatttattcttgttatgttgcaaagtacttcattatcttttgttggtattacttggaattcctaactatagttttctcttttggataaagcattttaaaatctttatttaaagcacatttaaatctgcacccagttactctttagagaaactggtttagactcactcttaagtgaacagactcaattttatttgaaacaaaacttaaaaggtaaaattttggccgggcgcggtggctcacgcctgtaatcccagcactttgggaggccgaggcaggtggatcatgaggtcaggagatcgagaccatcctggctaacaaggtgaaaccccgtctctactaaaaatacaaaaaaaaaaaaattagccgggcgcagtggcgggcgcctgtagtcccagctactcgggaggctgaggcaggagaacggcgtgaacccgggaagcggagcttgcagtgagccgagattgcgccactgcagtccgcagtccggcctgggcgacagagcgagactccgtctca

SEQ ID NO: 248969 - DNA, 353 bp, Homo sapiens
tggagagactcatgcctgacttgcttttccaaatgacaaatgagtcttcactgatcttcaggcataatttggtatttccaagtctttttttttctttctttttgaaaaaataccaattgggaactaggtatttccaaatcttaactggggttatttaccatctctggtgccacccaagctgtgagctccttgtgtgcgcattgtgcccagcagcagacacaaagtctggcatagaagcaggcgacgaggaaatgtgtgctgctttgaattgatcctctcttttagttccaatgatgtttagaaaatctcagtacaggatgaagctgacaataataaaaatgcatttgacattt

SEQ ID NO: 248970 - DNA, 257 bp, Homo sapiens
atagcagaagcagtaaaggaagagaatactaagagatcttttgggtgggcagaagtggtaagaaagatagaggattatgggaaaaaatcatttttattgagaccctaaagataattttaaaccacccactttcctacctatatccttgttcgacatggattttggccggaattgttggtcacagtatatccaaaatagctgagtacttattttgttataaagagtggtattaaattactctatttgtaaaactacaa

SEQ ID NO: 248971 - DNA, 482 bp, Homo sapiens
cagaaaatcaaaagtcagtagaagacgtcaacaggctctaacccacctagacttggcagacgtctgtagaatactccaccaacaactgcaaaggttgttgtgcccattattctcaagtgcacgtggaatgtctgacagaataaacccgatgttgtcataaaataaatctcaataaatttaaaatgattgaaatcatgcaaagtatgttctcttaccacaattgaatgaaattacaaatcaataacagaaagaaatttgggtaattaaaaaatatgttaataaaacactgaactccttagtatccaatagggcaaagaagcattcacaagagaatttagaagatagtttgagataaatggaaatgaaaacacaatatactaaaatacagatgaagctaaacagtgcttacagggaaatgtacagctgtggatacttacactaaataaaaagagatctcaaatcaataacccaaccttccacct

SEQ ID NO: 248972 - DNA, 476 bp, Homo sapiens
cagtgattcagactccaatcctgcttcatctctcaggcttatcgcttatctccagctgccaggagacagacgatgggggcagagaggcattttggctgagccaggcctcaggtagccccaagggatttgagaggcctccagacaagcagactcaggcactctcaccaggtcactctctatttaaaaaacaccaagtctatgagttcccttgagaatatagcatttcctgcgacctatgacagcaaaaatggacatttctatatctgttgattcattccttcttcagagctgctgtttcaagtaacccaggactttgggtgaaagtatttagggcagtcgggactccaaaggaccttgcaaaaggtgaattcttgtcccgccccttcccaacttcatttgactttaaaagtaaccctaatactctcatagtaaaactggcgaaatctaaataaactctggattgtaccaatgtcaaa

SEQ ID NO: 248973 - DNA, 798 bp, Homo sapiens
aaaaagaagaagaagaaaaaccggacagaattgtatacactctcaccacaaagatggatacaaggtacacggaaaccaggcaatatgtctttgttttaggttcaaagtctgtcaaaatgagcctctaacttatatcctaattaatgaggacttattggaaactttcaagaattaggaagcccggcctgaggtgcttcccaaaccattttgggttgtttttacttaaaaatgttagaagagaatttagagattatgaattataacttttcatttcacagaagagaaaattgaaaccaagggagatttaagtatttgtacaaggcatgagcataaaaatatatgcatttatcactaatttttaataccgggccattaggtacagaggcatttatgttaaaaacatactttttaatagttattattttatcccagtttggaaattttgacactttttaggtagatgatgaagacacaaaatccgtttgaatagtgaggaaaacatacctatacttcagccgggcatggtggctcatgcctgtaatcccagcactttgggaggccgaggcaggtggatcacctcaggtcaggagtttgagactagcctgcccaacatggcaaaaccctgtctctactaaaaatacaaaaaattagccgggcgtggtggcaggtgcctgtaatcccagctgctcgggaggctgaggcaggagaatcgcttgaacccaggaggcagatgttgcaagtgagccgagattgcgccactacactccagcctgggcgacaagggcaaaacttcatctc

SEQ ID NO: 248974 - DNA, 465 bp, Homo sapiens
ctgcattgggggaaggagggagtctgtatggcatagccatctgggtcccagagtctcccaagaagctgccctaaatcctgccacatcacagctgccaaaaaactccaaaggcagcacctcccttagtggtggctccagaatttcaactctgggactgcaatctggaaggaggctgtgtgtgcaggggaaggagtggtatcttaaagctgtgtttgcacagcacattgcattagaccttaaaaatgtccaccatccatttcaaacagtgggagcactacttataaaaattataaaggcctttagaacccaccctccccataaattaccaccggcaccataggtgattccacatctgacccatcaaacacctatcagtccttgttcttcaaaatgagggcatatttgagacctagtatggcttccagtaacctcccagaaggcctcataaagctgagttgaaagttg

SEQ ID NO: 248975 - DNA, 553 bp, Homo sapiens
ggaccttttcatcagttataacaagtgcacaactcttgttcaggggaagctgtgcagttgggagggcagagagtatgtgggagctctctgtactttgtgctcagttttgcgtgaatctaaaactgctctgaaaaattaagtctgtgaaaaggaagaaatgaactaccaagtcatgaaaaaaacacagaagaatcttcaatgtatattactaagtgaaaatgcatactactgctatggtttgaatgtgtcccctaaagttcatgtgttagaaacttgatccccaatgtggtggtcttggagatgggacctagtgggaagtgtttgggtcatggggccactaccctcataaatgcattaatgccattctcaaaggagtgggttcattatagagcaagtagttttcttataaaagaagtttgccttcccaccctctctttgcccggcctctgggttgatgaagcaagaaggtcctcaccaaatgccagctcctcgatcttgggcttcccagccttcagtcccacgagccaataaatttctgtgcattataaattac

SEQ ID NO: 248976 - DNA, 521 bp, Homo sapiens
gccttatttaaaaatttgtattatttaatacatttaatgcattattttttattatatttaaatattgatttatttgtactttttgccttattgctatattgtttcaaaaaatttaacattatttgagttacatgatttcaaatacatactgattaacattttaattagaaactttatgtctgatatgaattgccaaaatgtgtagttggtacaacctatgagtcattctgggttatctagaagaaactggtagcctgccccatactccagaagccttccccagtgtctagacctcagaagctgtcaggaatatgcacaggagaaggacacatggcaaatagctatttcgtctcttaaatgtatggtatgtgggaaccactgaaaaatgtaaagtttctacaaggtgctatttttattatttatggctctagagaacagagaaggtgaaaaatgtgagagagaagggaaagccaatagtatgtggccttcaaaacaaaagatcccacagatattgtcccaaa

SEQ ID NO: 248977 - DNA, 650 bp, Homo sapiens
ctaaaagctataaaacttctagaaaaaaatgtaagaaactttgtgcaaccctggggtaggcagagatgtcttaggagaaaaaaagtataaattataaaagaaaaaatgttaaattggactttatgaaaatcaaaacttgtttgctcattagaagaaaccatcaaaaaaggcaaatcaatgacggagaaaatatatttgggaaaaaacttgtatctaagatatataaagaactcttacaactcaaaataaacaacctaactttttgaaaatgggcaaaagacttgaatggacatttcataaaagaagatacatgaataagcaccatgaaaagatgctcaacatcattagtcatcaaggaaacaaaagttaaaactacaatgagataccactttacgtcactgaatggcaaaaataaaaagcagtacctagtattgatgtagctatagagcaactggaactcacacattgctggcaggaatgtaaattggaaaaccatttggcagtttcttgtaaagttaaatataccatatttttaccatattagcaattccacttctacatatttacccaagggaaaggaagacatgtatccatccaagacttgcacatgaatctctatagctgctttattcataatagccccaaatgga

SEQ ID NO: 248978 - DNA, 273 bp, Homo sapiens
gagcatctgtaaccctaggcatgtgtgtccacaacctccacacgtacacaaggacactcctacagaggacaggccgtgcggacagttaggggaggacagtggaggccgcttcagttcacttcggtgctttggattcaagtgtttttctgtttcattttctgggtagctgattattaagctaaacactcctttgatggttgaaaatacattagtcccttttcttgcacgaatctaattcaccaaagcctattaaagtgcttttggaccaatgag

SEQ ID NO: 248979 - DNA, 416 bp, Homo sapiens
ttattaactgtttctacatctctgtatcattgaacttgtttaaagggcattcatcatttatttaaaaaatccaataaattgaacatattaataaatacatcaacaacaatgagaaaagagaatcttttgggcctctgttttcattgcacaatccacaaccaaacaagtgcaaataccattgtaattttttctttttctttcttttctttttttttttttttttgagacagagtctcactctgttgcccaggctggagtgcagtggcctgatctcagctcactgtaatatcctgaattcaagagattcttgtggttcagcctcccgagtatctgggattacaggcacgcgccaccatgcccggctaatttttgtatattttttagagacagggttttgctatactgtccaggctggt

SEQ ID NO: 248980 - DNA, 254 bp, Homo sapiens
ggttcagtgtttgggttgacttttgtttcagctgaactagttgacttattctggctttgtggctgcgccagtgaaatatgtacatattttgcctgtgtacggctatcttttcctgttttccttcagggattatacatcagcacagagtccatggcactgctccagataaaacagcgcggcagaatcatcaccactggcagagctctctggttgactcatgaggattgggaataaatgaccaaatataaacagtg

SEQ ID NO: 248981 - DNA, 419 bp, Homo sapiens
tgtaaaataaacagaagtttctgagagtttgctaattagactcctttgaggtttgattttgtgttttgcaatctcctgttattaaaatagttcctcatcccggctgttattaagttcctcatcccgggctgggtgcggtggctcatgcctgtaatcccagtgctttaggaggccaaggcaggcggatcacctgaggtcaggagttcaagaccagcctggccaacatggcgaaaccccatctctactaaaaatacaaaatattagctgggtgtgttggcatgtgcctgtaatcccaactactggataggctgaggcaggagaattgcttgaacccgggaggcggaggattctgtgagccaaggtcatgtcactacactccagcctgggcaacaagagcaaaactccgtctcaaaaaaaaa

SEQ ID NO: 248982 - DNA, 475 bp, Homo sapiens
tgccaaaaggctaattcttatttttaaaaagtttgaataatctatttttattgaatttacattgctcttcctaattaatgaccttgataaaagataactatggaaaggattcggctcggtgtggcctctcaaacagtgaggggcgtgtggcatgacagcaagactgctgaagtttgctctttcttggggtcctcacaggagtaggcattgaaccaaatgcagattctgttccaattcccatattcttggagctcatttaacatgagttgctggtttctgtttcaaatgaaataaatttttcaaacgttccaagatgcatttttcctatttttaatttacagctatattcaactgtggcaaacacaaaagggtcagaatgagaagaactgtggcctattttttaatatgggaagctctggccctgacagtttataaatggtaagattttagaaatagtgtcaacttaaaaacaaag

SEQ ID NO: 248983 - DNA, 430 bp, Homo sapiens
ccggacgctcattcctcacttgcttgcgggcagaggcctactgagagccaggccgtgggccacgcttccgatccggtggggagagcctcaggcgcgtctgcaggcacctgcctcctccaccaacacaacggcgtacacagactcgccctggtggggttaggcagagcgggaacccaaagccccagcgccccacccccagctcgcggaccccgctccctggggagagggcgaggctgcggcaggtgcgggccggatccttgcggggaaggctcgtcactgcaacaacccggccggagcggcggccctggggacccccgagcgggggcaccagctggtgggggagtgggagcgggggagggggaatggcggcgtctcggacagaggcgggggagggcgggaggagacgcccgctgcggtgcccccaggttta

SEQ ID NO: 248984 - DNA, 339 bp, Homo sapiens
aacctcaccattaggaagaagaaaattttcaggaactgtccaagttaagagactacttaaaatcaaacttatcaatgacaggtatctgatcatgatagataaaagctacagttctaagatatgatcaggacatgttaccgatgtacatatagaggaattattcactgcatacaaattatagggttgtggggattttgttttgtgagagttctcaaatttaccaatttcataaatgaaaacttggtaaggactgcataaaattgcataaagatgcaatttggtggacaacacgtcttcacctcaatttgttaagagaacctgggttgtaataagagccat

SEQ ID NO: 248985 - DNA, 710 bp, Homo sapiens
ggcgggcagatcacctgaggttgggagttcaaagaccagcctgacccacatgaagaaaccccgtatgtactgaaaatacaaaattagctgggtgtgatggcacatgcctgtcatcccagctactcaggaaggctgaggcaggaaaatcgcttgaacccgggaggcggaggttgccataagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatctt

SEQ ID NO: 248986 - DNA, 257 bp, Homo sapiens
atggctggctccagcctgggcagcacaggctctgcccagtgacctcgtggccccactgtttgtcagttacactgtggaggtgagcgtcacaaacgcagggtggagttttcccgcagctgtgtgacgtgaggtggtattgtaacatttatgctctaatatcaacgtaacataaatattggaatatttgttacaatatgttaacacatcatggatttattgttatttttaaatgaattaataaatacttttagatttgt

SEQ ID NO: 248987 - DNA, 794 bp, Homo sapiens
ttattactcaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaatcagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactagaaagaaaataaaaagcagagtttgtcattggactgcttaacatgctagaaggact

SEQ ID NO: 248988 - DNA, 224 bp, Homo sapiens
cattcatgttgagacaatcagtagtgatttagggtcagagtttagtgatcatgaccacagactgttttaaggatttactaacatttcaaagtcaatgtttggaaattcttaatgagtaatccactgatatatttgcatgaaacagtagtttatactatgtgtatagaacttggttttgttgcatatgtgggtttttaataggctgcaaaaagcttacttgattt

SEQ ID NO: 248989 - DNA, 437 bp, Homo sapiens
caggactctgtctctaaaaactagtaagattttgtgtgacccatgggacattgagatttccagtattctgctttgatctgtgcaaagagaaactttactggttgtaccactgtttagaaaagtagcattcttttaaggtcacatgatacttgatagacttcctagaaagtctttctgtatcaaaaagtatatatattaaatatataatatatttaatatatattatttataatttattattatattttatataatataattttatataattataataaaatatatattatattttattattataaataataaataataaaataatatatattgtaagtctttctatatcgaatgttcatggcttttaagtggtgagaatgcttgatctgcagcctacctattgactcttccattgaccccctctggtgatcgttttt

SEQ ID NO: 248990 - DNA, 272 bp, Homo sapiens
gggaggcggaggttgctgtgggctgagatcatgccactgcactctagcgtgggcaatagcaagactccatctcaaaaaaaacaaggatgatacatctatagccacaggatgaatattatacattagttaccaagaaaaaaaaacgggggtgggtggatgggtgtggtggctcacacctgtaatcccaacagtgtgggaggctgaggaaggaggactgtttgagaccaggagttcaagactagcctgaacaacataacaacacctgtctctac

SEQ ID NO: 248991 - DNA, 316 bp, Homo sapiens
agatggggtgtcactctgtcatccatgctggagtgcagtggctccatctcagctcactgaaacctctgacccccgggttcaagcgattcttctgcctcagcctccggagtagctgggattacaggtgtgagccaccgcccccggcctgtgtatgtattttgtttcaattgtgtgtgtgtgtggtggtcggggggaagtaaagaaagtcttggccaattcaagcaaaagaagaactccataaaaaactgaggctttgggttctaaagaaatttacatggggagagagtacatatggtgagccactgttgagattggg

SEQ ID NO: 248992 - DNA, 276 bp, Homo sapiens
ggctaagacatgacatgccacagccattcccctatcaagtgcaacagggaagtggggcatgaatctttgctataagagggaatgcctccctctgagttgctcccttcctagtcttagaatattcatccttccgacatgaatagataattctcaaaagaagatatacaaatggccaacaaacatataaaaaaatgctcaacatcactaatgatcagggaaatgcaaatcaaaaccacaatgtaataccaccttactcctgcaagaatggccataatc

SEQ ID NO: 248993 - DNA, 266 bp, Homo sapiens
cccctcataccgccccgcggcctcgccgcctcctcccgctttcctcctccagctcccacccggacctctagaacggccgcgcagagcggggagggggcaggggtccacaccagaggcccagactctggtccttgagtcaagatgcccaacccactcgcctaccaattacgtcccttcgtccagctccaagccgggcggtaatggggtccaggaaggctaaaggggacacgcccagccaccgagggaggggtctcacccttggagac

SEQ ID NO: 248994 - DNA, 838 bp, Homo sapiens
ttgggtggaaactgaaactctgctagtgactagatgtgtaattcagggaacattccttcactctttcagcttcagtttccttatctttaaaaggaaatgatcataatagcacttatgctgctgtgagatttaaatgagataatgtgtccacagtactcagtacagtgccggacacacagtaagcactcaaacaatggtaatgattattataatgtattttaaaatatgacactatattcaaacataccatcataatatgtcaaatgggaatgtggacagaatatatgagacaacctgttcacaactgtttaatgaggaggttttccaacattaggaatgatttgatccttcagtaaaaaatggatgtctgaaggttcctaggcataaaagaaagttcagaaggatatgtaggaaatactgttgtctctctggggattgggattacagggtttttttcctcttttctttttgttaagtttgtgtttcctaaagtttctgcaataaacatacgatgcttgtataataaaaattataggttttccttaattgcatagtcagggcttgcctccctgcgcctcctaccccaactccccaacatacagtagttctgagggatttcaccccctgctccgggagagagcgggcttagcctggattctgggagaagctcttgcttggtcccagacccaagtaaaacagcagttcctgttgtgtttggggcggcccctgccctgttctctgccctatacagaaaataggacgtgttattcctttgtttctctgacaagcttgccaacttattcctgttccgggaaaaccgggggctgtcagcactgaa

SEQ ID NO: 248995 - DNA, 428 bp, Homo sapiens
aggctgggccttaccactagcccaggccaggctcactcactagtgaagtgtcagcctcacgcacgtagctcttcatagttcaccgatggaaacaagcttgtagactggagtaacatgaatatgcatatatcatgatatgcctgtgtgtttagcctgaagaatcccacttttctctgaagctcatccagtttctcttcacaaaggagcttttttttttgttgtgttttgtttttaaatttaaaaagagtctcactttagtgagtgccactcttagtgtagtggcacggtctcagctcactgcagcctcccgcctcctgggttgaagtgattcttgtgcctcagcctcctgagtagctgggatcacaggtgtgcaccagcaggcccagctaatttttgtatttttaatggagacagggtttttgtcgtgt

SEQ ID NO: 248996 - DNA, 431 bp, Homo sapiens
gggtgtgtcccactcttgcaaatcagtagctgattcatgtgttacaaaagatgtgtcattaaccatttgtttactctgaaacttcatatagtatattagggcattctaagacctgctggtttacacgtatgactctttcagagtcctcctgctgcaccccagtcctttgtgtgacatttcatactatttttctcagcaggtagcacttacaccaagttttatttcacagggtaaacctcatttggacagtgtggacagatgacctttagatgaaaaagctcccattgatgtggttctccagtctctttggctcctctaatctcttgtacatagatggccaaagaactctccattaggactaagcaaagggcagagcttaagacttaagtaggtggcttctttgattttcttgtgactaaaaatacattaaa

SEQ ID NO: 248997 - DNA, 419 bp, Homo sapiens
cctcactcccaccaccctttctccacatgtagatgtggtcaaaaaccttaccatgggactggtaaggccaccacggccaccattagaaacctgatcccgagttgctgattaaaaccaggaggggtttttaatcagctgaggccatatgctatttaaccaaagatgaaagcacgagtgataagcatcgtctcagaaaggatgtcattaaaggaagagcagaacagcaagaggcagcttttatcattagagaagccccttgcaaagctctcgtgaggggcttcggggaacatctgggctcggtctattatgcagtacttacaacgtcattgtgtttgacaacggctcctgagcccacgccacactaaacttctaaatatacaattaatgtctattaattatagttttcaaatcagcaaaat

SEQ ID NO: 248998 - DNA, 492 bp, Homo sapiens
gatttcaagagaagaaattaacagtgagcgttaatggcttctttaacttatttgtgattctcagcatttaaaaaatgttagtcctatttttcttcctttgaagtcactattaggatgatataatttctgaatgctgcaacaaaaaatgttaaaaatggccctgacatccaagactctattgctctaagtttatgggtgggtatgcaagctaagtgttatgataatacatagtcatatacatagaggtttaatacacctatgggaaattccggcatatttgaagtagagaaaaacaaacaggcttgaaatgtccttcagttcagaatctcatactttacaagggacatttatgggcagattggtgaatatgtagaaggaggatgtttgatctggaaagaagacaaaattggattaggaataagaatatgtagaggagttaggttaagtaggactgttagtttcaaattctgcagggaagatgatttgtagaat

SEQ ID NO: 248999 - DNA, 408 bp, Homo sapiens
cttaggtgatagaggacatatagcagtgagtgtagacaattcctcccaaaaacatgagaataaagaaggtggtagtggtgttactttagaagaacaactcaggcttcagagagggtaagtttcattacagacaaggtaatctaagagtaaaagggataaaagaattctgtggggtagccagactcagaaaggtggaataacacttttacaagaagataaaacccaggaaatgtttatggcaagcttgtatgttgccactaaacctaccagaaaaagaaatcccattagaaccgcccccatcacaataactacctaagtaaatcattgttgagtaacaatgagcaccccttaaacatgtcagaaaccagaaagtttttgtttctaatgagatttcatttacacttttaa

SEQ ID NO: 249000 - DNA, 658 bp, Homo sapiens
cagctgtggtttgtcatagatggctcttgttattctgaggcatattcattcaatacccagtttattgagagtttttaacatgaaaccttgctaaattttatcataaaaaatttcctttctcattcccagaagaaatttttcatatcaaatctttttgaaacttttatatacagaatttgcttgatatttctgatataagctataactagggatatatgtatacatgcacacatatcagtatttacacactcaagctctcttttaagtggccacctttgtgagccatgcatctcccaaataatttttaaatgtcatttttggcactggatgtaaaaaccacattttaagtattttcacaatggttttatcctttcagggtggaaaacatttctttaatgaaccaaaactatttgggacaagtaggaatttagactataaagtaataaaatgtattttcttatgagacgtatattgattcttagaacagttccaaaagtggattagaacatatttgttggaacatgatggcattatttatgtaggcacataggctcatgacatgcctgctttgtggaattaaatgcaacttataatttttatttaaaatttattattcttttttttttttttgatgtggagtctcactctgtcacccagg

SEQ ID NO: 249001 - DNA, 603 bp, Homo sapiens
gcatgaataaatctccaaggcatgatgctgggtgaaagaaaccagaataaaaaaaaagtacatgttgtatgattccatttatatgaagttctaaaccaggacaatggtttcctttcaaggttgggatagggcaaaggcaacattgattagaaaagcatgcaaaagaatttttcagagtgatacaatattctacattttaataaaaacttgtgtgacacaggtgcgtacatttgtcagaattcatgaaatggtacatgtaagatttatgcatttgactgtataaaaggttttacctaaaaaagaggaaacacatacacattttaagcctctgtttccttatcagtgagtcaaataaaaagtgtcatctttgtaaagcataatgcctttatatagcattgttccaaaagtgacaataatccttcaaaacctggacattttttcaaaacaaaggatcggtatacctaatatataaaaagctcactgagagaaaccactaaacttcaaatagggaaatgagaaaaataaataaatttaaaattctaagaagaaatgtacatagccagaaaccatgaaatcatgttcgaactcattattaaaaaataa

SEQ ID NO: 249002 - DNA, 727 bp, Homo sapiens
caatggcagggagtttggtggtggttcctgtcccctgccccgcacagttccccagcttctcagtgggctgggctccttcaggcagaactctcctggcttcccttcccacaattgctaggcagccccaaccccattcttgtcagaatctgtcttctcctttaactccctgacatacttcccttctggctcccaccctttccctcctcacctttccacgtgattttaaaaggccaataaattctttcctgttccatcctggttatcttgggaggcagcttcagcagacagtgagaactttctcactgcccaggtggcttcctcctggctgacgcttgtggttttacaatgaaagagcttctctttctgtctctaccttctgttatgctcccaaatatccccatttttactctgactttacgatgagccaaaacccaggaagaggagtattttcagacccctgaaaggtagactgtatccagaagtggggacagaaaatcccggatcccaccactcatgtaaatatacccaaccatgtagtgggccttttacatactttgactcatttatttattgtgccaactcctggagggagaagatatctctttctccccattttatagctgaggaaacagggcagagaggttgtgtgacttgcctattgtaacgcagctcagaagggcagaagcagaactcagaggtgtcttcaacaaaacctgtgtgtctattt

SEQ ID NO: 249003 - DNA, 153 bp, Homo sapiens
gagtaggactaatgtagaagagtggaaaccccttcggccaccagggctattcataattcataagtgcttcaaaccagccagctgaatacatttggacaggctcttgctccttcgtgcaattcctgatttcattactctcttctgccaggaaat

SEQ ID NO: 249004 - DNA, 467 bp, Homo sapiens
tgtgacagccagtcccaaggccaggctatgagagactatgctaattagtgaagtccctggtagggccaggtcactcggccaccaggtaaaaagtaccaggttatttctgccttggcagaaggagaaggtgcatgaatattactcattaatacgcctcaaggaaccactaggttagacaacaaaataccttctgcatccactcccctattacttcctcactccccaaacatcctttcagtctgctcctccagcttgagaaaccaggagggtcttcctaccgagtggtgcctcccgagcctctggggtacagcttgtgaccctcctcaatcaaatgaatcccagggttccaggccaggtgagtatagatggacttggagcttttcttatgaaatgtcttgagctgagtttctttttcctgctacgccgaactctgtatatgtttgtttttgttctaattttggcttcag

SEQ ID NO: 249005 - DNA, 447 bp, Homo sapiens
gctgaccaatattccttatgagcatagaagcaaaaatcttgaatagaatattagcgaataaaatccagcaatatatagaattaataatatagaatcatgatcaaatggggttacggctggttcagtgtttggaaatcaatcaatgtaatctacattaaagaagattaaagaccaaagaggaaaaaccacctgatcataccaactgatgcagaaaaagcatttgacaatatacaatatccattcatgatacaagctcttggcaagctagtagaagggaagttcctcaaccacatagaggccaactatgaaaaacctacagttaacctcatacttaatggtgaaagactgaatattttccctataagatgaaaacaaggttaggatatctgctgtcactactcttatttaacataggactggcaatcctggccagtgcaataaatcaaa

SEQ ID NO: 249006 - DNA, 615 bp, Homo sapiens
ctttgtctcaaaataaataataaaatatgtaagtaataattttagagtcattgggaaatatttcaactcaagagaaaaaatataaatatcaaatcaaaaacataatgaaaaattcctaaatgtgaatttaattattttgtcttaaaataacaataatacctatttcttagtttttttctgttgaaaaatcctaaacacaatgaccaacctagtaacaatgagcattggtgtaataacactggcgtctcaataccatattccattaaaagtaaccagagttccttggatagatggttgattccaggcatgaaatatgtaaggtaagcctgctcattttttcatagcagaaaccaaagcagcttccaaaaatactaggattcagtcaaaaagactcaggagccaacttgaagaaatcccttatgaccaaaacagaaaaaaattaaatattcattgaaagaatcactgcagtgagttgaaacatgttaaatatattgccattttaatgatcatatagacaaaaccaaacaagaacctactaatggtcacatttcagagatgtttcaaacccagtgaagtattctgaaaacacatcaaagaggaaataatcattctatt

SEQ ID NO: 249007 - DNA, 93 bp, Homo sapiens
agaatgtcaacgacagagtacctgtgagcttggttagctgttcctatttatgggtcaagctcagcttccctgattgctatcagaattcccctc

SEQ ID NO: 249008 - DNA, 277 bp, Homo sapiens
ttctgctaatgcgatttcatacatttttgttgcacggtgggctgagcagcattcctggtctgttgcctcggatgggaattgttcaatgccatgtcacacatagctgtgccccgagtcatcatgctgagcggtgaaccgatcccatggccgtcgtgacagtttctggagaaagcaggcgcatgctgattcattctcagcctcctcttcccatccctgtctccagcctagcatcctttttacgtttattcatgagcttatcactcggggcaaaaaaaaa

SEQ ID NO: 249009 - DNA, 284 bp, Homo sapiens
ggaagcttcctgaaaatgcagatgcagaatggattatactgcatacatatctacattagggttgatctgggaaattataaaaagtttatttctgagctcattaaacatttcctgcaaatttaaaattgagttggttgtataggaaaacaaaacttataatgaatacatggactcttttcctgatcctccttttaatgaggtaattaaatgaagaacagacaatgtgtacatggccatgtgcctttcatatagtgtaatttaatacagatacatggccacatatg

SEQ ID NO: 249010 - DNA, 513 bp, Homo sapiens
atgacaggcatgagccatcgcgccaggccaagactgtctcaaaaaaaaaaaaaaaaaaatctaggcttccttattaatatctgaacaaataattacatatttgcttctttccaaatttggcagcaactaaacttaaaaatttttttaagtacatttgcttttgcagttagcctggcctccagagctcttggactgcagcacccataatgatggccaaagccgcccccacggcgactcctcctgctgaagcaaagtcaggcagaacaataagatgagcatggtggtgcaggcctgtaatctcagctcctcaggcgggaggatcacttgatccccggaagtttgaagctggactgcgctgaccgcacctgtgaataccactgcccgtcaatcagcctaggggaaacattctcgagtgcgagcatgacggcttaggttgatgtttttcaaattttcccaatgatgagtattgtaagggaccaaaataaaaaaatgccaatgcctaaaaccctctca

SEQ ID NO: 249011 - DNA, 352 bp, Homo sapiens
atgacaggcatgagccatcgcgccaggccaagactgtctcaaaaaaaaaaaaaaaaaaatctaggcttccttattaatatctgaacaaataattacatatttgcttctttccaaatttggcagcaactaaacttaaaaatttttttaagtacatttgcttttgcagttagcctggcctccagagctcttggactgcagcacccataatgatggccaaagccgcccccacggcgactcctcctgctgaagcaaagtcaggcagaacaataaggtatgtgttgaatatgaggatgtcttacataaaacatgttaccttgtggaatgcttgaaaataaacgagttcatctctgta

SEQ ID NO: 249012 - DNA, 416 bp, Homo sapiens
tgcttccgtctggctgtgtctccggtttctgttgctgcgcccctcatgtcctgtacccatcacccacgcaggagcccacaaaaccttgccgactgtcttcagtccaaccgtggctctctactccatctgcactgctgtctctgtgcgttcatcatctcacagccatcctttcatatgagcatggtggtgcaggcctgtaatctcagctcctcaggcgggaggatcacttgatccccggaagtttgaagctggactgcgctgaccgcacctgtgaataccactgcccgtcaatcagcctaggggaaacattctcgagtgcgagcatgacggcttaggttgatgtttttcaaattttcccaatgatgagtattgtaagggaccaaaataaaaaaatgccaatgcctaaaaccctctca

SEQ ID NO: 249013 - DNA, 484 bp, Homo sapiens
cgtcaaaatcaattatttaagggctatacatttatatttgctgtcaagaagcctgacgtcaccagagtcaaccttcaggtgcgtgttaggggctggggtgggtgtggggaggcagaatagtggcgtggttgagggcacaggttctgtaggccaactccaggcctggaatcagggccagaacctctcagtgtatccgtttccctgatatgaaaagtggaggggctaaccatccttacctcctaacgattcagttagagaaagcccggagaccattagacactggacttggcccactgtcaagcctgaatcttcaccattatcatcacagctctccatagcctagttgttctgttaaagcacacggctgcctagttcgggacaaagtcagcccctccccactaaaggctgaagtgcaccaccagtgtccaagggtgtcattttcctttggcagtttggaggctacaagaaggagaagctttgctca

SEQ ID NO: 249014 - DNA, 413 bp, Homo sapiens
tatatattttcatattttaatgaaaaataccactttaaataatttatagtagcaaacatcaaatattcacaaatcttagagaaagatactatttctcacaaaatattgagtggctaaaagagcaaatatgttcctgaaataactgaaattaagaatgtcttcatgaaagctaatttctggcgttgaatacttatttgggaatgttatttattaacagccttcagatatgaagaaattaagagacttaagcagtttactctaactaatagaagaataaagcattatttttagaagctttttgagcatacttcttactgtgcttaactttttttttgtatactaacaatgccaagcttttgatgacttgcagtttgatatttaaatatgtgaacttaatgccttttactataatt

SEQ ID NO: 249015 - DNA, 169 bp, Homo sapiens
aaaattattgggccattcataagtagcattttcaaaatatttgtaaattggctgggtgcggtggctcgcatctgtaatcccagcacgtcgggaggcagaggcaggctgatcacttgaggccaggagttcgcgaccagcctggccaatacagagaaaccccatctctacc

SEQ ID NO: 249016 - DNA, 272 bp, Homo sapiens
tgccattgcactccagcctgggtgatgagaacgaaactccgtctccaaaaaaaaaaaaacggtgggggggaggcggtattttagatttacagttggattaaatccttgaaagaactcaaaagaaggaattaatctgttaatgccttttctttaccttcataaaacatcagggaatatttcatgaatattccttatatcctactttctagctctgagcattactttgctggtagaaactagtctacatgtatataactataaatgactatcac

SEQ ID NO: 249017 - DNA, 1200 bp, Homo sapiens
gctagagttcagtggcagggcagtcatagctcattgtaacatagagctcctgggttcaagccatcctccaccgtcatcgtctccagtagctaggaaaggcatgtgccaccaagcctggctaatttttaaaagaatttttgtagaggtggggtcttgctgtgttgcccaggctggcctgaagcagttttcctgccttgacctcccaaagtattgggattacaggcataagccaccacaccaggctataagagtgcatttttaaaaaagataaaaatgtctaagccctgtttgagttgtaaggtgtcatcagatatgatgctgggtatatcagcttattcctttcttctgaaggttgtttttatgctatcttaatgaaccatcaaaggttctgaaatcaaacattttgaaaatacttgacttacggccattttatatcaagtgtatatgcttttattgtttgtgtgcttaaaactggttattttcatgaatgtactttctatggatcgctaaaggtcagaaccagctaagaatgaaaatgagtaccatttatacttactgtcagctgaacacttgcattatttttacctttatggtgtatcttacagaaattagtttttaggtcgtggtttcatacatagcagagcagctccctccctgccatctattcaaagtcagccctggacacagggtttgtccaccccctcgcgcatgcctggcgtctccgttgccatccgtctctcttacttcctccctctcaaactccctcccaacacccctgggggcctccttccctggtccacgcttgcccaccctctccgggatcccagagcaagtggcgggtatctcgtcgaaaagcgcccgtctccatccgatgcctttccaagctggcggtgctcaggggcatggtgccatgctgggggtggccgaggttgcaggggtgcccatgcttggtgtcccacctctctagttctagtctcctcccccaaccctactaggggcttgtccctggtctgggacaggcttggaaagtgtggcgcgagtatggctgaggcgtggttgtttgagggtgtgaccctgcagtccctgtcccagggataggggtggccgtgtggcccaggggtggccgaaagtggcactggggtccagccctctcccactctgtggtggagtggggcagtcactgcccttgagcccttttaa

SEQ ID NO: 249018 - DNA, 871 bp, Homo sapiens
acctgagcgccccgccaggctgtaattccgcgggcccacgtgacctccggggccgcgccttccggacgcaactccactggggcggaagttggttttgtgcggctctcaagaactaagtttgtgctgtgctgcgggatccccagggagcttccttatatcttcggcaggaccccttctttttttcttgaagattgattttgctagaagttatcctgtgatgggactccctaggggaatggaggcaccacgtggttaaggagtttgtgcgttgccgcccacatagtgtgggcagctgaggcgccgcccggatcagagccgcagggcgtctactctgtcactttcccaacctgacttttccggattgctatttcagacggcggttgcagcagccgacctgtctcaactccaccactgtagtcagagaatcaaaagcggtctgagttgcgaggtcattggggaggcccccacccccacattaccagtgaggaaactgagacttaaaaaagtgacctgacctggacacgggattgcctgacatcagagctggattcttaagttcctgttagtgttaaggcgctgctcagacttttagtaaaggtgagcgccatctactgccaagtctcacaaaatattcgcaaaatttgatacggttatcacatggtaaaaattagactttaaaagttgtatttaatgctgtgttttcagctgttgtacacttatgtaattttaattatgcaaagttatcctaataatataggaatattaattgctttcgtgaggtctgtcttgatgtgccacgatgacttttttgatgtgccaaaaaagatgactacatagtgcttttacctttttgctcaaatagaaagatttt

SEQ ID NO: 249019 - DNA, 557 bp, Homo sapiens
aagggagagtcaggtttcagtaataacaagaaagcaaagggtgaaagaagggatttgctgatgactgtgaattctatactgcgtggtggaaatttctttataattattcccaccctatcagcttgtgtcctttaaaggtacttacccatggaaaaattgttcttttaaaagttaagtttagttagttggctcccacttatttcaattttaaattttattttaaaacatgttttttgtactttggcaggaaaattaaatgtatcagaaaataataatttttaaattcttgaattataactaagttgaagtgataaatgcaaaaattattttcagaaattcctgttagtagttttctgagtaatgtactgagttgtaggtcctgtttatttctcttttcttccagtaaaaaatttcaaggaactcaattattgaaaatgttttaagagttttactgtaatcccagtactttgggaggccaaggtgggaggatttcttgaaccctggaatatgagagcagcctgggcaacatggcaagatgctgtctcaaaaaaaaaaaa

SEQ ID NO: 249020 - DNA, 476 bp, Homo sapiens
tataagcccatttttgtaggcaagaattaagtattgatgtgaagattgtttatgtttcagtgatacggtctccttcaccccaattatatggcctttttgagagagattagaaaaattgtggcttagttcaacaaagattgagttaactcgtgtgccaggttactagaattatggatccagcatctaccttcaagactcttacagtctagtgcaattaaagagaaagaaacagattatttaatacaatttaagagctaaattagagataatcacagggtttacacaggtttgaggctatagaggtggttacttatacatgatacttgggctgagttttaaacaatgaagataatagttaattgaaagaatgaggtaaaaagagcagaagcatgtatagagcacagtgtgagccaccgcgcctggccaggagagttaagtttttatgcactggctgtgattagaaggggtgtagaata

SEQ ID NO: 249021 - DNA, 167 bp, Homo sapiens
aggtatctgattgatggattactaataaggggaggaatcctaagtgaaaagattagtattacccctaaatgctatcccccccaccaaaaatagaaagaatggatgtaagtgggatctaaattctcctactctaaaagtatagttcttggaagcaagtttttaaagaa

SEQ ID NO: 249022 - DNA, 792 bp, Homo sapiens
acatgtggcaactgtccatgcatcatgttgtttaggtgagcttgctgtttctgtccctactgctgttggcccaactaggaaatatgaactaggtaaataattttcaaaaatccagacattaacttatttgcctctgtaggagtcttttttccagagctgatgataacaagacagtttcctctgcagcttctttcacctggcatctatttcacagaggagggaggtaagttttattttcaatggcactaaagattgttttcctggattgttttcacaaactgcacatgaacagtttcaaaagtatttcctgaattaggtgatgtctgcaggcagccatgaatcatgctgaaaacagtatcgttcaaaactttgccaggaagtctctggcagaagtgtgttagcgagtcttagcaaacacagctgcttcctttctgttccaatcaatcagcccagcctaattaccacagtacaagggtgaggagggaaggaaattgtaattcacagtgatgttatcagccagcaccatgcctgggagatcaccagtgcaggagaggtataaaatgctccaggggcaaggttctgagaagatgccctgccactgtatgaggccacaacctgctgtgtataacctcatctaagcacagagaagcaccagactgagcgtgggaaatgataaagcaaactgtggacttgaatgaaagacatacaggtattctttgtatttttatagttagcttctgagtctgaaattatttcccaaataaaaagttaaaaacaaatctctactgaaca

SEQ ID NO: 249023 - DNA, 381 bp, Homo sapiens
tccttcacatagcctgcacattctgtatgttttttagaacatgtaaacatcttgaccaagttttatagtttccttcacatagaccgcacattaattctaggtattttttagaacatgtaaacatcttgatcaggcttgtctaacctgtggcccatgggctgcctgttgcccaggatgactttgaatgcagcccaacacaaatttgtaaattttcttaaaacattgtgagctttttttgtgttatttttactttttttagctcatcacctatcgttagtgttaatgtactttatatgtggccaaagacatttcttccttccattgtggcccacggaagacaaaagattggacacccctgatcaagattggacacccctgatc

SEQ ID NO: 249024 - DNA, 482 bp, Homo sapiens
acaggtgtacacagctagttttttaaatttttattctgtagagatgaagtctccctatgttgcccaggctggtctcgaactcctgtccttgaacaatcctcccactcacacctcccaaagtgctgggattacaggtgtgagccactgtgccccaccccaaatacactttacgaccatatcatcaatacagagaatgagggattcagatgcaataaatatgaaaaccttgtctttcagcattcaattccaaagagcacaaactaactactctgaccaaaaatgggtgactaactcttctaactctatttttaccagctcctacaaaataagaaattgttgatagtcacaaaagtttacaatctgtttaaaaatatctagtgtatgatcacttatttaatgattttataaatcccagtcacaaaaatgaactgatccctttacttcacaagccaaaaatgccaaaccatttcatcattaaaaaa

SEQ ID NO: 249025 - DNA, 305 bp, Homo sapiens
tctgccaggaagagtctcatcttagaaccagtatagggtctgaagacatttctgcaatttatgtttatgccattctttcacttttatttaaaaaggagatttaacctgaccattctctttgaagccgatgtcccaagtatatatgtttgatgagggtacagaagacataaggaataaaactgcattgccacagagggaatacacggctccagatacaaggctttatgctaattttagcaaaatgtatgtatctttttacatacataaagttatggcactatataaagagatccttaaatgtgaca

SEQ ID NO: 249026 - DNA, 462 bp, Homo sapiens
actgattcaattttggaactcattgttggtgggttctgtatttctgtttttttcctcattcaatcttgggaggttgtacatttccagaaatttatatatttcctctaggttttctagtttgtatgcatagaagtgctcatagtagtctccgatgatattttgtatttctgtggtatcagttgtaacgtctccttttccatttctgattacacgtatttgaatcttatattttgttcttggttaatctagctagtggtctttcagctttatttatcttttcaaagaatcaatcttttatttgtcaatagacacaggaagagcatttgataaaattcaaaatctcttcataataaaaactttcagcacagtaggcatagaaaaactcaacataataaatgccatatatgacttacccacagctaacaacataccgaatagggaagagttgaaagcctttccaca

SEQ ID NO: 249027 - DNA, 730 bp, Homo sapiens
gttgcagtctatctcataagggaaccaagaactcaggggaaactgtgcagtccattgaaaaactggccctcattagatgtttgttaaatttactacagtaaagtttacatcacattattggagctgtttgccatggggaaatatctgatgctttaaatatttaactccagttgtttagtttccccattatacttaactttctttagtaacaattgcttatttccttctgtcaatttctcttctgattttaggctattagtgagatttgttaggattatttgactcattgttggggagtgagatagagttaaaaattgcatggcttactcagtttttctttgagttttgagatatgagtgagggtgaaaaatcagtttccattcagattttggaatattaataaaaattcttagaataagtttacttacttctcaggaataggatttgcttaataaaagttgcatagcaacttttgtctttatcttttggctagatgcttaccatattatgttgtaaccctttgcttgcttgttgatggtgaatatttttcttgcttaaaaaattagtttgcagaacattctgtgatacagctttcttcattataatctaaaaagtccttttttcactattgtgcctctatttctaattagacaaaatcccttcatagagtatatcttatatatctctagtctttgctttgtgctctttacaaagtttgtactctaggctg

SEQ ID NO: 249028 - DNA, 652 bp, Homo sapiens
aacaaatgagttgttacattgccatctgccaatgagaactggcttaccaattcatggctatggaaacacagactgagtgcataaccataaaggtcctaagttcctccactgataaatggggatgctaaaaagctaccttgttgggggttgcatgttattattactttaatcataatggaactaaaagatcagagagctcactctgcctaatttaatttcatagagcactaaggccccagtatcatttttaagtattataatttttagcgtttaatacttagtgtttaaatattataattttaagtagaatactcttacctaatatagaaactctcatgtgacatatacttttagaaaattcataacttggcttcaaataagattcactgacaattttatgatgaattttaattatttttatttttttagagatggggtttcaccgtgttagccaggatggtctcaatctcctgaccttgtgatctgcccacctcggcctcccaaagtgctgggattacaggcatgagccaccgcacctggccaaatctggggcttttatgggctcagaatgggggagtgtgtggtgattggtttgtgagtatgcaaaaaaggctaaaacaaaggcaccactcaaagatggaaacaacaatgt

SEQ ID NO: 249029 - DNA, 400 bp, Homo sapiens
agggatcgcctgctcccacagtggattccattgttagctgagtgtcctgccatcactcgaatgtatgaagagagcgctctcctgcgagaccgcatgactgtcaactcccttatccgaattctgcagaccattcaggacttcaccatagtcctagaaggatcactcatcaaaggagtggatgtgtaacccaactggctagaaactctcagtccaaaccttgctccttccccaactaggggaccgatttggacttgtctgacagtagtgagtcactgcaggggcagccaaacatatgccccatttggaacaatcctcactctacagacaaggcaaaatgttgtattgtagttcatttgaacctggaatttagtataaaatagagtattttcatgtgttaaat

SEQ ID NO: 249030 - DNA, 195 bp, Homo sapiens
ccatcaagtacaccaccacctcctcctccagcaggaagagctataagcactaaagtgcgtctgctagctctcggtcccacagtcctcaggcccctctctggctgcagagccctctcctcaggttgcctttcggtaggtaacagaggacaccatggtggctccgcttagccaggggcaggattgcctcctccccat

SEQ ID NO: 249031 - DNA, 160 bp, Homo sapiens
cattttctctgggtaaatatgtagatcagtgggcttcctgccttatctgagtaaagagaatccatagtgaaaagaaacacaagcttgagcttttaaaaggcccatgtgactctggccgagacaactatccacccttgagcccagggtttctcatcaggaa

SEQ ID NO: 249032 - DNA, 597 bp, Homo sapiens
cggcgcccacaggcatcatctcaggtctccttagcacactctgctcagtcccaaatctccttgaaagtgtcttttggcgaggactgcctgataaaatacaggccgcccagttacacttgaatttcagataagcggcaaataatttctgttagtataaaatatttgggacatatttacactaaaagaaatgattgtttatctgaaattcaggtgtaactgcgtagcctgtagttttacttcctaagtctggaaacccagaggcttcaccaccaccacctccatacctcccgccaccccgacctacacaattagccctaaaagagatcactgctgacccctcccccgctcccagccattcagggctcccagacaccaggctgagggccgaggccagcctgtgacaagttctcacctgtccaaggcaaaaggagataaaagaagacaacgcaaagaggttgttttgtaaagctgaaggtgttcaaaggactggtcttcattcttttttttctttcctttgtgtgtgtgtgtgtgtgtgtgtgagagagagagagagagagagagagagagtgtcctcaaaaaataaaacaatgctatcta

SEQ ID NO: 249033 - DNA, 354 bp, Homo sapiens
ttctgtctctcgctagttgtgacctgagatgacaaaccctaatcactgctctctgttatctcaacagtcaactgagtttggatacataaactaatatgaaatactttaggacatgcagaaaaaattttgaaaacagagaaagagaagcaacccaaggaaaaccaaacaagaaagcaaaataaaaaactgtcttgtgaaaaggccaaggccattattaagaagcacatgccagccgtcacccaggcctccttgcaagtttactgccttttattctacataaaatatgtaatggtttataactatttatggaaataatgcatgctaattttaacttatccatacaataaagtttga

SEQ ID NO: 249034 - DNA, 613 bp, Homo sapiens
caaagttttatgtttagtatttttgggagcaaggaaagactaataaactctaaacgaaatatatacagtatacaaacactgctgtcacttttacaccatagagggaggggcaaagcgtagaggaataggttagtttctggccttgccagtgtcctaaacttttctaaaagattcaggttctaaaaggttgagaaagcatttttagtaaatatcatagaagtgattttctttttctttttctttttttttttcctcaaaattgttcctctcaggagaaaatcagtaggggaagaacttacttggatttttcatatgctataacagattattttgttgtcttctttcttgatagtttatgattgatggctgaaagattaacactcatgagaagtcttgtaactcagctctgttttacttatgaggcagttgaagcatagagcagatacttagatgaggacacacttttacccttggctgtaccctacttgtttactaataagcatcaggtattattctaaacagtacctgaattttaaatagattacgaactacaactttctgatataactttattgcatttctgataccttttattttcttaaaatgtcttctt

SEQ ID NO: 249035 - DNA, 299 bp, Homo sapiens
ttcctatgccaactataaatttaaattggtagctaaggaaggaaatttttggtaacactctttccccactactatcttcactgaaataattcatgagttaaaatatgttgttatagacaactaagaattatattactttttgagatggtgatttaggttaagacattaggaagcaaacagatctatttatttaatagccttacataattttaaatttcttgtagccaacaaagttgttaaaattatgacatctaagtatataattagacaggctacataatctctgtgactcagtctcc

SEQ ID NO: 249036 - DNA, 499 bp, Homo sapiens
actgcagagagaacatggtcctgctaacaccttgatttcaacttatataccccagaactgtgggggatatagatttctcttgttgttaaccacccagtttgcggcactttgttacagtagtgtgaaaaaagtaatataacatgcaattgaaataattatggatgctacataaagcaagagatttggataaagaaatggcagtggcaaggagggcaaatggatttctgctgtatttagaatgccacggtaaaaactttgtatttattaggtatggagaatgagagggaagtgaaggctgatccccagtttctggcttggacaactgtgaagatagtgccttttgctgagatggagaatattagaagaggagaaatttgagggaagggaaatgccaattttaattcagccttctcttatgtttgaaatacatgtgagaaaagtaaaacaacacaccagtagtgctgtaatgaaaataaaggccatagactcaaaatgtaat

SEQ ID NO: 249037 - DNA, 419 bp, Homo sapiens
  misc_feature (48)..(48): n is a, c, g, or t
  misc_feature (178)..(178): n is a, c, g, or t
  misc_feature (180)..(181): n is a, c, g, or t
ttttgagtcggagtttcgctcttgttgcccaggttggagtgcaatggncgcgatctcggcttactgcaacctccgcctccagggttcaagtgattctcctgcctcagcctcctgagtagctgaggcaggagaatcgcttgaacacaggaggcaaaggttgcagtgagctgagatcacngnnccactgcattccagcctgggtgacagagggagactccatctcaaaataaaataaaataaaataaaaaataaataaaccaagtaggtaaaagcaaaaaaacaaacaaaaaagttacattgtattgttttctggcccccattatttctgttgacaagtcagatgtcagtctaattgttcctttgaagattatgtgtcttttttcctctggttactttcaacagttttatttttactatga

SEQ ID NO: 249038 - DNA, 407 bp, Homo sapiens
tagaaaagcttttctgagatcctcaatttccacaaatattctttactaaaatgaatctgcctgagaatgtcccttggcctcttttcccacctccccttttccaatcatgcttcatccacttgttaaaagaatggaatacttttcaaccatctggaatcttacttggggtagtttaatgccctagaggcttttacacatcccttttacacatctagagcattaaactaatcatatttcaaaatgttggtgctaggattaaagagagtaaatggctattaatgactggattataaattcgtttgcaggttaggtgatttccaattctgtgctgttaacaaaattgaaggaagacctaataaaattgtcagcttaaacttaataaaattaaattttgatgataaattatc

SEQ ID NO: 249039 - DNA, 776 bp, Homo sapiens
aaggcatagagtttaaatgccttgaccaaacgtcactagctggtaaatgaagtcaggtgtcaaaccaggcctgtctccaaagcctatatgccatcaccatttacatttttgaagacattttaactttagtatgtattttaaaagaaacattttctggatagccaaaatattatcataattcacaaaaattaatcataatttttaaatataccctgtccatatttcacaaaccaccttccaaatatcatttacatctggtctatacaaaccaggatcctgtccaagccacactacttacctctccaatgtagaagagtctctttttttttctcaatgacactgatctgttctgtaaagtgtttcaccttctgaatttgtctaattgtttcgttgtggcaactgtttattcttctatatgtttccaataaactgaaagttacatctaaagtcttgataggtttggccggcagtggtggctcactcctgtaatcccagcactttgggaggcccaggcgggcggatcacgaggtcaggagatcgagaccatcccggctaacacggtgaaaccccgtctctactaaaaattcactggccgttgtttacaacgtcgagactgggaccctgcgttaccaacttaatcggtctgagcacatcccctttcgcaggtgccgaattgcaaagaggccggccggtcgccctaccacagttgccacctgaatgcaattggaaatggagcgtaattttggtaaattccgttaaattttgtcctcattttc

SEQ ID NO: 249040 - DNA, 246 bp, Homo sapiens
aatattagaaaatttctattgattttcttgggtagggtggtgacatgtggctggctataagggaagatgtctttatttttaggagattcacattgaagtcattataggggtcaagtgacatgatatctacagctaacttttatttcacttatttattattattattattttagagactccatctcaaataaataaattaattaacatttcagcaaaatacacacatgcacacagacaaagaaaata

SEQ ID NO: 249041 - DNA, 504 bp, Homo sapiens
gattttttgctgtctctttttcatcaccctatttttcatcagactgctgagctacatgttttttcatgtaagattcataaatccagatctcctcgtcaatgtactgcccaaggtactgggcaggagcaccttgtggaagctcagatgcttcttctttccatctctcacacttgagacagaggacatgttaccccactgattccctaagaaatatccttgagcaatagaagggaagtgggatccgagcctgtagaagggaggcatgaaacttgtggaggaaagagatttgcttcagttttttcctcaccgtttgcctgcttgactaccttctgtcaccacgtcatctttccaggattaaccttgaccagtaaaaagctctgtaatagatttatgtggctctgtggatcggctgaatagtacttgatagtaaacaaatttgaccatttggggaattatatagatgctaagaaaagttaattgataaattattctagtgaatctcaa

SEQ ID NO: 249042 - DNA, 707 bp, Homo sapiens
gtttaaccagacatctgcacatctcatggtcaagctgacacataaaattaaccatcattatcaaaaacagaaaaaaacagacattatgggctttctgttgagagaacacgtcactatctatattttgaaaaaaacaaaaaactctgaatctgaacaagtctctagattcaattactaattttcatgaaatgcagagaaacttattaacctataccatgagggatcaatcagtaaaactgagacttaagtcacctaaacatcaaataacctaagatcatccaaaataaattgcaagtgtaaggatggggagttagagggggatactttaaagagattgtgaaacatataaaacagggagaaccaatctgtattatttagagattcaccctaaatgataaaactatagagaaatacaaaagagtgattactataaaaattaaagataatggttactttgagaggggaggaagaaggctgtgatggggtatatgaagggcttttgagctagttagcgatgttctatttcttgactttggcggtagctatagggctgtttgccttaaaataatccaataatctactcaactgtagctttgtttcatgtgcttttctgtatatgtgttttattttataataaagaagtgttaagtcactattaagaaagtgatttgaggctgggtgcgatggcttaagcctataatcccagc

SEQ ID NO: 249043 - DNA, 410 bp, Homo sapiens
agttaacttgcctatctggaaaaaaaccaagtatcttctttggaagcgtacattacagaggtctcaggaccatctagtacatgtttgtgaactttggtcaaatttccccctccttttcaaatttctggagtgcaaaacactctactttaaatgttatgcacaaagtaggttcaggcaaatcaatagttaattccaaagctgtgaaggttaatgattaacagctggattcagggaaggttctggaaagctctaaggcatcggtggagactgtagtgagctgtaaagaagacagctattctgctgctgctgctaactgtttaaacccagattgttgccagatctaccagttgtccaatacacatgaaaatctagatttttttcctgccaatctcccaatttttaaaagctag

SEQ ID NO: 249044 - DNA, 501 bp, Homo sapiens
tactactcagtctttaaaaagaaggaaattgtcattttcaacaacatggatagagaacattatgctaactaaaataagccaggcacagaaacacaaataaagcatgctctcgtgtggaatctagaacaattccaatctagaacaatcgacagagtgtggttacagaggcagaagtgagggcataatggggagatggtggtcaaagggtataaaatcttaagacaggaggaatatggtttggggctttttcttttttagatctcttgcacagcatgatgaatatagttaataaaacagcattgtacatttcaaaattgccaagtgttaatttcaagtgttctcaccacaaaaattttgagtatttgaggtgatgaatatgctaactagcttgatttaatccacttcatattgttaaagcataacatcactttgtacaccataagtatatacaattataaattgccaatttacaattttaaaaaataaggaaaagaaagaaaa

SEQ ID NO: 249045 - DNA, 571 bp, Homo sapiens
ccaaggaggacatgtgcagcctagctctccaggtgagagcttggagttcagagacttcctgtggatttggaggggagccagagggaagggctcaagttctacccagcttcaagcgttttctccttaccctgagcagcagagatgagctcttatgctttctgggccgtcccatcactggctgtcctttgtatccaagtgggaggctgcctctgagagttggatgtgcctgttaggaagcccacatagaactcattccagggtcccaagatgagttgcacaacttgtcgagattcgaatctcgacaagtggtgcatctcatcaactaccaggacgatgccgagctggccactcgcgccctgcccgagctcaccaaactgctcaacgacgaggacccggtggtggtgaccaaggcggccatgatggtgaaccagctgtcgaagaaggaggcgtcgcggcgggccctgatgggctcgccccagctggtggccgctgtcgtgcgtaccatgcagaataccagggacctggaacacagcccgttgcaccaccagcatcctgcacaacgggtaccgag

SEQ ID NO: 249046 - DNA, 456 bp, Homo sapiens
agcacatgtgcctaaaataacagaaaaatacagtgcctgcatgttgggagcaagccccccaaagtctggccccaaaactggccataaataaaatctctgcagcaatgtaacatgtccataatggccataaagcccaagctggaaggttgtgggtttacaggaatgacggtaaggaacacctggcccgctcagggcggaaaactggttaaaggcatttttaagccataaacaattagcctgagcgatctgtgccttaagggcgtgttcctgctgcaattaattcagcccatcccttcgtttcccttaagggatactttcagttaatttaatatccatagaaacaatgctaatgactggtttgctgttaataaatatgtgggtaaatctctgttcggggctctcagctctgaaggctgtgagacccctgatatcccactttacacctctgtatttctg

SEQ ID NO: 249047 - DNA, 381 bp, Homo sapiens
taagaaggaaaagagaagaaagatcggtcaacagagcactataaattcaagccagaagagaccctaccctctctcttcattctttgttggtttcgtttggccagctgtcagatggattttcccctgctggctgtgagatgctttaggagctgagtactgagaacttactcttaaatgtaataggaaaaacctgtatgcaaaagtgcagggattcttcctccttttatttgattcatagacccttcctatatctgtgctggggtatcagaagattattatttaattccttgtgctggaaagaggaagataatgtcccaagattgagatggggaggtaattaagaagcattcaagtatattgaaaccctacccaatcagcaaa

SEQ ID NO: 249048 - DNA, 409 bp, Homo sapiens
attaagtgcaaaagatttccttgcaagatacatagactcttgcatccgatttacttgcaggttgtttttgttctaatattgtcattccctgtacacatcctttactgatgactgggaattggagaggaggcccttaaatgtcaggagagtaagtcagccttagcttaaaaatcaagcagaaaagtctcatgttcattggcacacttgtaactacattccagtctcccagtctgcattatttctagaagctctgcatatctaactgcctaccacatgacaaaagtcattgtcattgatcctgcttcaccaaataaaaagtaaaaatattgagggccacctctcaccagttcacccagggagactggtaagcaaggagtgcccggtccctagtgagatttatgttgaacat

SEQ ID NO: 249049 - DNA, 721 bp, Homo sapiens
tcttaggagtgatcatggttctagttatataggagaatatccttatttaggaaatgcattctattatagtgcttaaggttgaagcatcatgatgtttgcaacgtattttcaagtgttcactaaaaaagcagatgcagcccttctgactaaatgggaaaaactgctgaacgtaggcactgtatagacaggtatgccatcaactaccaattccgcatttttatcggtttaggtttttttaacgaaggttggaaaaaagctgggaacagcagacaccaagccagaacagtctgtgtgggttcgtgttgctttgttatcagctgctcttcaccatggaggcttacgtggtcacagccctggtgctgtgttcagccaggcctggcacccactgagcacacaaacagtcactcaccactgaattgtgacgtaggattaagaagctaccactctggtcatctaacccctccatcagcaccgacggactgaatcgggggttctcaaactgaggcaataaccaggaaatgatgatgattaacatctgggatttggagtgaagtgactatcggttatgtaagtaatcttttcaaaaagcaagaagccatcttttctatcacaattcaaccggttaagatacagtttaactctgcgattccatgaagcctgtaagtctttattctggtttgtctcaccagataacagctcccactaatgacaaccagtttaa

SEQ ID NO: 249050 - DNA, 510 bp, Homo sapiens
gatctaggctctgctaagagtcagctgtgggactagctattccgaaaagtgattgtactcttagtggaggaacagtgtggaggaggagggagaaaatagttctcttggcctcggcttgcaaggctccacctggggcattgcttctatttgaggagccttcctacaagagggacatagacaaactacatggaggaaggacaaaccacggggatggtggtaacgccacatttagatcctgcgaggaatggctgaaggaaccgggagtatttaatgtgaagttcaaggaggtgggagggggttagaaagactgccttgaaatatttgacaggcggccgggcgcagtggcttatgcctataatcccagtactctgggaggctgaggcaggcagaccacaaggtcaggagatcgagaccatcctggccaacatggtgaaacgctgtctctactaaaaatactgagacaggagaatcacttgaacccaggaggcagaggttgcagagagccgagat

SEQ ID NO: 249051 - DNA, 810 bp, Homo sapiens
gatcatgttgcagtgactctagccaagggtatggcctgtgtcgtgtctgttacaggccgaggtgggaagaaaaggttgtccctgtatctggaggggccagttcatgccttgaggaggagagaggcactctgggtcctgccattgtcctcagggatggccatgcttgccattgtcccacgtgtctgttcgggggggtccttctcctggggatacaacgtctgccgcgttgatttttgggtgtctaagtgtaccgggctagtatcacattgagagtcacccactgtgggtggattcacccattcccgtcatggtgcctggggctccagcagcctcgtcacaacacagcctggtagttggagggtctgagcctttgttacaaccgccctgacttagccgcaggactatgcacctggtggggactggggtgggcggccactctctcacaggcccaccccaaggctctagatgggcacgtgcattgttcaaatgccgtcataccttgggggtgcgagggggcagcgtgaggcagacgagagaggcggaggtctcacagtgaaccacaggatctggtatcctgcagccggggtgcaggcctgactgtggagcccccattctgggcgcctcacactccctatgactgtgatgcttgccccccgccccccgatgccacaggagtgcacagcaggcctggagtctccttcggagggggtgaggaggccggcggggggcgggggggtgctgtctgtgggccctggcacttccacgctgcctgggtggagggtccctgggtgaggtctgccttggctgaaa

SEQ ID NO: 249052 - DNA, 954 bp, Homo sapiens
  misc_feature (372)..(372): n is a, c, g, or t
ggcacgaggcaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggncagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaaaagaaaa

SEQ ID NO: 249053 - DNA, 1375 bp, Homo sapiens
  misc_feature (372)..(372): n is a, c, g, or t
ggcacgaggcaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggncagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaaaagaaaaaaaaaaccggggggctttttggggggggggagaaaaaggggttggaaggggcgggggtagggttttcccttagacccaggtcttgttgttggtccagacggggggtaaaatttcggggggcccccataatggggcggcgggaataaattcccggaaaagccggggtaccctcggtagagtacgcgccgcagacgacgggagtaggagggagcagcgaacggacgacgggcccagggccgcacgcacgcgcgcacaccgcggtcagaccacggacaactatcgcatctcagacgagaccacagcacaagagccctacgattaagcgccgacacaccacgcacctacttcacgagtaagcacgagagacagcagacagcgaggaccagaacagaaagagaccgcacccacggtagcagcagtg

SEQ ID NO: 249054 - DNA, 282 bp, Homo sapiens
ctgcaatgcctggagcagtccctcttaactagcaattgtcctgccacaaaatgttggtagtgatgttattgataaacagataaagcaatacctttgatgccatttctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcg

SEQ ID NO: 249055 - DNA, 468 bp, Homo sapiens
agccccacaatatacaaatcgtgacctctaatagtcattgaaatacatgcatttgttttggtctttatttttaatctttaaccagaagtttaaaaatgatactataaacatgaaatctaggcagaaataaagaaagatgttctttgaaaccaataagaacaaagatacaacataccagaatctttgggacacattcaaagcagtgtgtagagggaaatttatagtactaaatgcccacaagagaaagcaggaaagatccaaaattgacaccctaacatcacaatgaaaagaactagaagagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagactgctagcaagactaataaa

SEQ ID NO: 249056 - DNA, 2264 bp, Homo sapiens
gggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagcttgtgtttacatgaaatatgtttattatcaagaagtcctttttccaattctgtacattaaatatatgtgttttaaa

SEQ ID NO: 249057 - DNA, 1284 bp, Homo sapiens
gggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtccatcctccttatacattaagattacggacctactctcccgggaatccttagaa

SEQ ID NO: 249058 - DNA, 2502 bp, Homo sapiens
ctcgccgagatgacctgggcacctctgcgttgaatcggcaaatactgatcaagccgcatttattctgctctcaggaactctaagtctagcagagaagatgaggcggtagaagttcatcaatggcttggctggaggacaagcaaattgaggacattggcaacggagtgatcaaaatgatagatcatgaggcctaaaatgaataaggaaagaagagaagtggcagaggctgagaacagaaagagagggtggaggggctgtaaatcttgaagattagggtataatatgagtatatgggtaagaattggaagaattgtgtaggaggcagtagtcaaaaagtagaagcagtttggaagagtagttacaaatatcaagagccaggtggctaaaaggtggagctataggtcattgaagctcaagaaactgagtctctagggcattggttaagtcatctgtctagacttcaaagttgtctaggatgataattcagaagactgatctgtgccaaagtcacaggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagcttgtgtttacatgaaatatgtttattatcaagaagtcctttttccaattctgtacattaaatatatgtgttttaaa

SEQ ID NO: 249059 - DNA, 2658 bp, Homo sapiens
gggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccgatggcttggctggaggacaagcaaattgaggacattggcaacggagtgatcaaaatgatagatcatgaggcctaaaatgaataaggaaagaagagaagtggcagaggctgagaacagaaagagagggtggaggggctgtaaatcttgaagattagggtataatatgagtatatgggtaagaattggaagaattgtgtaggaggcagtagtcaaaaagtagaagcagtttggaagagtagttacaaatatcaagagccaggtggctaaaaggtggagctataggtcattgaagctcaagaaactgagtctctagggcattggttaagtcatctgtctagacttcaaagttgtctaggatgataattcagaagactgatctgtgccaaagtcacaggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagcttgtgtttacatgaaatatgtttattatcaagaagtcctttttccaattctgtacattaaatatatgtgttttaaa

SEQ ID NO: 249060 - DNA, 364 bp, Homo sapiens
tggtgaccttatcaggtgctgtttcagtggaatcttgaattcaggagccactcaagaatgaatgagaactgatggagtaaacacagcatgcgtagataagtcaagaaccttggctgttaaaaaggagtaagaaatatggaatgatccaatagagagggaaagaaggtgatgcaggggcagaggccacatggacaagcgcagacagcacgtggcaaaggcctctatgccattacccatggaagaaaactgaagaggtttaagcagagaactatttgattggactgtttcattaggtaaattattctgtcattgtgggagatgaatttggggtctttaatgagtgtctgaaagcacaaaactcagt

SEQ ID NO: 249061 - DNA, 589 bp, Homo sapiens
gctagaagtcatctgagaacatgataaaatttcacattattctcttatttttttaatttagtttcaaattaaaaccaaatttgtgttcatccttagtttagatgtgtaattaaagcaataactataggcttcaaacaacagttgcaagaaaaccccaaaaataaaaggacacatgtgtacacttgtgcttggagatggtaagcactcagccagtgacttacattttatcatgttgacatggcagaggtcagtagttacacaatgttataacacattaaagataagcctatctttactctgaatttcatcatcacaaagttgtaagtctgactaaaagagccaaggtaacattgaaagatatttttcagcatttccaaagatcattaagtcataaccttgattctagaatatgcttgttattggcaatgacatcttttagaatatttgctttagaaagctatttttgtttactaagattttgaaacacatttgctataggaggtgcagttgcctactaacctgagagataattaatttttgataaccttactgatctagttacactcacagtaaacatttttttggtaaa

SEQ ID NO: 249062 - DNA, 455 bp, Homo sapiens
ctttttttttcaagacagagtcttgctctgtcgcccaggctggagtgcggtggcatgatctcggctcactgcaacctctgcctcccacgttcaagcgattctcctgcctcagcctcccaagtagctgggattacaggcacgtgccgccatgctcagctaatttttctatttttagtagagacggggtttcaccatgttggccagggtggtctcgaactcgacctcgtgatcttcccgcctctgcctcccaaagtgctgggattacaggcgtgagccaccgtgcctggctcgaactttaatattttctattctatttcatttaaaaattgtagcccactattgatttcatgactaaccaatggatcatcactggaaacatcagtgtactgtgtagtgttttgccatagtgaatgctcaataaaggtgttaaatgatgtctttcatttagaaaagcg

SEQ ID NO: 249063 - DNA, 189 bp, Homo sapiens
caggctgtaggctgagcttcacacacatgggataacacgtgtgtatgattacatgataagtgggattttcctgctctatgtgcagagcgtaatacaatctagcagttcattgtgctatggggcttttgtcattttgcagtgtgcgtcgagcggccgcgaatttagtagtagtagtatagtagtagtagg

SEQ ID NO: 249064 - DNA, 491 bp, Homo sapiens
atgaacccggtacctcagatggaaatgcagaaatcacccgtcttctgcgttgctcacgctgggagctgtagaccggagctgttcctatacggccatcttggctcttcccccaatcatgataaaaataattaatgagattttatacattcaatctttgttccaagcctttgaaatatggtatgtgtgctgggattacaggcatgagtcaccacacctggcctacatgattaattttttaaaattgtggtaaaatatagccaacgagatttgtcatttaaccatctttacgtgcacaattccgcattcacaatgtcatgtagccatctccctgtctactttcagaattttttcatcatccgaaacagaagctctgtacccattaaacaatgtctccctgtttcttcctctctccagcccctacaaaacttgtgttccactggaaagcttaatttgtattacttaagaaatctccagcagctttagagcctcca

SEQ ID NO: 249065 - DNA, 459 bp, Homo sapiens
taacacgtgtaaatcagattttgcaatcccgttctgtagacaaccaaactgagattgatgcatttccagtctttcacttctgtaaagaacacagcagggaaccaccttgtacatacatcttttaggcatttgtccaattatttccttaggataaatttctagaaacgggtttggtgttttagagcttttgatatatatggttccagaacaatctggatgcctgaaatcatggcagataaacaggtgctgagtttcgtggccatgctgaaagtgcagacgtagaagtgaaatgcacagtgaacagtcatgcctggatgggcacacatgccgaatttttgtttggatttctttataccggtggttgtctccaccggtggcagtaagactctgctggatgaggacctaagactgatggggtgtttgtctataatgacaagtgcttgactgtagcagcaaatg

SEQ ID NO: 249066 - DNA, 435 bp, Homo sapiens
gataaacaggaaactagtggaaaagattacctatagaaagtaggtggcaacagagtgaaaggtttgggataggagtgagactctgtatctttttgttcagtattgacttttgaaccaattaaatgttttaagtagtcaagaaattaaaatctaatcaacaaagatgaaaatcagcagacttaaaaatttaaaacaaacaaaaatgaactcaccgtatattaaaataataaactaaagaacaaatagattagattaacttttaaacataatgctatgactagacatcctctgtggaacattctttaagacaactggcctgaacttttcaaaaatatcactgtcatgaaagacaaaatgatggggggattgccctagattaaaagagactaatgagaccaaatgtaatgagtgatccttgattggctcccagattga

SEQ ID NO: 249067 - DNA, 296 bp, Homo sapiens
catttatgtctataatctcattctgagtcaatttttcattctagtgtgagttatgtgtccaaatttattcttttgcacacggatatctagttgtcttagcgccattcattgaaaagaatacttttgtcctaatgaagaatcttggcacatttgttgaaaatcaattggctatacatgtgagggtttatttttggattctcaatcctatcccattgatctataaatctttctttgtacgccactacacccaatcatctttgctgtaaattttgatgttgagaagtgttattccttca

SEQ ID NO: 249068 - DNA, 1005 bp, Homo sapiens
ctcaatagagacaatcaacaaagtcaaaagctgattatttgaaaagattaataaaatcaataaacctctaaccaggctaactaagcaaaaagagaaagaacataaattgctaatatcagaaatgaaagagtggacatcactacagatcccatggacattaggaggataataaaggaatgctctgaacaactgtatgctcacatatttgataacctagatgaaatggagcaagtccttgaaagacacaatctgccaaaactcacacaagaagaaatagaccatctgaataggcctatatctattttaaaatttgaatcaataattaataacttttccaaacagaaagcactaggcccagatgtatttgctggtgaattctaccaaacatataaggaagacattataccaattatctataatctcttttggaggatagaagcagaaggaatacttcctgactcattttgtgaggccagcattactctaataccaaaaccagacaaagacattgcaagaaaagaaaatcgcagatcaatatctttcatgaacatagatgcaaaaatcctcaacagaatactagcaaatccaatccaataaagtgttaaaaaattatacaccatgaccaagtggaatttatcccagatatgccaggctggttcagcatttaaaaatcaattaatgcaattcatcacaacaactgactaaaaaagaaaaatcatttcaatatatgcagaaaaggcatttgacaaaatcccacaccaatttatgatttaaaaaaaaactcccagtaaactagaaataaagggcaacatcctcaaccgtataaagaatatctacaaaaaagctatagctaacatcacgcttaatgaagagaaactagaagttttcccgtaagatcagggacaaggcaaggatgttctttctcatcactctgtttcagcatcatactggaagttctagttaatgcaataaggcaagacaaggaaataaaagatatatagattg

SEQ ID NO: 249069 - DNA, 1235 bp, Homo sapiens
ccttacttacagaggaacaaagataagaattatatctgacttcttctcagaaaccatgcaagcaagaaaagagaggaatgaaacatttaaagtgttgagagaaaaaaacccaaccaacctagaattctgtaccccacaaaaattaacgttcagaagcgaaggagaaaggaagattttcttgggcaaacaaaaatgtggaaagtttgttgccagtaggccttgcaagaaatgttaaaagaagttctttagagataaagaaagtaatataggtcagaaagttgggtctacataaagaaaggaagaacactgaagaaggaatgagtgaaggtaaaattaaaacttttatttttcttattcttgattgatctagtggataacagtttattcaaaataataatatcaatagtaatgtacttgatcacatatacttaggtatattacacacacacacacacacagacgcttatatataagtgagatgaatgacagcaatggtacaagggatgaaaaagaggaaaaattagtatcattttgtaattataaggtactcatactacctgtgaagtggcattgtgatatttgaaagtggacttggattcattgtaaatgttaattgcaaactctaaggcaaccactaaaataagttaaaaaagaaatatagctgatatgctaagacaggagagaaaatgtaatcagataaaatgctcaattaaaaccaaaaagaaatgctggaagtggatgaaaaagtggaagataacaatagcaacaaagaacaaaggcaccaaacaaaaatcctcaacagaatactagcaaatccaatccaataaagtgttaaaaaattatacaccatgaccaagtggaatttatcccagatatgccaggctggttcagcatttaaaaatcaattaatgcaattcatcacaacaactgactaaaaaagaaaaatcatttcaatatatgcagaaaaggcatttgacaaaatcccacaccaatttatgatttaaaaaaaaactcccagtaaactagaaataaagggcaacatcctcaaccgtataaagaatatctacaaaaaagctatagctaacatcacgcttaatgaagagaaactagaagttttcccgtaagatcagggacaaggcaaggatgttctttctcatcactctgtttcagcatcatactggaagttctagttaatgcaataaggcaagacaaggaaataaaagatatatagattg

SEQ ID NO: 249070 - DNA, 166 bp, Homo sapiens
tgcaacaattctggaacaaaactttaccctgtttccaaatttaagctaaattcgttgtattatgcaaatgtagggacgtaacttgtaaaactccaagtatagggccaaaggcaaactttgcagtaaaactggctttgaattaaaaaaaggaagaaggaaggaagga

SEQ ID NO: 249071 - DNA, 151 bp, Homo sapiens
ggaggctcacaggtgtggcattgcacctccagagattaaccaccatccaaggacttgcagcattttctggcttcactgatgaatggtttgtagggaaacctggcaagagaaattagtttggaaacttggagtcaggaaataaatggtggat

SEQ ID NO: 249072 - DNA, 411 bp, Homo sapiens
tagctataggaagtgatcatatttttaagaactccaaggttcttaaaaaccaaacaagtttttccccttttcatgtgagggctggttctctattagagttggtcagaaaggctgggcgcggtggtggctcacgcctgtaatcccagcactttgggaggctgaggtgggtggatcacgacgtcaggagataaagaccatcctggctaacacagtgaaaccccgtctctactaaaaataaaaaaaaattagctgggtgtggtggcacgcacctgtagtcccagctactcgggaggcactgaggcagaattgcttgaacctgggaggcggaggttgcagtgagccgagatcacgccactgcactcctgcctgggtgacagagtgaaactctgtctcaaaaaaaaaaaaaatgtc

SEQ ID NO: 249073 - DNA, 328 bp, Homo sapiens
ctctggagagagtgggctgattcagggaatggggtgagctccattttggatatgttgggttagagaacttggagggcatctaagtggatatgcctagtagcagctgcccatggggaaggcaggggagcccacaggctgcagagatccagaagggcacagctagatggaaattgagatcaaggagtaactactttcacctgaaaagagaccaggggtcaggccctcagcataaagacactggggaaaaaaaggaagagtgggactcaggccgcctgcatcagaatttcctgggggatttgtgaaaaacaaagttctcctgttgaactga

SEQ ID NO: 249074 - DNA, 442 bp, Homo sapiens
gcaaagtttagggagtgtggtccaggaaactgttaaatgcttccgatcaagagagtgatatgataaaaatggcataactgggagatgaatctagtactgaactcccacatcgattagagtgagttggattggaggcaagaacttgggtgctattttatgtatttatttctaaaatctataattctatataattaggtagacctgtatgtacttttagcacttttcatgttttctaagtttgaattgttgactaaaaaagtgaagatttgatgtgcagctagatttgtcaaatagccttccaaagtggttttggcaataatataataatgtaaatagttgagaatgcagttgtaatcaattttcatttagctgatacgcataggaaatcctggtgtggaaaatgtacaacagtgtatcactttttgtatttggctttgaagcc

SEQ ID NO: 249075 - DNA, 477 bp, Homo sapiens
gattttgagtggtttcttttaattttcatgccttgatagcgtttgctgtcaaaagttaaagcaaggatctggactcattctcatacttgaatatattttctgacctttcaaactatagttccagaacttcagacattgatgcaaatacaaaggaaatttccatgtttcaaattcatttcactgcacaattgaaattttgctttaatttagattggaagttattaatctgcaatataataacatgtttataagtaaataagtattaggagaataatctactggaattctataaatgtctttcaagcaatgaatatgctcaacacatactcgtggattaatattttcaaagatgaaatatttaaaatttcattacagatcatcatcatcagataaagatttatggtcagttttgaaaatagggaacattccaaaccccaattaaacaaagtgtaatctccctgcaaaacagttgtatta

SEQ ID NO: 249076 - DNA, 341 bp, Homo sapiens
attttaatctcactgcttattattgatctgttcagggtatctaattctttctgagttaagataggagacttgtatctttccaggaatttatccatctcctctaggttttctagtttatgcatgtaaaaatattcatagtagccttcaatgatcttttgtatttctgtggtgtcagttgtaatatctcccgtttcatttataattgagcttatttgaattttctctcttcttttcttggtgaatcatgctaatggttcatcaattttatttatcttttcaaagaaccagctttttatttcatttatcttttgtattttctttttgttgcaatttcatttagt

SEQ ID NO: 249077 - DNA, 328 bp, Homo sapiens
ttggggcaaaacaattttaaatggaggcacctgcatgacatcagtgctcttcacccagtcacacctcaaggctctgttccctgcattccagtgcaatgctccttagctgccctaggttttactccagcaggcccaggtgaagcatatgttgtgatggtgacccttctataggacacaggtaagaaaccatggcagcatccatgtggtgccatttctgctggcttgcagtatgcacaagtctttggggcatggctgtctccaccaagatagaatctgaaggatggagccatccagatcctgtgtatgagacccagacacagaattgtta

SEQ ID NO: 249078 - DNA, 486 bp, Homo sapiens
tttgtgccatgcaccccctttagcagtctggtgaagcctatggaccccttttcaagttttttaagtgtataaaataaaatgtttgattacaaaggaaattgatttgattgaaatacagtttatcaaaatattaaaaacaaatgctatagagtaatatgttctttattaatacactgaatattaagacctagcagagcagttagtctgattctaattttgcagtggtcatgaacataaaaggtattttgagatctgcaacaactataatgtgatacatgaaaatatctgtgatttgtgttagtgacagtcacaggcactgctgatactgctatattttgtttcctatgttcaaaacggaataacatatttgaacatacttcctttgttcaaataccaaatgtcaatttggaggttgatgaaaataatatgtggttttcttctcattcaagttcactgaattttctgaattcaagttcactgaatttt

SEQ ID NO: 249079 - DNA, 413 bp, Homo sapiens
tatgctttattctgtccctttatctcgtatcagctttttgtatgccattccttagataacatttcttaaataataaatggttatatattgtttattataaaagaatttaatcactcagcattgaatacttaagcttaagcttttactgtgtgtcatgcagtggtctaggtgttcaggatatggtaatggagcaacacagaccctcagccctcatggatattacatctttatgggataagaagacagcaaacaaatatatatacagtatactattgggttttagtaagtaacttgatgagaataaagcaggataaagggatagagaatgactggccattctaccttaactaattctctcagggaaagtctctctgaaaaggtggcaattaagctgaaactgaagatttctagga

SEQ ID NO: 249080 - DNA, 405 bp, Homo sapiens
ttttctttttttgtaatgggcacagaggatatttatttaagatggtggttttcaaacttttaaaaaagtagcagaccgcttgttttgtaaatgaaccttactataggaagcagataaatgtggcactcctcggggagcagcaggggtgaggggcctgggctctaccctctcactttccaccttgtcctttaaaggagactctgacatccctgaggaacacaattggtttagagggaaagggaaaagaggttaacatttagacatgtaaatgaacgaataaaataaatgaatagggaaaaaaggaaaccctttccttaatgtggaagtagaagtggagctggaaaatcaccgctttgtaaccatcacagtaaaaattgcaagaatcacgatgaatacttaatccag

SEQ ID NO: 249081 - DNA, 823 bp, Homo sapiens
tggggctggatccgaaaagcgcggacggggtcggggtgtgtgtgtgtgtgtcccctccggctctggggatgcccctttcattctagagctcgggctgagcaatggggtttgcagcgccctctccttccctccagcatgggagaggcccagccaggccagcgtgaccttcctggccccggccccggctgaagggagacctgctgggtcggccttgcaagtccaacctcattattcttttcccattcacctccctgcgtccctggagttacctcaatttgggggccctgagatggggtaaacctacccccccaaaaaatccctcgaggtgtaactcaggaaggcctagcgaatcccgactcggatggtgtcgcgagacccttttgcaggcggcgaggagtgggtaggtagggtgagttgaggaagtgcccctcacccgccaccccaagcccacctgtggccttggggctccccgtctcggtggggggggctgttgggacccctcatctcacgggtcatttccaccactaaacgccctttttgggcgccggaccccgcagtcttgtcccgcggctcctcccgaggccggcgccccgcgcccgctccccccagagccggcgcggctggaatgttctctcctcctcgcggggccgcttcctgtccgccatgttggaagccgattcctgtcaccgactccggcccactgaggagcggagggggaagggtgtcgagggccacacggggcggcggagccgggtgacccgggatcaccaccggccgcagcctcgccccctgcactgcgggggcgccggcgccccccgcaccg

SEQ ID NO: 249082 - DNA, 440 bp, Homo sapiens
ttctccaatcgggaatagaaccagctttggcgcttgaaacgaactccatctccaaaaaaaaaagaaattaacttttaaaattggaatagaaaaaccttatttaaaacattttagagtatgttagagtagatagagtagatacctgaactgaatctctggccacctgtggagttttgtctaggaagtaggtgatggcctatcaggaatactctgggtagctgctgtaagaatctagagttggagagagaaaactaaatccatactcactgatcagtagaaagaacattggactggggtcaaaagacctggggtctgaggccaaatctaccactattatgtctctcctgatcttagattccatactcgcaaaatgagagaactgaagttaaccagattttcaagtatgtctgcatcagaaatacctaggacttaaaaaaaaa

SEQ ID NO: 249083 - DNA, 510 bp, Homo sapiens
tgcacttttggtgcaggcactaaggaaaaaagtatggaagttcctaaaaaaaattaaaaaagagaactaccatatgattcatcaatcctgcttctgggtacgtattcaaaataattaaaattgggatcttgaatagatatctgcactgccatgttcacctcggcattattcacaagagccaagaggtggaaatacctaaatattcatcaacaaatgagtggataaagaaaacgtggcatatacaattgactcttaaacactacaagtttgaactgcataggtctatttatgcatagtttttttttcaaccaaacatggatcaaaaatgcagtctccatgggatacaaaacccacacatatgtaggactgacttttcatatatgcagcttccacagagctgactgcaggacttgagaatatgcagatttgggtatacacagggagcactgaaccaatcgcctgtgtatactgagggacaactgtacaaacaatggaatattaatcaacctt

SEQ ID NO: 249084 - DNA, 419 bp, Homo sapiens
catgtcccaggagggccgtctctgcctccagtcccaattaggcagccccaatataagggatccagagggctctggctcagaccaaaggcatctgaagggtccatgtgggatcctggctatccaccctctcccttgcacctcattttttcctgagctccaaggttacacaagtggcaggctgcccaggccaaattccacgtctgtcccaatcctcgatccactaacacacaaaaccaggtcagaagcggttatgcagcccttgggtacaaacagacaaagtccaggcctcctgaccccagggaataaagcctgcagctttgctttgctacactttaaagtacaggctgctttcaagttaaccaggcagtccttcgtcttctccagcaaggctgaatccacagttctctgctagggtaagg

SEQ ID NO: 249085 - DNA, 332 bp, Homo sapiens
ggagcccagcaagccccaggaacctcctagccagtcttccaccctcctgcggtttaggagggaccccgggggccttggctgctccctgagcctttctcagttctagaaaaactgaggtttccagggtgctgggaagaaggggggcagcccacctgccacagcacatgctggtcaggccctgcctcccagctggccctggggacaccaggtgaccatggaggtgtacctccctgctggggagggagcactgccaggagaaacctctagaaagagacggtgcctggattgtcttttagaaattgaaatcatgttttcaatacatgcccttgtga

SEQ ID NO: 249086 - DNA, 352 bp, Homo sapiens
tacagtgagccgagattgtgccactgcactccagcctgggtgacagtgagactctgtctgtctcaaaatatatatttatacaatatttatataataaacgtatatttattatatatgttatataaattatatattatataaattatacaaaattatatttattatatatgttatgagatgatagcattgtatcaatgataaaagtctgaattggaccattgttctgtgcttctgtaacacaatattcttgctcttaggagatataggttgaagcatttaggagtaaagggacataaatcatgcaacatgcattcaaatggttcaggaataaaaatactcatgaagggctggg

SEQ ID NO: 249087 - DNA, 289 bp, Homo sapiens
atgaagccagaaggtctgcctcttttaggaaatcaattcaattagtaagtagctgaagttagaattgaacaaaccttgtatgtttgtaacagcttgaatgaccaaatacagtagttgctcttttactaaaagccaccatatggtccagctgtgcatgggtggtgtttcagggaatgcaagcttcttatctgtgggtgtcctcataaatgaaatttgtaagtaggcctccaaagttaataagagaatgatccagtgcctgacatttttattgtaaatacaatttaatatc

SEQ ID NO: 249088 - DNA, 475 bp, Homo sapiens
gatggatgatgggcctaaaacaagagagttgcagaaaattggacaggatgaaatgaactgtttgtatatatctaaattgagtatccattatttaatttaaatgtcacctactctggtgcactagccacattttagatgctcatgagccatgaggctcatggccgccataatgaacagcacaactctagtgataagccataatggtgataaactacactttatcattttatgcctccttcccatcctgtccattatttgggtaccctttaaaaattaaacacatgtgttgtctaattactgaaataaatgaaaatgctacggaaaaaatctgggcacctatcttcctggaaacttcaggcttaattccatttagagaatggaccgtctgtgacttctgaaagaagaacttacaatattattaatggtttcccctattgttaagacaacagaccaataaacttattttttaatgtta

SEQ ID NO: 249089 - DNA, 278 bp, Homo sapiens
ttcgagactgttgaaaagaactcccacgagtgaacaaaagacgcctggccgaggacactccagagtgctgtcacgagggttccctgcagttttcagaaacttggagcatgtggccacagcggcttgcacgtgattcatacggcacatcttgtcaccatgtaaatgtttatcagcagagacaaagaccagaagagcaaccttggaaagagctaaatattccgatgttccagcattttcccctctggtttgtattgtgaatttttaaaatctcgattgac

SEQ ID NO: 249090 - DNA, 387 bp, Homo sapiens
aattctttatctgtgatgtcatatatttaatttctagcacttctattttactttgtcttgtagtgttcctctcgctggtgaaattccctatctgtttgcgtttgttgccccttttacattagatgcattaacatatttattatagttattttaaaatctctgtctaatggttccaactattggggtcatcaagtctatttctgttgattgctttgtctctagattgttttatcttttgctttttaaaaaattataatttttgatcgaatgccagacattgtgtgttaacagtacagactgaggtaaataatattcacatctccaaattattatgcctattatgtctgacttctagtgtgcaaggtgaagtcgatctagttaggagct

SEQ ID NO: 249091 - DNA, 1042 bp, Homo sapiens
tgcacaggatgcagggggcagagccgcagaggcaggacgcctgcgggagggcactgtcactcttccctctccccttcaccgcccaagcgcgcacctctcaccacctgcccagaggtcggcgcatctgtgctgcgctaggcaggagcacactgttccccagacaccagcccattgaactttcaggtccgagagggaggctgggtcatatagggctacacagccagtaaccacagaacccagattcaaacctgggtctatctccagtgatactgtggcttgaaagcgagagctagccgaggtcacgctgtttctttcttacagggagggagagtagtttaaaaaaaaaaatcacaaggccagctgtcaccgattaccttcgtgaccttatacaactcactcaacctctctgtgcctcagtgtcctcttctgtaacatagtggtatgtactcctcacaaagcagttgtgagagtgaaacagaaattccacattgtagcccccttgggctccctttccccttccccacttaatttttccccgcgggacttctgccatcagcgaggctttatgttttgtcggcctccgctttccagcggggcaggaatttttgcgttttgttcattgtggtattcctagaaattcgaacagtgtctgtcacacagcaggagcttacaggctatctgttgaaggaatatgaagtgtttggcatagtaccagtcacatgttaagacctcagaaaacagcaagtgcagaataaacaccagttggataaacggaatgattttcggctctgaggctataccagcactagacagcaggtggcggtctaaccctttccctctccagggtcctctgccccagttgcggtcagcccttcccctggcctggctgaaatcattcaggggctggtgatgacacactatgccacacctgaaaaggagactcaccctcctgggagcccagtccacagcccagcctttaaagaaacaggccccacatccagatacctctggtaaactttatcttcccccaaacagcccctac

SEQ ID NO: 249092 - DNA, 311 bp, Homo sapiens
tgcacaggatgcagggggcagagccgcagaggcaggacgcctgcgggagggcactgtcactcttccctctccccttcaccgcccaagcgcgcacctctcaccacctgcccagaggtcggcgcatctgtgctgcgctaggcaggagcacactgttccccagacaccagcccattgaactttcaggtccgagagggaggctgggtcatatagggctacacagccagtaaccacagaacccagattcaaacctgggcccgcaatgatgcccacgatggggatggtggctgggaagccgcttccatcatgcaggt

SEQ ID NO: 249093 - DNA, 1906 bp, Homo sapiens
cctgattccggaaatgctaaatatttatagttaggggctcctgggcccagcatcccatctccactcccaggctctgggggctggggagtggttaccaagcctcctctctccttctgtcccactgccctctccccgtctctagctcagaggccccactggaccctcggctcttccttggacttcttgtgtgttctgtgagcttcgctggattcagggtcttgggcatcagaggtccgccgcgatggggaagccctggctgcgtgcgctacagctgctgctcctgctgggcgcgtcgtgggcgcgggcgggcgccccgcgctgcacctacaccttcgtgctgcccccgcagaagttcacgggcgctgtgtgctggagcggccccgcatccacgcgggcgacgcccgaggccgccaacgccagcgagctggcggcgctgcgcatgcgcgtcggccgccacgaggagctgttacgcgagctgcagaggctggcggcggccgacggcgccgtggccggcaaggtgcgcgcgctgcgcaaggagagccgcggcctgagcgcgcgcctgggccagttgcgcgcgcagctgcagcacgaggcggggcccggggcgggcccgggggcggatctgggggcggagcctgccgcggcgctggcgctgctcggggagcgcgtgctcaacgcgtccgccgaggctcagcgcgcagccgcccggttccaccagctggacgtcaagttccgcgagctggcgcagctcgtcacccagcagagcagtctcatcgcccgcctggagcgcctgtgcccgggaggcgcgggcgggcagcagcaggtcctgccgccacccccactggtgcctgtggttccggtccgtcttgtgggtagcaccagtgacaccagtaggatgctggacccagccccagagccccagagagaccagacccagagacagcaggagcccatggcttctcccatgcctgcaggtcaccctgcggtccccaccaagcctgtgggcccgtggcaggattgtgcagaggcccgccaggcaggccatgaacagagtggagtgtatgaactgcgagtgggccgtcacgtagtgtcagtatggtgtgagcagcaactggagggtggaggctggactgtgatccagcggaggcaagatggttcagtcaacttcttcactacctggcagcactataaggcgggctttgggcggccagacggagaatactggctgggccttgaacccgtgtatcagctgaccagccgtggggaccatgagctgctggttctcctggaggactgggggggccgtggagcacgtgcccactatgatggcttctccctggaacccgagagcgaccactaccgcctgcggcttggccagtaccatggtgatgctggagactctctttcctggcacaatgacaagcccttcagcaccgtggatagggaccgagactcctattctggtaactgtgccctgtaccagcggggaggctggtggtaccatgcctgtgcccactccaacctcaacggtgtgtggcaccacggcggccactaccgaagccgctaccaggatggtgtctactgggctgagtttcgtggtggggcatattctctcaggaaggccgccatgctcattcggcccctgaagctgtgactctgtgttcctctgtcccctaggccctagaggacattggtcagcaggagcccaagttgttctggccacaccttctttgtggctcagtgccaatgtgtcccacagaacttcccactgtggatctgtgaccctgggcgctgaaaatgggacccaggaatcccccccgtcaatatcttggcctcagatggctccccaaggtcattcatatctcggtttgagctcatatcttataataacacaaagtagccacaa

SEQ ID NO: 249094 - DNA, 474 bp, Homo sapiens
gtactggctgcaggaggccatgagtagcattgtaacctcattaacgaggccttgaacaataaagatgtttttataatccagttggctgccttacagcaggttcaagagtcatgtgggatggaattagcatcacgggtcatgtagctcaagggtaagtttcagtccacagcttgaacttcaacccctgggtacagctcctattaatgcacccacaaatgaacataaatagagctgactctggctatgatggtatccagataacttgttttccacttcacagcttttcccttttggccccttccttccattcacaataactgggacatgaggattccggctcaatgcccagtgtcctcctctgtagcaagtctcctcctcaaaaatggaaagaatcttacatcagccatctatgtttactaaaaatgcttttcaggtctctactcaagcagaaaacattttcaggttaaaaaaaat

SEQ ID NO: 249095 - DNA, 1019 bp, Homo sapiens
agaaagactctttttttttttccatgatggagtgttgctctgtcttccaggctggagagcagtggcgtgatctcagctcatggcaacctccacctcctgggttcaagcaattctcctgcctcagcctcctaagtagctgggattacaggcatgcaccaccacgtctgactaatttttgtatttttagtagagacagggtttcatcatgttggccaggctggtcccaaactcctggcctcatgatctgcctgcttcagcctcccacggtgctggtattagaatcatgagccaccgtgcccagcaaaagatgattttaaacatttatttaggtgggtaggcaacattctaagataataccctggattaccagtctgttgcacacgtgctgtgtcatactttcctcttgagtgtaaaaaaaatgtgtgactgtggtgggaaatcacttatgaaattaggttactcatccgtagactttgtgtttatcaaaatggagattatcctgattgtgctaaacttaatcagaggtgcttttaagagaaagagacacatcacagaaaaacacccctgctggcctgaaagtaagtgacttctaggtagaacatgttgtaagctgcttatggtggccacatggcgggaaaaatgtttgtatcttgccatcatttctgcctcctccatgttgcttccagtaaggaacataagaggattctatggcagagggaaaaaaaagggaatctcattcattcaagaaataatcacctctcatctgggatagcttaagagaaacaggagaccacaacaggtccacattaatgggaggaaaaaggtaacctgggtaaaagtgctcactggcattatggaacagtatttagtaagctgtagtgaatgatcagcctctgggataccaatagtctaccaacaaggctgaactcattctaattcaatcagcatgtctgcaccattctggtgacacaggtttacactatttattacagaaatgccatgaagaccagtgggtaatg

SEQ ID NO: 249096 - DNA, 466 bp, Homo sapiens
taggtctagcagatgagaactgagattgtgagattcctctgacaggatatattagggagtttaataccctcatgcagcacgatttaaagaattaagcttttttaatcttcaacagaaagtacagttaagcagtaagtagtcattgataaaagggtttttcttctagagtttctataatgaaaggagataatttttcaaaagaaagagaaaaaactgcttatagtggagtaaaaatttaaaaaaagtcaatattttgacactcacagattcttgaaacataggttcttagataccaaatatgctagttgagagtgtatgtatgtatatgcctcctcctttatcatcgttctcacttgttaagagctatagggctatttttaatgctatctttatgaaatcgatatggcttctcaaaatctgtggagtagcagcacattttgagagatgggaagcttttatagctact

SEQ ID NO: 249097 - DNA, 1412 bp, Homo sapiens
ggaatctggagctccatcttagacatgctgaagtatctgtgccacttccaaagggacatggggtataggcagtggatatgtaagtctcggattctgaggcattctaggtttaaaatataaacttgggaatcttttagatggccttgaaagctccaacagtggatgagatccccagagtgagtgtagagagagaagtgatctgagagatccagtagcgagggaacctgaggttaccggagatgaggaggcagttgtgtgagtgagatctttgtgagggtgaggagggccaggaaccaggatacaggaagagggtggccttcagtagacacatgcactgtgacaggaagggaggcagagaatatgagaggagcctcaggtagggggatatatttggggatgggaatattcaagaatcagatatttactaagagcctgacactgctgggagggctctgatgtttactaagtgcctatccatgccatctgctatgtgaaatgctgcacacatgttatctagttgaatcctgagaacaatctcattagggaagtactatccatgttttacagataaggaaaccaaggctgagaggaaaagtgccttgctcaatcagtaaacaccagggcctgaattcaccccgcacctgcactccagatgttggaggataagaatgttgtcgaggagataaggactacatatgtggcaagttagaaaaccatgtaatatgagtgctttcccgaggcaacctaggagtggcacagacactgaattgtctgagttctcagaaaggaaagagcaccatgggtgacagggacccgctgcaggggcctcgagcacagggactgcaaccttcctcccgctgcattgtattccccctgctgcacctcatctgcacctagccccttctaatcaggggtccctgtttctcaccttcccaccttccaccgcagggcgaatgcagactccccactgtaggggacagcaccatgcggaatgttcttagtcatttccttcatcaattttgcattctactccatatgtctggagtagttgtacttcttttttgacacagagtctcactctgtcactcaggctgaaatgcagtgggatgatcttggctcactgcaacctctgcctccagggttcaagcagttctcgtgcctcagtctcccaagtagctgggattggaggtacccaccaccattcccggctaatttttgtatttttggtagagacggggttttaccatgttggccaggctgctcttgaactcctgaccttaagtgattcactcgcctcagactcccaggatgctgggattacaggcgtgagacactgtgcccggcctggagtagctgtattaacataaaagtaggtgaaattatttataattaaataaaatgaagtctccagg

SEQ ID NO: 249098 - DNA, 735 bp, Homo sapiens
ggaatctggagctccatcttagacatgctgaagtatctgtgccacttccaaagggacatggggtataggcagtggatatgtaagtctcggattctgaggcattctaggtttaaaatataaacttgggaatcttttagatggccttgaaagctccaacagtggatgagatccccagagtgagtgtagagagagaagtgatctgagagatccagtagcgagggaacctgaggttaccggagatgaggaggcagttgtgtgagtgagatctttgtgagggtgaggagggccaggaaccaggatacaggaagagggtggccttcagtagacacatgcactgtgacaggaagggaggcagagaatatgagaggagcctcaggtagggggatatatttggggatgggaatattcaagaatcagatatttactaagagcctgacactgctgggagggctctgatgtttactaagtgcctatccatgccatctgctatgtgaaatgctgcacacatgttatctagttgaatcctgagaacaatctcattagggaagtactatccatgttttacagataaggaaaccaaggctgagaggaaaagtgccttgctcaatcagtaaacaccagggcacgtggatccacaatggcacgtggatcacaatggcacgtggatcacaatggcacgtggatcacaatggcacgtggatcacaatggcacgtggatcacaatggcacgtggat

SEQ ID NO: 249099 - DNA, 513 bp, Homo sapiens
ataacaagtacagatgacttaaatagtcttggaaacaaattcacctgattcttcaaggtgttctgtaaggatacatttaaaatggttagcagaagtggcattatgaagacatattgagagcatggaagctggggccaaactatctgcatttgaatcccagttctgacatttattagctttgtgacttgggcaagtaattatcacatctgtgcttttatttcctcatccataaaatgggcactctgcagggtcattgtgaggaatgatatatgcatagcacttagaagagtagatgcatagtgaacataaagcaagctagttcctgttattcaaagtaataacctgtcacccacaatatttataataccatggacattgatcagtgtgttttacaaagggacttaagagtattgcttaatccagtggttgcagtcgttggttaagaaagcttctactgtagctcttgttttcttggcctgtaaagacaccatttttttttttaaaacatagaaa

SEQ ID NO: 249100 - DNA, 423 bp, Homo sapiens
agcagtcaacggatgccaatgcttagatgacacagagttagaattatctgacaaagagttcagagcagctataataaaaataatccaaaagtaagggtgaatttgcttcacatgaatagaaagaatagaaggtcttaacaaggaaatagaaaatataaagagaacaaaatggaaattttagaatgtagaaatgtaatcataaccaaaataaaacacatgggatggactcactagcaaaactgagtgacagaggaaagagtcaatgaacttaaagataaataaataaccatgacctaatctaaaaaacagagaaaaaacccatagtgaatacagatttagagacctatcacacagcaccaaaaagtctgacatttaagtcatcagagacccagaaaggaaggagacaaagtgcattgctggaaa

SEQ ID NO: 249101 - DNA, 283 bp, Homo sapiens
ttacaggtacacaccaccacgcccagctaatttttgtatttttggtagagacgaggttttgccatgttggccagggccaggctggtcttaaactcctgatcttaggtgatccgcctgcctcgacctcccaaagtgctgggattacaggtgtgagccaccatgcccagcctaggaatgtccaaattctgataatgttttataagattaaaaatataggccaggccaggaggtcaggcgttggagaccagcctggccaacatggcaaaaccccatctctactaaa

SEQ ID NO: 249102 - DNA, 305 bp, Homo sapiens
gatggttacattaaaacctagacttcaccacagtgcgatatattcatgtaacaaaactgcacttgtacctcttaacatttattttaagaaagtttcccaacgaatgtttagcttcaccaggcactttgtttttatttcttttctttttttttttttttttgagatggactcttgctctgttgcccaggatgagtgcagtggcgtgatcttggctcactgcaacctctgcctcccaggttcaagcgattctcctgcctcagcctcccgagtagctgagattacaggaacgcgccaccacatccggc

SEQ ID NO: 249103 - DNA, 478 bp, Homo sapiens
gaagagttgggaaaatttgaaaatctactgggttttagatattaaataatttctgttaattttggtagttatgataatagtattgtggtttggtagatattgaagtatttagggctgaaatgtcttgatgtctgtaactgactttaaaatacttcagcaaaaacaaaagataaagcaaatacagcaaaaaaaattaatactttgtgaagctatgatgaatattagggttgttcagtctttctctgtgttagaacattttataaataaaaagactaaaaatagagaaaagtgtaagagattgaatatactggaagtataagattacttaaaaggtgagagtttaaatcactggtggaggggctgggcatggtggctcatgcctgtaattttagcactttgggaggccaaagtgggaggaccagttgaggccaggaggtcaagaccagcctgggcaacatagcaagacactatttctcaa

SEQ ID NO: 249104 - DNA, 456 bp, Homo sapiens
ggtgatccacgggagacggctagcctggaccaagcagttggcaatggataagagcctactcctcaaggataagatgctgaagcagccacgtgctggtgttgtaccttggacagttccatatgatgagctcagctttcacccattctgcaggagctgtggttctgcagctccctgaccagggacagcttcatcctgcacaggaccatgcatgcagggtgtgctcaatcatcagtggtgactgccgaactccttccatcattctcacatgctccacagcaaccacaaacacttgtttaacctggaaagaggaaaaggccaccccggaatagtcatgcttccctctcactgaagtgaaccagatggggccacatgcaatcagatggactcctaaacagaacaaaatgtcactctccttgtatcatggttgtctcatgggttgacatacccaacactaaa

SEQ ID NO: 249105 - DNA, 363 bp, Homo sapiens
ctcccgagtagctgggattacaggcatgtgccaccacgccccgctaatatttgtattttcagtagagacagggtttcatcatgttggccaggctagtctcgaactcctgacccaaagtgctgggattacaggcatgagctactctgcctggccccatacatcaactcttgagaggggccttggaactacatcagctttatgatattctggggggaagaaaattcaggtagacttaaaaagctactgccaacccaattctagtatttggccactgactgagaaagggaactcctatatacctgacccagttccacattgcctcctgccagcctccaggtccagggaaagtaattggatgacatc

SEQ ID NO: 249106 - DNA, 425 bp, Homo sapiens
aaaaatctaaggactagagaccacgggtgcaaggggttatggccagtggaacaagaaaagatcatacgtggtaataaatataggtaacagtccattctggatgaggtcaactgggcaggaattctttatgctccatctaggcaggaaatacatggaggcctttgaagtcccactggcatgtgtgcaaggagccactgttaatttacacaggaaaaaggaatggagggagtaacagcatcagtttgaggtcctgtgatatatccattgggggtgaattgtcccacagttattaaattatttaaaaatcagtactgtattctaagttacactgcctgatttcagtgcttactttccggctatagtaattaagacagtgtagtattggcgtaagtataaacagatagattgatggaacagaatagacc

SEQ ID NO: 249107 - DNA, 756 bp, Homo sapiens
ctttccgtcacactgggaggcttgagaattggcccatggaagacaggtgcagcactttctaggaaggagagtgtggaacttgggctcttggccaacaggtcagtaaactgtagtttcattggggctcacactctacttagcacatgtgctgagggtttgcatctgcccaggtgagaaatggcaccgaggaaggcccacctctgggggcacgttgagggaggcatgtaagcaggtgtgatattgccaccctttcccacggaccctacccgttcccactgtgcagtcattatgtcagggaggaccgtgcccttgaccctaggggtcctggggccctgtccaattctggtggctgcgaggcagacaggaggaggttgtagtttcctgatgaggaaggaatgacgtgactaagagcagtgagcctgtgagggtcactgtggtattgcctgagctccaggaggcctgtgaagaaggtgcagtgtgttcttcccaccttccgtcccgttattcatgttgtaaatattgtgctcccttgtaggaagagccatgggtccaaggccacaagcccctctgggccctaaaattggtacctgaatactcattcccacttttttctgaatgggtgctgaggagggaggaaaatggtgcctttcctctctgcgcaaaggagcagacacctcacagctgagacaggtttcagttcctgctatggcaggatattttgccaggtatagaaaaataagacaatactgattaagc

SEQ ID NO: 249108 - DNA, 282 bp, Homo sapiens
aattattcatcctatttttactctgctactgctcaactttgaactttctttatcctgtatttttttaatcaatgctaattataaaacagccattttttactctccttggactcttttgtcttcctcctgcctaattgttgagaaacattctataattgtagatccctgctattagtctgttacattattcttttttgaggaatcatttatcattagctttatggcacaccactctgttaacaactgctagtcacaattaattctatgctacttaaaaaaaaa

SEQ ID NO: 249109 - DNA, 373 bp, Homo sapiens
ctatgcactaggcaaggtacaaaatgttttatattgataatcaaatgtaattcttttgagatcagcattattactcccacttttcaaatgagtgaacctgatcaaagagattaagtaacttgtctggaaatttaagtaacttgctcagggagaggcaagagcatgatttaaagtcaaccagactgcaacatccatggctgaacccccacctgagactacaggagcttaccagaggatggggggagtgaaatgggaaggcttatggcagtggctctcaataagtaaccctgggaccagcagcatctatatccagatggtcttactcggtagacagtgcacttaaccattacacagtactgctacattgtgtctt

SEQ ID NO: 249110 - DNA, 840 bp, Homo sapiens
acatgtggcatttaaatttaacttaattaaaatgaataaaatttaaaatgcaattccctggtcacatagccacatttcaggtgcccaacagccacatggacagcacataatagtccattttcatgatcgcacatggctctattggacagtactggtttgcagtgcattggagcaaatgagtgtagacttgtaccacatgtgtcaagaagcaagaagatgttttcaaaggggaaaaggatataatatacttctatgagtgtctctgaaatctgtgtgtgggatctatgtgtgaagcctgactctcactcaagtactcctctaaatctattacctaaaccttaaccctttctgttctcagctaaggcgcaggctgtttcaaacccctatggcatctttgtgcaaataagaccaaggcgcctctcttcccagaggaagcaatgccatgtcagtgcacactggatctgagcagtgccaccaaacagggcccacctaacaacgctgtacaaatctggcctaagggccaggatttgaaatttagaaggcaggaagagtttcttcattgctctgtgttctgcatctcaatacttcttttagcaatgagtgcagacagaatgacagggcttgagtttgtgagttggcaggaaggccaaaggataaaggaaataccaagaacaacaatttttttaaaaacactaataatactacaagtcaaaaacatggtctttgctgggcacagtggctcacgcctgtaatgtcaacactttggaagactgaggcaggaggatagcttgaggccaggaattttagaccaacctgggcaacatggcaagacttcatctc

SEQ ID NO: 249111 - DNA, 224 bp, Homo sapiens
ttttctctaaaactcactgctatactaatgcaagtaacttaaaatgtttaaagatcaagcagcaaccaagcactcatgaatttgccatcgtcactgtcattcctcagaaagatgtttctttgttgaaaactattggggaaatagcactaaaatgtccaagaaatacacatatgaaaacctattatgtttgccgggcgcagtggctcacgcctgtaatcccagca

SEQ ID NO: 249112 - DNA, 471 bp, Homo sapiens
tacatttatactccatgtaagtaaaaaaatacggaagaaaaaatgattatatagttccataattatttaaataaaaataattccatgattaagaggggaagaaaaggttacaaagcagtatgaatagtgtgatgtcatttttgtataaaatatatgaagaaatagacatagaagaaagtaatgaagtatcccaaaatattatattaatgatcattctctctggatttgttgcatgatatatttattatctttgtttcccttttatgcattctgatataaaattttttgtagcaagcatgaacttttatcattggaataaacattgatgctatattaaaattagagtgtggtggagcatggtggctcatgtctataattccagcgctttgaaaggcctaggcaggaggaccacatgaggccaggagtttgagaccagtttgggcaacatagcaagaactccactctaccaaa

SEQ ID NO: 249113 - DNA, 1131 bp, Homo sapiens
ggcgtggtggcgggctcctgtaatcccaactactcgggaggctgagacaggagaatcgcttgaacccgggagttggaggcgtagattgcattgagccgagatagtgccactgcactccaacctgggcgaccgagtgagattccgcctgaggaaaaaaaaaaagaatattttgtatcacttgtgagaggctaacattagattgtccagatgaaagtgctacagttatacattggtatgtaatgaattttaatttggtctgtcattgtcctttttgtggtgcagaggagtcattctgcctagagattggagctaaaatacattgcagaaatttgttttagactagtctcttatgtagattgtgtgggtttatgtagaacattttgtgttcagaatgcttttattaaccttcttcatggtactcttgagaggctgtccttatctcttactgatgattagactgagacaagtggaaagtaaaggttagacaagatgtaaagtgtgtggtttgagctgtgatgagcacactagggagttccagataccagtttgatgcttattcaaccatttaggttatcggtctgcgagtttgttttctgcagtgtgtgcataactagtgttttgtcctcttagaggatactctggggacattcttgagttttctttgtttattcctttccgtttaaggaccagaagtaatattcttgaattttcatttgttcagatctttgctctgtaattaagattgcgtgagagtttgttgtttgggccagttaggctgttgaatttcttgggaatgtggtttcaggcattttttggtccctttgattatatcattgtatgtggaactttttttgagagagagagttttgctctgtcacctaggctggaatgcaatggcgcggatcttggctcaccgcagcctccgcctcctggattcaagcagttctcctgccctagcctcccaagtaactggaattccagtcctggccaggaactttttttaaaaaagaggagcacgatcataaaattaagtcagattctttcctaatcctatctctgatttgtttttaattgctttacctgtttatctcccctcacccttttgttgttgttgtttgagatggagtcttg

SEQ ID NO: 249114 - DNA, 321 bp, Homo sapiens
aaaccccagtaagagaaatggtgtttatttcatcacctagaaaaacactgtccgaggaactttagttttaaggaaaatgttctgtatttatgcttcctaatgcagaaaccactagccacatacgtactcgaagtgtggctactgcaattgagaacctgacttcttaattaaattgaaatataaatagccacatggagctcgtggctaccgtgttgggcagcagagacgagagctgtaggattacggggagaggcaaaatatagattgacctataactgacatcagatagtaagacagcattgatatcaaaacagagactgt

SEQ ID NO: 249115 - DNA, 488 bp, Homo sapiens
tcctcgggaggctgaggcaggagaatcgctggaacccgggaggtggaggttgcagtgaactatcgtgctactgcactccagcctgggtgacgagcgaaacttcacctcaaaaaaagaaataaaacaaaaaaacacttgggtgtgccagacgcattgtaggctgcttggagggtgaggacctgactggtcctgctggtgcctttttactgctttcggtgcagaatccagatggctactacttggttctgacctaggccaggggaactccactgctcaagagactgatagcttgtcttcaccagaaaccttgttaaaacacttggctgactcaacaggctccaggtgagccaaagtatcttgcatctcaccccgagaggaggcaagtagcctccagcttcacttttctttctggtcagcagcaatggctgttggaagtcttccttacccattcgttcttctgagctggccaagtttatgaggcaaaaaaa

SEQ ID NO: 249116 - DNA, 1021 bp, Homo sapiens
gggagaccacagccccagctgacatcttgattgtagcctaatgggaccttgagcagagaacccaacaaagccacacttgggctcctgatccacagaaactgggagatcataaatgtgtgttgttttaagttgctaatttgtagtgatgttcttatgcagcatagataactcatacacagagaaccaaggccacgcgagaaccctgtgggggcccctgctgctcagccactcctcacatgctgggacagctgtctctctggcctctagcaccaaggtccccactatcccaggccttgactcttggatcagagagggacaaaagccccatggagccaagcagactcctccccctgggctgcactcacctagcttgtctggcacacacaagttggagtagagaaggcaggaagccctgggaagggagagggtgatggccttgcttaactgggatgagtgtccaccaaatttcccttcccacttcccctgctcatgagcccccaggggacctgtgtcagttcactttctagaggcttctatgtgccctaacttggatgacacccacgggcctccccaactcagcacagggaacatatgcccatggtggcatggggaaagaacccagcctctcccctgcccaggctcctgcaccccatagctgtcacccctctggaacctctcagggcagcacgagtggtagcctcggagtggccttcaccctccaggcactgcggtcctccagattggctcacagcccagctcttgctcccatatccacagccatgagagcagccacctccccagggggccataagcgcttctcaccaggagcccacctaggccaggagggagctgggggcaagttccaactgcccccttgaacactgcatacccatgaatctggcaggggcatctgggaagagatttgaccactgaaagactgtagggaaacccttgaacctcaatccgctacgccacgtggatttgcttcctgtgggctgcccaagagcgcctctgtggtgaa

SEQ ID NO: 249117 - DNA, 453 bp, Homo sapiens
atgaacttatattttattaagccacagttccttgtaggtgttctgtcactcacagctgagcctaatattaggtgatacaggtataaacacatacaaggttacatataattttttggagggaggtggtccatggaccccaaattaagaatatcactttagaaatatatataaaaggataaccacttaatgtttgtactttgtaattaacaaatttttcttcacatccattatctttcttaatcttcacaatcatcacagaaataaatatcatttttaatcccatctgtttattaagaaacaaacaaaaaaatcctgaggctcaaggcatgttatcttgccaaaagttaataatgcagtaaaaattataaccaatgtgaatgattctaaatcccatggtcttatcactattccaatgactgtagtacatgtacaggtatcctccagttttgtaaa

SEQ ID NO: 249118 - DNA, 300 bp, Homo sapiens
gtcctttcccccactgcttatgtaagaggcaaaggaaagatctaaatggaaaaatgaagcaacataagcatggagaatcaggtatttctacaaatagtttcctttaccaactaatcaacaggtgggaaactgaggctgtttcccctccccccaccttcataaaaccaccatactgaaaaattaatagttctttggctatgctggggtttgattaaaaaggccaccctccacccttcatccacagcacagcattggttcctaggtccacaaagacagcacggaaagaacgccagagttagc

SEQ ID NO: 249119 - DNA, 1122 bp, Homo sapiens
agatgggatttcatcgtattggccaggctagtcccaactcctgacatcaagtgatccacctgccttggcctcccaaagtgctgggattacaggcgtgagcaccgtgtccagccttgcttcagagctttatgagtaaggtccccatggcctcagaagtcctctaggagttctgagcctccgagcctgtggctctgcctagaggtggggaactgcacagctctgccagctctacatccagatatgtgtagtcaggataaataaaaacgcaaccactgtggtaaagtcttgggaaggttttgtgcattggaaggagcatctcatgtatggaaagattggtaaccacaggttggatgcattcctcagtagaagcatgcacctctctgacggtttaaagaggaaggcagattagagagaggtatttgaccttcagaaacagccagttaaagcagaagcccagctggtgataataatagtagtggttgaagaaacagaggtacacacaggtgaggaagacagtgattggtgagtcacgatgcaaacccaggcagccggattccagacctccacatagccaagtattgcaccagatgaaatagctctagtggtggtgccagttctttctgatggaaataaaatgcgagccaaatacgtaatttaatttttttagtagctatgttaaaaaaaaaacaagatgaagttaattttaatgatatattttatttggcctagtatattcaaaacatcatttcaatatgtaatggatataaacaaaatgttaatgagctattttattcttttcatgccaagtctttgaattccagtgtcaattttacatctctagcacatcttgatttggactaaccacatttcatttgctcagtagcacacgtgaccagtggctattggacaagacagctctgagtttactgtgaccctcaaagaagagccgcagacttcacccttgtaacagataagctgctggctccctttgtgcaaaaaaatgatgccaaggataataccaccttaaagcccaggctcttggacctgacccaggcctggtcacttaacgtcatccatagcccgggaggtctatgttcttggtttttccacatcctgtttcag

SEQ ID NO: 249120 - DNA, 659 bp, Homo sapiens
tgggcattaacccaaaaagaaagttggtctaggctgcctcccgacttcagcaaatagtgtgtttgttacatgcaaaacaaacaggtatttacgttctgccgataccttatttttaaagtataggattagaacctggagggggtgtgtaggtttcatttagttttctagattaagaattgaggaaaccatcatcactctacattaaattacttgcagttgcaaaaattgcatttaattgtgagtcattaaaaggtacccagaaatacttttattaaaataaacttgtcgacctgttgcgggtaataggatttgcacatgcctgcatttctgccttccttatgtcagctggatttcttttcaactcttttttaaaatagaaattcaggtggacattctggagaccataaacattttacggaagactggtgcctaaatgtgccttcccatgtccagctaataaaccatggcaggaagtcaacagaacaagccatgtttctgaacaccctttcataggtgccacctgagttactcagtgaggggagaaagaactggagtgtcatttcagcaaccacagaaagctacaggtgaattttaaagcccaggtttgtgttctgattcagaacatatttaagctaagaatatttccttattcatgttta

SEQ ID NO: 249121 - DNA, 440 bp, Homo sapiens
gcaggacgttacgccggcctcaggtatggggaccggggatgggggacagtgtggccaaagtgacccttgtcctataccctcctccttctccaagcccagtctcaggggccgggaggagaggtgccccggggtgggcaggggccagactgcagatggcgatggggagccgggggcagattaggaatgaggggcttgggagctcccacggcagattctaactcagcaggtcagaaaagaaatgcccatgctggagcccttgtggaagtggagggccgtgaggtgaggaggggagcagcccccactgctgagcaaacctgggtcccggaccaggcggatccagggccaccctcccttcctcagccccctgcccccttggcccaccctgtggtccttgcccccttctggatggccgcctgcctcactgactggtcccctcccac

SEQ ID NO: 249122 - DNA, 451 bp, Homo sapiens
ggcacctaatgtctctactacagattagaaattactttcacagaaggccatttctgaaacccaaactagcttatgtgttaccctacattgaaattattcagacgctgtcttccccagtaatctgcaagtttcacaaaggtagatgccatgttcttaatggtttcccagcacatagcacataacagaagctcaataaatatttgttgaatgaataaatgagtaaacagaatatttttacagttaaatacctttaattcttttattttttttaaatttcaagtccttagaggaggaagaattgaaaaaatatgaaatatcaaatatacatttagctaaatttttaaagtttagtaggctatatgcataaatcaaatgaatagcaatatttggaactgtaactatttttggaatcttgtatgaataaattacaagtttaaaacatcaagagtaa

SEQ ID NO: 249123 - DNA, 229 bp, Homo sapiens
tcttcttcttaaacctagaaatcttcctataatgcttgatcctttttaaaggaagaatttggaatatggagcagatgtatattttcttcgtgacactcagaaacatgtattgtaaatgtgtctgttttttagataccatattgttcagttggctcctctccacttgaatccttttcttttaattagttttccagcctggctgtcccctcagctgcaaaacaatgcagta

SEQ ID NO: 249124 - DNA, 465 bp, Homo sapiens
gggatacagtatttgtttcacagcgttgttgtgaagataaacgggataccccagataaacagcttgtgtcccccccatcttaacaaccctcctttaggctggcgggccacctgctcaaaagccttccccaggggggttaaaaccgtcttttagtagttctggtacgggtgggctgggggagatcctctaaagccagtgcgaccttgaccccagccaatgtccaggctcttgacacatccagagaatgagttcaaggacaactcagaaaatagtgacaatatgcagatttattgcaaagggaaaagtacacacccaggaaaagggattgtggagagggtcactcacaacggggcttggggctgctacctttatgggtttctttaaccaaggggtgaaatattcatgaaaattcctggaaaagtgtggagatttttcgggactgtggtgccacccatttttacttca

SEQ ID NO: 249125 - DNA, 368 bp, Homo sapiens
agtttatctaattaaatcctcgtagcaaatttaaaataggttaggtagattatgcttaaccaattctgtattagaggaaaggcaagcatggggtagcctaagtttgctgggagtacccagcaaagccagtggtaacgtttaccatggatttcagatcctccaatatttggtgacttccactttccacttcttctataatcctcatgttaatattcattcccctcttcatgatttaacactatatacaattcccaggaggaaaatgtggtagaaatctatttttccttgctttgccacactacaactacaaaaggtgcaattatattcatcctaatttatccatgtaagtataagcattctagaggagg

SEQ ID NO: 249126 - DNA, 437 bp, Homo sapiens
ataaatgagtaagatatatcaggttatggtggtctttctgatgtgtcaatttgaacagactatagcctttaattatccaatccaacacaaatctagatgttgctgtgaaggtattttatagatgtaatttaagtccatgatcacttgattttaagagagattatcctggagaatctgagtgagtctgattcagtcagcttgaaaggccttaaaagcaggactgaggctcctcttagaggagaaattcatgtgtaagacaacagattcagcccatgcccaggagttccagcctgcccttatggttggcctgacctatggattttggacttatttatgcagctgccacaattgcctaagccaatctcttgcagcaaacttcatgtcatcctttattggttctggttctctggtttaaccccaactgactcagtgctatg

SEQ ID NO: 249127 - DNA, 483 bp, Homo sapiens
ggagacataaccagcgcaacgtggtattctagactggatcctagaaaaggacgtcaccagaaaaactggtgaaatccagataaagttaacagtaagatgtcaatgttggtttcttaaactaatgtatctcagtaatataagatgggaatattaagggaaaactggttgaaggatataggggaactctgtactatctttgcaacgtttcagtaaaatctaaaattattccaaaacaaaaagtttatttaaaaaaaaaaaaaactccagacacacttgtttacaaaggttatctagcagccatggataaactttcttggagtaaacactaccaccgataaatccaatcaccaagctgagttcccataaatatttcaaatgtcaaatgaaaagtcctagattaagtcacagaattataaagacattgatgacagctgatgagtcatcaattcaactagattactacagatagcttaaaaccgtcga

SEQ ID NO: 249128 - DNA, 475 bp, Homo sapiens
ctgacataacctagttgacaagtatagcttaagcaagtaagacctcattgctgatggagaagaccccttttcctttgcttgtctgttttgcaaaattcatttttccttcatgagagtaaaaacaatttaggggttattgcagatgtccaaatgcagccagcaattttaaagtcattgatgataccgtcagttatcacactcctacaccagcaatgaaaatactgtatacatagtattacatatatccactcttctaaaggcaagtctgagtttttaaagaatcatgttgtttaaaaaaaaaaaagttgcaaatgtatccattaattataattatatgcacttaaaaacatagaaaaagaatatttgaaaaagattgcaactattctgttaagatactggttttacgtatgattttctccattgtattctgttgcattatatttacaattaaataaaaattataaaggaactggtg

SEQ ID NO: 249129 - DNA, 329 bp, Homo sapiens
ctctgttgccccagctggagtgcaggggtgggatcatagctcactgtaacctgaactctcgggctcaagcaatcttcccaccccaggctctccagcaactaggactaaggcaggccaccacatccagctctttctctagacagggtctcactacattgcccaggctaatctactgtttatgttatcggtaaggcttctggtcaaaagtaggctattagtagctatgttttgggggagtgaaaactttcttttggattttcaactgtgcagggggattggcaatcctactcctcatgttgtttaagggtcaactctatataaaaaactta

SEQ ID NO: 249130 - DNA, 405 bp, Homo sapiens
aacataggaaaggtacaggaaaaacacagtattaatcttatgggaccaccattatatatgcagtctgtagttgactgaaatgtcagtatgtggtgtaggactgtgcttgctacatttattataacatctattaatatgtaatttattacattatgttattataacagtattgactgttataaaaaatgtttagagctaatagcaagttccttggattgagatgttaatattttttatattatttttactgttgtatttaactttttcttttttgagacagagtctcattctgtcatccagcctaggtgacagagcaagaccctgtctcaaaaacaaaaacaacacacacacacacacacacaaaaattatcttaaaggtactcaaagaacaacaacaaaaaaaaa

SEQ ID NO: 249131 - DNA, 314 bp, Homo sapiens
tctccctgcagtcatcctgcccatggctgttgatggccctgatggggcttggagcccccagaatgtgcagaagttggacaaaggtggtcttcaaatgcaatggttgtcttatcaccgaaagcccacggcatccagaggaggccctttactacgaagtttacagagagcacaggtctctgtacgtcccaagtttcccctgctgccaaatgcaggggaggagagaattctggaagcccaccctgtcccatggctcccctggcacatggagccactgaatgtcttgtgaacattaaacaaatgcttccaagtgaaca

SEQ ID NO: 249132 - DNA, 426 bp, Homo sapiens
gcaatgagagactggagaggaatattccattttatctctagatggttatagatagaaagggatgagggagtcacagctggtgatggcagtgtcctttccatagaccttttaggccctagttaccttttttttttttttttaacttgagagataatacacatggtatgggaggtaggcaatgcagaactagaaaaagttaatgacattaatatttaatagtaggctcttctactgataaaaatttgctagatgccaaacataattttttataacaaacctctgcttttgcatggtacagatgatttgtgtaacttttgatctaaatagtttaaaatcactagttcttgtggaaaaatgtgataccagttcctctgctaatcaaggtaaatgagccgtagtcagatagatggaaagacagaccaaaaa

SEQ ID NO: 249133 - DNA, 258 bp, Homo sapiens
tttggaaaaatgatattaaattgctctttgacagtggtatttataaaacttatgcaatggtagatagaaagaacagcagtgttgagaaaagttcctaagtttccactgttttaggtacaaagataacgtcttttcctcaatgatgcatttcctgttttttaaatcttttaaaaagttctttcttgttttgtgccattggacagtaatttaagaggtgaagtcaaaaagaaaaagtacaaataaaaaattgtgactttg

SEQ ID NO: 249134 - DNA, 352 bp, Homo sapiens
ttattccctaggcttgtttcagtttcacatcaacccagaggatatgagacttcataatggtcctgatggcacccagccatccactgagagctcattctcaggcatgctggcaaagtgactcagtgattttcaaacctggggagctggataaaaatgcctgtttccttccagagagtcgaatgcaaggctgtgtgtggtgcctgggatctgtagactgaagcaagcctagggaataacaaacaaacaaaacttccaatgaggtatacaacatatttccttatcttcttccactaaacatttattatgttttcagagctaagcctgggaatatagagctgactaagacatggct

SEQ ID NO: 249135 - DNA, 418 bp, Homo sapiens
cccttaaattgaattatttgactaattgataactcttgaatatttgtcaggtaattgctaagtgcaagggagtatgggaaaatattacattctactttgtggtatatttgcattgacataaatagtacactgatttacataacatggaatgatgcagcattgtagatcccaagattatgggaagcctagtttgggaagcagagacagatatattttcatgttcctaatattgtgtgtgtgtgtgtgtgtgtgtgtgtgtgtgcacgcgcattttcctgtacctgtatctatatctgtgtgtatatttgacaaaaagcaacttgatcatagattttggtaaccatatgtacaactgcatattttaacagattgttttccttttatttaattaaaaaagaaaaaattaatttgcttatat

SEQ ID NO: 249136 - DNA, 386 bp, Homo sapiens
ggatagttaaaaaggcttaccgtggctagtttttataaggaaataatttaagacattctagaattctgcaaattaaattatatatgtatgcatgtatatactttttgagacagagtctctctctgtcacacagactggagtgcagtggtacgatcatggcttactacagccttgacttcccaggctcaagcaatcctcacatctcagcctcttaagtatctgggactataggtgcatgccaccgtgccgatgaaactgtgtatttaaatggaacatggtaggcagttaagtacttgaggaaattgaaatttgtcaacaagggatcttagttatctgtattacgtattaaaagggctctagggaagcggttgagaggttaaaaaaaa

SEQ ID NO: 249137 - DNA, 388 bp, Homo sapiens
tactcccaaaaagaattatggtattaaaaaataaatgtgctttctttttccaacatgaagataatttttttctgatcacgaagataatgtatatttatttagaaaattaaagcaatattagtaattctaaggaagaaagtaaaaattactttcctccccaaccacccagaggaaacctccatttgcttttggtgataatttttgcagctgtctctctccatgcctgtaactataatattcatgttgtttttaatctgctttttcccctcagcagtatattatggagctcattctatgtcaatgaaaacttacatatatgtaatattcgattatttgtgtaaaatattgtaccagttttttattaaagaacatttaggtcatttcctat

SEQ ID NO: 249138 - DNA, 243 bp, Homo sapiens
tggtacataataggtataaaagaatgtatgaaccaacctgaaggtttaattgattttcttggttttagtttattctcagtgacaatagctttattcttttctaattatataattcatgttcattgtaaaaactttcaaacaacccagaaaaaataactctgataactttgttttctggatgtgctcagtgtaaaaaacttcattaatacagaaaaataaaggaagaattaagtcactgaaact

SEQ ID NO: 249139 - DNA, 390 bp, Homo sapiens
tgagacggagtcttgctctgtcgcctaggctggagtgcaatggcacggtctcagctcactgcaacgtctgcctcctgggttcaagcagttctcctgcctcagcctctggagtagctgggattacaggcacccgccaccatgcctggctaatttttgtattttttagtagagatggggtttcaccatgttggccaggctggtctcaaactgctgacctcgtgatccaccctcctcggcctcccaaagtgctgggattacagggatgagccactgcgcccggccgagtctttaaagaaaagaaaggaaaagagaaaatgaaagacagaaacaatgatccttggggtggagtgtgtgtcccctccctgcagccctgttggcactggctctcta

SEQ ID NO: 249140 - DNA, 543 bp, Homo sapiens
ggctgaccctgaggatcccgggaggcaatagagatatttgttaactctagactttgaaattcacatttgcgtgatcaaattgtaagtatcactaatacaaatgaactgtataattttcaaaccaataaagtgctcttaaaaagcgctgtgttctagtgcagttgacaaagtatttcacagcaccagagccaacgtttttctacctgttttataaaagatcctccccatcctccaagcagacttagaggttttctcctgtctgctcttgggtatcttggccaaatctttagagcaagtgtaatggccaatttcttgggtcaatttcctatgcctcctcatcattgtgtcccagtgcctggcatataccaggcactctcatgtttgaagaaggaatggatatgacttgctcaagttcacacagctctcaagtggcagataaaaaacagggacccagattttacctcttccaggtttgttccatcctttgacacaatctgaaaaaaaaaattgcattttaaaaaaaagttgtatttcaagaacaca

SEQ ID NO: 249141 - DNA, 536 bp, Homo sapiens
cacaatacccaaggtcccctattcttgggatcccaatagattacacctcttaatccctgtgcaccagggtgggctgtaagactagtttccatcagagtggatgtgcctcacctgagagcagtggtgccttttccacgtgtgctctttgccttacactggccaaatggagaagatttcaaaaactcagaagaggatagagccataagaaggaatgagcctggattcctaaatgactgcatggaatagaactttgcagtagctctgtaagggaatgtgaccagaatgaaagataaactttgctgtgttaagtcactggaatttgggacttgttaagcagttagtccgctctaacacaaccaccaaaggtattacagagacaggatgtgtattgatgtacctgtgagctaaggaaaggtcagataggcaaggagcatggaaattacaagtttcatgattcccaggtgtaagcgttttatgttgctcattaatcatgtggcaaatatgtttaaataaacataggcaattcctgttcaaca

SEQ ID NO: 249142 - DNA, 290 bp, Homo sapiens
acagaccccaggcagatgcagaagtgggatcccagccaaggagggtcctcgagccccaggtgccaggcaggccctcaccctccgtcctggaggcacccagcagccactacagctgttagcagaggaggaccgggctccctagctagctgtgttttgccagctgttcctgctgatggtgggtcagaggggggctgaaggcaaggaaacctggtcacagatccagagcctcagcgagtacagcaaccccatctaccctggttgcccatagcctccagcagtggggctctgta

SEQ ID NO: 249143 - DNA, 472 bp, Homo sapiens
aaaatattgtttggttgaatatcccaagttagattttgtttgtatggagaattttttgttggcgtttgtttgtccacctccagtacaaaaagaaatctaacaaactttcaaggaagtttgtcccggttctcaaaatgggatgctattcaaactgaattaattctattatacattagtatggttatattttccagatttaaaaaatgaatttaaatttattaattatgttcttaactgataatgattaaaataaccctccttgtgatagttatttgtattagaatttccatacttgatcatgtaactaaagctgtgatcaaataattaatgttatttttacaaactgtttatttgttttagtaaagaggactcatgaaagaattttaagtaaatccaaatttctaggatgtatatgtttatcacatatatgtgtgtgtgtgtgtgtgtgtgtgtctgcatgcatgttggtgtg

SEQ ID NO: 249144 - DNA, 594 bp, Homo sapiens
agagatttaaaagaagcaagtaccattttccaagtataaaactcgtaatattaaaagtgacatagcagtatattcacatgactacttaggtctaatgcagaaacaagacagtacagtttttgcagaggccgatgtgacatctgcatgcgacatgatactattaagtgtctctacccacctctgctacagagtagctgctatatgcacacatacacgaaactcattcctgctacagggcctttgcccatgctgttccagccttctggaatacttgtccttgtcctcattgtctctccccactttgcctgactagctcctacaggaagccttccctaatcccctccgaccctacccccacgacccaaccaggggcgattgagctaaccccaatcccaggacttctcccaccatgtcctaattgctgggagagagcgcctgcttgtggaaggggggtctgtggggtaagcagccctgacacctgttcctctgatccctggagcccagcacaggctgggcccatagtccaagtgaatgtttatggagtaaacgaatgaacaaatgaatgaatggaattgtgtgtgtgtgtgtgtgtgt

SEQ ID NO: 249145 - DNA, 998 bp, Homo sapiens
ctagggtctttcccctcaaacggctgcctcttgaaagtgcacaccacgatcagggtcaacatattcaacagttgaatgtatattatatgcctggcatggttctgaaaatcacaggtaaaaaaaattacatacagtcggccgggcgcggtggctcacgcctgtaatcccagcactttgggaggcagaggcgggcagatcacttgaggtcaggagtttgagaccagcctggtcaacgtggtgaaaccccatctctagtatgaaaaatacaaaaattggcagggcatagtggtgggggcctgcaactgcttcagaagagaaacaaaatcaacttagttttgccatccttacttctccatgagaacaaattttgcacatgtcttttctgtttagtggatattaaaagaaaacaaaccgtgggaggcctggagattttgcagttgatatttagatatcagttttgttgccctcactttgtacattagacagaatcctgaaaatttgtgtaaattgccattttggtaggcaaaactgtactttaagcacataaaagagttttataagtgtctatacttactatgtgaacacattacaactcatgctttacattggtgagacatggaaagtgcttctttgaaggactattcaagtatcacccactaagcagctaaagctaatattatgtttcctgcaagtattactcatacttgtttcatcaacaccacccacatttaaaaataaggctttattttgacacttaaaaattgaaagctactaagaatacatgaatgccctgggaaattaatctaattagattttagaatgtgggtgtgaagtcttctggaattagtgtttataaaggaatatttgtttcctgttttacttgtacactcatactagcttgagcctagtaatgtgtttagttaaaaaaacttttttttttaatgatgaggccaaatatgtgtattatattagagagtaatttgggggtatgtaagttt

SEQ ID NO: 249146 - DNA, 224 bp, Homo sapiens
gtaagacttctgttctcctaagtgaactccctatttataacccaatttatgaagaaggaggaaagagagaacttccagctggtgatacactctttctttcatgggactttgggagaatgatgcgtctggaaaagacattattgcagacatgcaaaagtgacacttattaatagaatgatgtcacatgagaaaaagtttttaaaaatccattttgtaaaaagaaa

SEQ ID NO: 249147 - DNA, 267 bp, Homo sapiens
attcctttattttggttagtagcagtgtcatttaccaaactgctccagccaaaaaccctggtgtcagcctaaactccacactcttctttcacctccattgtctaatagtcaccaaagtctgtcccctcctaccctagcatatctcacccttccattctcttgtttccatcccattgtcactgccctatttcaggctctcatcacttctcacctggactagagcaactgctttcttgtttccattaaaaatttttatttataattgat

SEQ ID NO: 249148 - DNA, 424 bp, Homo sapiens
agtacatgagatgatttctgtggtccctgatacacagctttcattttgagagacacaattatttgagtatctagtaattcaagcctgggattcaaagatatcatttaagatgaaactgaagactttttaagaaaaccattaaatgggccgggtgcagtggctcacacctgtattcccagcactttgggaggccgaggcaggaagattgcttgagcttaagagtttgagactagcctgggccacatggcaaaaccaaaaatacaaaaattagctggcgtggtcgtgcgcgcctgtggtcccagctattcgggaggctgtagtgggagaattgctggagactgagaagtcgaggctgcagtgagctgtggtcacgccactgcactccagtatgggtgacagagcgagaccctgtctcaaaaaaaaa

SEQ ID NO: 249149 - DNA, 890 bp, Homo sapiens
  misc_feature (48)..(48): n is a, c, g, or t
ggtaccgattgtgaataggtaggtcaggagcactctcaacttttcaanaaagcttacggaaaattataaatggcaaggccaggcgcggtggtgtgcctgtaatctcagctactcaggagactgaggcaggacaatcacttgaacccgggaagcggaggttacaagtgagccaagatggcgccactgcactccagcctggacaacaagagcaaaactccatctcaaaaaagaaagaaagaaaacaaaacaaaacacagaaatacatcaattaaaaaagtgagctattcaccagatatgttccactggtcataaaacaaaagaatacaggaggcatgacaagccatcatcatggctgttaaaataactcacagcaaaattataatgatttaagtcaataacatctaataattccagctatagtgtgcaatttaatttattatgtgccaggcacaatagtttattaaaggtattacctacctatttcacaatcggattgtgaaatacgtaggtataaatttaatatgtgaagaacgtgtacacggaaaactgcaaaatattgatgaaagaaattttaataagacctaaataatggagagagatgccatcttcatggattggaaaacaacataattaaaatgttaattcttcccaaactgacctatttcacacgattgtgaaataggtaggtggagcttgcattgagccgagatagcaccactgcaatccagcctgggcgacagagcaagactctgtctcaaaaaaaaaaaaaaaaaaaaaaaaaaaaaaaccaaggacacaaaattttttccccgggtaaaaaaaaaatgtggaccctccaaagcccatttaaaaagggcccccgggtttttcccggggttcaaaaatttttt

SEQ ID NO: 249150 - DNA, 859 bp, Homo sapiens
  misc_feature (48)..(48): n is a, c, g, or t
ggtaccgattgtgaataggtaggtcaggagcactctcaacttttcaanaaagcttacggaaaattataaatggcaaggccaggcgcggtggtgtgcctgtaatctcagctactcaggagactgaggcaggacaatcacttgaacccgggaagcggaggttacaagtgagccaagatggcgccactgcactccagcctggacaacaagagcaaaactccatctcaaaaaagaaagaaagaaaacaaaacaaaacacagaaatacatcaattaaaaaagtgagctattcaccagatatgttccactggtcataaaacaaaagaatacaggaggcatgacaagccatcatcatggctgttaaaataactcacagcaaaattataatgatttaagtcaataacatctaataattccagctatagtgtgcaatttaatttattatgtgccaggcacaatagtttattaaaggtattacctacctatttcacaatcggattgtgaaatacgtaggtataaatttaatatgtgaagaacgtgtacacggaaaactgcaaaatattgatgaaagaaattttaataagacctaaataatggagagagatgccatcttcatggattggaaaacaacataattaaaatgttaattcttcccaaactgacctatagattccactcaatgccaatcaaactccaaatattttttggataaacatcaaagtgattctaaattttatatggaataccaaggaaactagagtggccaaattttgaaaaattttaaaacagaacacctgatttcaaaacataactatgaagttacagtactggcaaaaagatatacagatcaaaagaatggaatgg

SEQ ID NO: 249151 - DNA, 649 bp, Homo sapiens
taaacaatagggcagaggaagcaatcagatatgcatttgtctcaggtgagcctcagagggatgactttgggttctgtctattctttgtcgggcacccatgaaaataagctgtcaatttacattgccagggtgaaattcaatagaactgttttagggtaaagatgttgaagcccacaaggaattcatcttttagcgatcttatttaggaacaaaatgagaggcaggcttgcgcagttcccagcttgacttttccctttggcttagtgattttggggtctcaagatttattttcctttcacacctgcgagagagactttctgatgctccttctctgccctgcgctcccatctcatctgccaactttgcgctttggctgccctgctgtccgtccccgacctgcagccctactagcttcctaaaaggcaagtttcacaaatcactcactgctcggtaccttctgtgatttcctgaggctccgggataaatccaaatttcttcacatgacaggtgggtccccatgagccagccgctgctttcctttccagacccagctcccgccacctcctgccttgtgtcaggctctgcagcacgagacgctactcaggagctggcccaccagggcctggcccagggttcacagtgactttgc

SEQ ID NO: 249152 - DNA, 635 bp, Homo sapiens
taagcaatgtcatattacagaattcaatatgccagtatcttatttttttaaattaagtaatttagtaacttgtaattatgagtcattttaaacactagatggaaagatgatgccaccgacaaagtcttaagagtagagccagaccaactgtattgtaccaagcactataggttagctttaacactggacacatgcacacacaaaatgaagttcagtaagagtcaatagcttctgcggggaaacaagcacagaaatcataagcacctcaagaggaagaaaccacagctttaaccaacatggaatatctactaacaatcgcaggaaacaggagcagctacacccagacacaagattcatctaacttggttaggtccttgacatgtgtgtgtctgtgagaagtggaagagaagggggtaagggcataaactgagtcaagaatttaataaacaccaggtacagtggctcatgtctataatcccagcaccttgggaggttgaggcgtgtggatcacttgagctcaggagtttgagacatggcaaaatcctgtctctacaaaaaataccaaagtagccaggtgttggtggtgcagtcctgtagtcctagctccttggtggggctgagatgggaggattgct

SEQ ID NO: 249153 - DNA, 1197 bp, Homo sapiens
ctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaagtgagtggaatgaatgttaaccatctgcaactttggatgcacttcaacagtttttttctttttcctcatttcctgccttattttatctttagattgagtctttatccactcctcggattcaggctatgaaggatgagtcttcatgtctttcatccctttgctccatgacccccttcctgtactagccttcccctctttatagttatggcatagttttggctagattcatatattcacattacatgtttacattatcatgactatacaaatgctatgtggagctgaagcttgtggtaaatttttatttatttttcccttcctgtatatccttttatttttttaggaagtaataactgtcctgttggtatgttagcttatttttttttcctgaggtaaaattcaggtagtaaccattttatttatttatttattattttttgtgacaggttctctctcttgcccaggttggagtgcagtggtgcaatcatggctcactgcagccttgacctctctggctcaagcaatcttcctcgctcagcctcccaagtagctgggactacaggcacatgtcttcacacccagctaattttttttttttttttttaagagacagggtctctctatgttgcccaggctgctctcagacttctaggctcaagcagtcttcccatcctggcttcccaaagtgctgggattataggcgtgagccaccatgcacagcaattaaaccattttagagtacacaattctgtggcatttattatagtacattcacaatgttgtgcaaccaccccctctatctagttccaaaacactttcatcgcccccaaaggaaactctgtatccatcaagcaggcccccctcctctctccaccccactccatgcccagcccctgggatacaccaacctaattggtgtctatggatttatttgttctgactatttcctctaaatggaagcataccgtttgaccttttgcatttggattctttcacttggcatattgttttgaagttt

SEQ ID NO: 249154 - DNA, 984 bp, Homo sapiens
gtttccaaagttttttttttccaactctcatacttaaattgactggattcctttgccttcctgtaaacacttcagagtctctttaccgactctaatctgtctttggcagagtagctgtagagatggcttaaaaagaattacacccacttttaacctgcttgtgagattaaaataatttgcaaggataatcagtaagtcatttcatcagctacagctgcaatcttcaattcaaaatttttcatctaaaaatctgcagttatttttaaggtttaataaccctaagcagcaagagattgatgatcttgaaaaaaggaaacatccatgctctcctgtaactgagaagtgctggttaaattctttaatcaagtttattggaaattttctcttaataaactgtcaattttctcctgaagagaacctctcacgttgtttgtattttcacttagaagtactcagcatacaaagcatttcttaattcaacatgacttccaggtctagcatttgactaaagatgcaagaggtcagtccaattgttaatactggattgtgtatcaacaaaatctactgaatttcgttgatatactgtgactaagtgccactccatcttcaacgtatactgttatgaacaaaatacagaggtctgaagcacacacaatatacctgccatgtgtattgatttgcctgtgactagtgaccaatgaacatctgccttaagaaaagctttatccaatccaggcttccaatacattcttcagaagatcctgatttaggttttagcacctaagttaaaggcttggcaaatatgcaagaaatatactacaaagcttagaacacaaaatcaaattaaaaccaaattatctgtagttgttaatgaaaagttctttttattaaaaaaaaaaaagtggaagtttaactagaaattctgaattttgatcaggtttagtggctcatgcctgtaatcccagcactttgggaggctgaaac

SEQ ID NO: 249155 - DNA, 812 bp, Homo sapiens
gtttccaaagttttttttttccaactctcatacttaaattgactggattcctttgccttcctgtaaacacttcagagtctctttaccgactctaatctgtctttggcagagtagctgtagagatggcttaaaaagaattacacccacttttaacctgcttgtgagattaaaataatttgcaaggataatcagtaagtcatttcatcagctacagctgcaatcttcaattcaaaatttttcatctaaaaatctgcagttatttttaaggtttaataaccctaagcagcaagagattgatgatcttgaaaaaaggaaacatccatgctctcctgtaactgagaagtgctggttaaattctttaatcaagtttattggaaattttctcttaataaactgtcaattttctcccaaaaaaaaaaaaaaaaacataaaacaaaaaacacttgtggtgggcgcggcgccttggccccctgagagaacgtttttaagaacccattggtttgggcgggccggggcccacagtagggctaccggccaccgtggcgcaaggttggacccaagggaaacccgggggacagaagacaatagcggcgcaggaggtcttctctaccccgctatttagaaagagacccccggggggggcaaacaagcgcgacatgtcttcctcgtgagaacaaactttcacagcaagtgggacgtctctccgagaggggggcaactagacgaggggagtgctatcaaacgagacgggaggatatcccccagggagaaggccgaccacattgtccaaaaattagcccccgccgacgtgg

SEQ ID NO: 249156 - DNA, 846 bp, Homo sapiens
gtgttcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaaggaccaaaggtgtggatgaggtcaccattgtcaacattttgaccaaccgcagcaatgcacagagacaggatatggccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcattttccaggtctcctttaacctctttcgtgatgctttccaacatgtctataagggctg

SEQ ID NO: 249157 - DNA, 983 bp, Homo sapiens
cggtgaccccctatcctacctccaatccatcctcggatttcgctgccttgcataagcccataatggttaaaggtgtggatgaagcaaccatcattgaccttctaactaagcgaaaccatgcacagcgtcaacagatctaagcagcatatctccaggaaacaggaaagcccctggatgaaaccctgaagaaagcccttaccggtcaccttgaggaggttgttttagctctgctaaaaactcccgcgccatttgatgctgatgaacttcgtgcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcagctgtacgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccaacagtccccgtggccatccctgtgagggtggacgttagcattacccccaacctcatttttagttgcctaagcattg

SEQ ID NO: 249158 - DNA, 1117 bp, Homo sapiens
gtgttcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaaggaccaaaggtgtggatgaggtcaccattgtcaacattttgaccaaccgcagcaatgcacagagacaggatatggccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcagctgtacgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccaacagtccccgtggccatccctgtgagggtggacgttagcattacccccaacctcatttttagttgcctaagcattg

SEQ ID NO: 249159 - DNA, 375 bp, Homo sapiens
gccagtactttatatgggagtctgccccctgaggagaaactcccaagaaagctgccagatacacaagtgatttcaggtggggtccaataccccacccctgacagatctcggtctggggcacaggaagaatgaagggcataaggagtagcaacttcctccttgtggcttcaacagtccccagagcagtgagagggcacagggtcagagcttggtgcaaaaggaatgatcctggaaaagtgagtgtggagttgggccagtgctgcttctgcaccctgtgtgccgatcagacgctttctccctgtcccacttaggtgggaaacggctctcaccacccccatagcaggaagcacaacacgcctcccacccagtaacaca

SEQ ID NO: 249160 - DNA, 312 bp, Homo sapiens
ggcacacatgtgtggtcccagctacctggggggctgaagggggaagatggcttgagcctgagaggtcaaggcctcagtgagcctagattgtgcctctgcactccagcctgagtgacagagcaagaccctgtctgtttaacaacaacaacaacaaaaaaacccacttcatatattgtatgaaaacttcatattttttgataggtggatatttgaaagtcagacttctttaaatgccacaaaaacagcactgggttaagagtcattgtttttcatttgaatccttgtcttgcacttttgtgcagtgtggtgagt

SEQ ID NO: 249161 - DNA, 465 bp, Homo sapiens
agttttcctgtacatttgttattccgaatgtcctgtgtaaccgacaggatgcctttgacttttttatgttgtacatttgttacagtcatagccttctgttaaataagaacagggctgcttacggatcgagccagcagttttcccagagaaagctgatagtaggcatatgctgaaaataataaagcaatttcattcatattggaagaaagagtagcaaaggtgctcagtagtgtacagtatttctctttggtttcccgtggttctgcacgaggaaaatggctgcatgtgataaaacgaatagagtattccttcagaaactagccatgaaaggaagcagacaggggaatgatttaagttaaagtcatgttcggcagtcgaagcagagatacaagagctatcctacagccccagagccatgctccaggaggatgctgacaccaaaataaagtgagttgtgaaaagaaa

SEQ ID NO: 249162 - DNA, 679 bp, Homo sapiens
gttataaatgcttggaatgaaaatgccttaaggaaattagtcaataatgtcacatatgttactttttctaattggatctgccatgattgctataaaactttgtccttccactatgactcatgagtaacttcaataacaaactgcttgggaattcccaatgccacagtagaactagtatatgcaaacattatttattatcagggtgcacataaagggaaactaggacaaaaacctaccctgtttcaatttgatcttgttctcttaagcatggaaaaagaatacttgttgctataactcaacaactaaaactcttgtttctcaggagaaaatgcaaaaagaaaaccagtttatttgtcatttttggttttgcaaatgctaatcaaagttggtctttatgcaatgcaatttttcccactcttaaaactgactgataacagcaaatcagactgaacctaaaaatgactccttcaaaagtactaaaagcctgtgtgcttatgtttatatatttgtctgtgaatggggaccaaatccttttatatgctggggaagaaaattccttgactcttggtcattagcaagtcagtgtacttgggtgctcatgtcactaaaatacctcatttatccctccaataacaccttcttctggccagaaggattatatttatcctgtttcaaaagg

SEQ ID NO: 249163 - DNA, 675 bp, Homo sapiens
ggaggcaaggggtgtagccctcctggtgcctggaagggctgtctgggcccccatggcgggtgctcctcactcactcaagcaccaatcatgagcctccactgagaagcttccacagcagccccagggtcagcaccaggcaccaagtgcatgccagccctggtcagtgagccttgattgaaggcctacggctcgcccaccccaaggagttcgatctgatctctgggacaaacgattcctacacagagtggagtaggggtctccacacagcatagccagccacagacatggagcctctgcagagctgggcacagcggagggaggctgagatacagctaaaggaaacagccaaggcgcctgaggagccccaagcttagcggctccattcacagacaaggaatccacgcccccacatctccttaggtggcaggagacaggcacctggccttcctcgggcgttacaacttggaaaacaagaccaggcgcagtggctcacacctgtaattccagcactttgggaggctgaggtgggcagatcacctaaagtcgggagttcgagaccagtctggacaacatggtgaaaccgcatgtcttctaaaaatacaaaaattagctgggtgtggtggcgggcacctctaatcccagctacttgggaggctgaggcaggagaactgcttg

SEQ ID NO: 249164 - DNA, 828 bp, Homo sapiens
ggaggcaaggggtgtagccctcctggtgcctggaagggctgtctgggcccccatggcgggtgctcctcactcactcaagcaccaatcatgagcctccactgagaagcttccacagcagccccagggtcagcaccaggcaccaagtgcatgccagccctggtcagtgagccttgattgaaggcctacggctcgcccaccccaaggagttcgatctgatctctgggacaaacgattcctacacagagtggagtaggggtctccacacagcatagccagccacagacatggagcctctgcagagctgggcacagcggagggaggctgagatacagctaaaggaaacagccaaggcgcctgaggagccccaagcttagcggctccattcacagacaaggaatccacgcccccacatctccttaggtggcaggagacaggcacctggccttcctcggtgagatcagtaaggagagaggagccccggccttaggaacccaggggcctggggaggtgggggccgagcccataggaagaggggtgtcatggacatctgaccatcccaggaggggcgggtacgtgctgacctctttgtttcttcatcgtgaagggcgttacaacttggaaaacaagaccaggcgcagtggctcacacctgtaattccagcactttgggaggctgaggtgggcagatcacctaaagtcgggagttcgagaccagtctggacaacatggtgaaaccgcatgtcttctaaaaatacaaaaattagctgggtgtggtggcgggcacctctaatcccagctacttgggaggctgaggcaggagaactgcttg

SEQ ID NO: 249165 - DNA, 167 bp, Homo sapiens
ttaaaaaaaaaacaaaaaaaaaacctgaattgtaaggactggagacatagacttggtagcttttcttaatttttcaccatttgtagaaatttacgcttagaaatggacttaaaaattcaggtcactgtttgtgaccagaataacgctatgcatttttggaagtaaaa

SEQ ID NO: 249166 - DNA, 356 bp, Homo sapiens
caaaaatacaaattcacaaatagcctccagacttctttttagggttagtttcaactactttcttgccacattattttttaaatcacaaatgttcatatgttatcaattgattaattttagatttatcaaaattgtgcttaccttctgataatattgcttatacaagttcaaaattgcctaaagattgggcaggattggatagcaagagagtgaaagagaatcatgaatgcaaataatacttaagattgcagaatcaccctttaattagagttaactggcaccattgtgggaatgtccgttacctacctatttatattcccttaagtagtcattgcagtctgactctggcaatgaaa

SEQ ID NO: 249167 - DNA, 755 bp, Homo sapiens
taggtctccctactctacccctagaatggaagcattaccacttctttccaccaccagctgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgggcagccccatcccagacactgggatggcatgtacatgcctgaagtatggcatgtacatggtctgtgggtatgtgtggacaacttcccctgtggttaagcataccctggcccccccaccaagttccctctaggcctgaaccctgcaccacagacccagggcctttggtgatagggctctctctctcaggtgtgaacattggcgatgtgggctgctacatctatgacccagtgaagataaaattcaaatgagacgctcacaaaaaaggtcaccctaacttacggctgtggacggtcatagtactcaatgcagagctctcgattgtagtgaaccgtcagtttcgcactggaatcgccatttcacgcatagtttgtgactctccatagacagagcaccgagagcctgatccagcctccggagtgtagcgataggtcttgcgggacaggataatcacatttcaccacaggtaatcaggctatgagccattagggcctattttaaggtgacacctactataacaacgtatggtacacacacaaagca

SEQ ID NO: 249168 - DNA, 927 bp, Homo sapiens
ccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaactgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgggcagccccatcccagacactgggatggcatgtacatgcctgaagtatggcatgtacatggtctgtgggtatgtgtggacaacttcccctgtggttaagcataccctggcccccccaccaagttccctctaggcctgaaccctgcaccacagacccagggcctttggtgatagggctctctctctcaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacagcccgttttgaagggtatcctcctcctggccatcacaacccctttccccagcacattctggagcttcaaggtactcataaaacttgtgtttattgaatttcagcctctgtggcttcttcaataaaatgttggctcccaaaaaaaaaa

SEQ ID NO: 249169 - DNA, 736 bp, Homo sapiens
ccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaactgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacagcccgttttgaagggtatcctcctcctggccatcacaacccctttccccagcacattctggagcttcaaggtactcataaaacttgtgtttattgaatttcagcctctgtggcttcttcaataaaatgttggctcccaaaaaaaaaa

SEQ ID NO: 249170 - DNA, 606 bp, Homo sapiens
ccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaactgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgggcagccccatcccagacactgggatggcatgtacatgcctgaagtatggcatgtacatggtctgtgggtatgtgtggacaacttcccctgtggttaagcataccctggcccccccaccaagttccctctaggcctgaaccctgcaccacagacccagggcctttggtgatagggctctctctctcaggtgtgaacattggcgatgtgggctgctacatctatgaccaggagataatcagagacgtacaagtcacctattcggctggcacggtcatatac

SEQ ID NO: 249171 - DNA, 881 bp, Homo sapiens
  misc_feature (787)..(789): n is a, c, g, or t
ccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaactgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgggcagccccatcccagacactgggatggcatgtacatgcctgaagtatggcatgtacatggtctgtgggtatgtgtggacaacttcccctgtggttaagcataccctggcccccccaccaagttccctctaggcctgaaccctgcaccacagacccagggcctttggtgatagggctctctctctcaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacaccactcnnntataaactatcccactatagacaactcaacctcaaacagacaacccagaccgagtcacccaacactgacaacaaatgcaatgcaaaccaaca

SEQ ID NO: 249172 - DNA, 430 bp, Homo sapiens
ccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaactgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaagccctctaggtcctgcctgtttcttgcctgcctcacccagtggcatcacgatgatggtaaaaccagccagggctgagccagtaagggtgcgggtgatggcaaacatta

SEQ ID NO: 249173 - DNA, 678 bp, Homo sapiens
ccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaactgagaaggtgatgtcattaggcagaaattggcaccgaccgtgtctgaggtgccagcgttgccacaagaccctgactgctgggagtcatgctgaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacagcccgttttgaagggtatcctcctcctggccatcacaacccctttccccagcacattctggagcttcaaggtactcataaaacttgtgtttattgaatttcagcctctgtggcttcttcaataaaatgttggctcccaaaaaaaaaa

SEQ ID NO: 249174 - DNA, 667 bp, Homo sapiens
aggctggagatgggaagagaaccaggctgagacagctctctttctctctgtgtctcagcatgatggagtcccctactgccacgtcccctgctacggctacctgtttggccccaaaggtgggcagccccatcccagacactgggatggcatgtacatgcctgaagtatggcatgtacatggtctgtgggtatgtgtggacaacttcccctgtggttaagcataccctggcccccccaccaagttccctctaggcctgaaccctgcaccacagacccagggcctttggtgatagggctctctctctcaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacagcccgttttgaagggtatcctcctcctggccatcacaacccctttccccagcacattctggagcttcaaggtactcataaaacttgtgtttatt

SEQ ID NO: 249175 - DNA, 258 bp, Homo sapiens
ataaaggagagattaagccttggagcaggaactgcttagaattacttaccggagagaaatttattgcccttgcttttcttcagactcccagctctgcctaggagccatttccattcgttgaacttgctgttccttaaatttcttctctcagatatcctaatgttctctccctcacctcacttggcctaaaaggcctgttttcggtgaggacttccctagcctactatgtatttaaattgcaacctcctccaactcata

SEQ ID NO: 249176 - DNA, 512 bp, Homo sapiens
ccttttcttcttttccaaattgttttgtagagataggttctcaatgtgttgcccaggctggtctcaaactcctggcctcaagtgatcctcctgccttgggcctccctaagtgctgggattacagacatgagccactgtgcctggacgaacctcttttaatctgtaacagcctcctgcctcggttaagtccagtccagttgttttgcagaatgtcccacattctgatttgtctgtttcctcacaattaaattcagcttaaacattttctgggccagatgaggactcatgcctataatcccagcactctgggatgctgaggtaggaggattgcttgagtccaagaattcaaggctggacacagtgagaccctgtctctacaaaaaattttaaacacgaggctgggcacggtggctcacacccgtaatcccagcaatttgggaggctgaggcaggaggattgctcgagtccagaagtttgagactagtctgggcaacaaagtgagaccctgtctc

SEQ ID NO: 249177 - DNA, 305 bp, Homo sapiens
ggatggaaaaagtaaaataaatataaacctttgccatcagatgtggtaggtgcttattaggctgtagctacacaggacttccacatcactgagtagaaatccatccatagaaatgaaagggaaggaatgcagtagggatagaaaatttgtcctcaaatacttctataggtctcccatatgattttttttcaatatagtagtatttctgacagagaatgaactgtttttcattactaaaggcattacctagttaagtttctatctggagataatgtacctgtttacctgtgaaagaaaaaaaaata

SEQ ID NO: 249178 - DNA, 459 bp, Homo sapiens
taccttttcttaaatagagttggggtcttactatgttacctaggctagtctcaaactctcaaactcctggactccagcaatcctcctaccttggcctgaggccaggagtttgaggccagcctggccaatatagcgagaccccagctctattagaaagaagaagaagaagaagaaaatctgcctgataaagagctaaagaagcagcctcaagctgctagagccacaagcgcccctggaactgtgcacttaaatagcattgtctttagcactagcataactgggcaaaaggagcaccatctctgtaacctataacttgaatggtgcttgcccccttggagttgttcaaggagtctagactggccaaagcaggcaaccggcctggcttcaataactatgcttggaactttgggccttgaggctaagaggtgtgttgtactatttcagcatgttttatgaatt

SEQ ID NO: 249179 - DNA, 441 bp, Homo sapiens
ctgtaaagtggtgaaaattacaaatctttccttagaagtgatggtaagtatttcaacaatgaactgtaagtaaaaaatcttaggaatatctcaaagttggtcagcaactacatttttcttattccctagataggatcatccattcacttattcttagggaaatttaaccactagcagccagatattcacctagaaaagttcggaaaatagaaaatgcaactgagttctttctattatatgtcgtattccatcaaagtatcagtgaacgcaccatcgtggattaatcacattagtaaatttaatatcttacatgtccagctagtgctataattctagaaattcaattcttctttgatattaccaagaaaggagaaatttgtcattcttgttctatgaagaactgactcacatgtgacttaattgttgaagtcaactgtgcat

SEQ ID NO: 249180 - DNA, 595 bp, Homo sapiens
tattttaatgtgtctgaatacttgttcaaaggctgagtcaggaagatgaagttcagctctgagaagaggctgcacagggcttcttaaccacctaagaatcatgataagatgacttccttgttagtttaccttctttggcgaaatgtcttcttagaggtcctttcaattgctaatgcacacccagagatacagccagagacttttcctgaactgtgaatccataacactgaaaaccctcctgtcaatctgcacaaagatgagctttcagaaacaaatgtttgacaacatcactttgaatcttatttctgaaactaccgaaagtttttggggatttattcattcaacatttgacaaatatttactgagcctctactacatgccaggcaatgttctaggccagtgcttctcaaatattaatgtgcatatgaaccaccaagggatcttgttaaaatgcagatcctgattcaacagagatgggcagagggctgagattctgaatttctaacagcctcccaagcgatgtccatgggccacatgttgagtagtgagggtctgggcactggggataaactggtgaacaagatagatagttcct

SEQ ID NO: 249181 - DNA, 742 bp, Homo sapiens
cgcgggtccgccctaggcgctgggctccagggatcggctccgactgctgcagttcgggccttattttagggtgaagcccgggcagccgacccggctgcgccgtagtgggaggccacggcgattacccaggtgaaggtcttccaggtgagacgggttcccccagcccagccctggaaggtggaaaaagaaaagttgacatggaatgtttaggaagcaccattggtccaggtccaggatcggggcagccagcatgtcctctaatctggcttcactgttgaaatccagtcgagcaagcagggcccaaaccactgcgagaccagctcggtcgggcccaaaccaccgcccactgcgggaccagctcggtcgggcccaaaccaccgcccactgcgggaccagctcggtcgggcccaaaccactgcccactgcgggaccagctcggtcgtggagaccctaacccagcggcgctagaggaattaaagaaacacacacagaaatataggtacctcgcaagggttttttgcatgtctgatacctacggctccaacaggacccactgactgatgatggctccacctggacctgccaactactcctgcagccccacccagaagcggttcagcacacggggaggatcctgtctcacaccctacggattgggccccccgcccccaaaaaccatcaagaggaaagcacccatgccaagtaccccaccttccccaaaatactttggaaacctattccc

SEQ ID NO: 249182 - DNA, 949 bp, Homo sapiens
cgcgggtccgccctaggcgctgggctccagggatcggctccgactgctgcagttcgggccttattttagggtgaagcccgggcagccgacccggctgcgccgtagtgggaggccacggcgattacccaggtgaaggtcttccagcccagccctggaaggtggaaaaagaaaagttgacatggaatgtttaggaagcaccattggtccaggtccaggatcggggcagccagcatgtcctctaatctggcttcactgttgaaatccagtcgagcaagcagggcccaaaccactgcgagaccagctcggtcgggcccaaaccaccgcccactgcgggaccagctcggtcgggcccaaaccaccgcccactgcgggaccagctcggtcgggcccaaaccactgcccactgcgggaccagctcggtcgtggagaccctaacccagcggcgctagaggaattaaagaaacacacacagaaatatagggtgtggagtgggaaatcaggggtctcacagccttcgaagctgaaagcctcgaacagagatttacccacatatttattgacagcaagccagtgataagcattgtttctatagattatagattaaaagcacttcttacgggaaataaagggatgggtctggctagttatctgcagcaggagcacgtccttaaggcacagatcgctcatgctattgtttgtggttcaggaactcctttaagcggttttccgccctgggtgggccaggtgttccttgccctcattccagtgtgggagtcatggccatcatgagcatgtcacagtgcagcagagattttgtttatggccagttttgcggccagttgatggccagatttgggggcctgttcccaacagcccacagccagacctagactccattcagattggttttgatcagcatgtagaaaatgggggagttgagtgtggtata

SEQ ID NO: 249183 - DNA, 361 bp, Homo sapiens
ccaggagttcaagaccagcctgggcaacatagtgtctctacgaaataaattttaaattagccaggtgtggttgctataaatcccagctacttggaaggctgaggcaggaggcttatttgaggccaggagttcatgattagcctgggcaacatagcaagactctgtctctaccaaaagaaaaaaaatctaaaaacattgtacatcagcagttatttagatttaactataaagatttttgttttctttgttcattatggtttcttgcatcccagatgttattttttcctgtatttttgttttgctgtaatacttatttctttcagaaatgtaatacaggtggtaaactttgaaccttagtatg

SEQ ID NO: 249184 - DNA, 406 bp, Homo sapiens
tttgtagatgtctatctgtggcgtaattgtaatctgaaactttgtgtttagtggcaagaaaagccgtcccacagcattaagagattctttaaaaaattaagacctctgccaggttcggtggctcatgcctgtaatcccagcactttgggaggccgaggtggacggattacttgagctcaggagtttcagaccagcctgtgcaacatggcgaaacccgtctctactaaaaatacaaaaattggctgggtatggtggcatgtacctgtaggcacagctacttgggaggctgaggcaggagaatcacttgagcccaggagggcaaggctgcagtgagctgcagtcacaccactgcactccagcctgggcaacacagtgagactctgtcacaaaaaaagaaaaagaaaaa

SEQ ID NO: 249185 - DNA, 447 bp, Homo sapiens
ttagattctgtctaaacacattaactttgggattcttatgatatattcaggtgagcaaaggaggaaggtgagaggagaaaaacagcttccagagtcaccagcagatgagctgttccaactcattcacgaaaagaaaacgacacttttaaaaatggaagatggtggctgggtgcggtggtagctcacgcctgtaatcccagcactgtggaagtctgaggcaggcagatcgcttgaggccaggagttcgagatcagctaacatgatgaaacgtcatctctactaaaaatacaaaaattatccaggtgtagtagtgcaagtctgtaatcccagctactcaggaggccgaggcaggagaatcgtttgaatctgggaggcggaggcttcagcgagccaaggtcatgcccctgcactccagcctgggcagcagagcgagagactctgtctcaa

SEQ ID NO: 249186 - DNA, 139 bp, Homo sapiens
tttttgtattaagttggaaatgaggcaacagttttattcttccatgccaataatcacagcaccatttgttgaatatggtgccctttccccattttgtttttgtttgctttgtcaaagatcagttggctgtaagtatttg

SEQ ID NO: 249187 - DNA, 405 bp, Homo sapiens
tccctgaccctactggagctaagggtcaaatatgtaccagctgggcacacttgggacagctccagggcttccccagccttggtgttctgggtgtttgcagataagcagcagaaaagtgggcctggcgcagtggctcgtgcctataatcccagcactttgggaggccagggcgagtggctcacttgaggtcaggagttcaagaccagcctggccaacatggtgaaaccttgtctctactaaaaatacaaaaaactagccagcatgatggcaggcgcctgtactcccagcaactcaggaggctgaggcaggagaatcgcttgaacctgggaggtagaggttgcagtgagccgagattgcaccaccgcactccagcctgggcaacagagcaaaactctgtctcaaaaa

SEQ ID NO: 249188 - DNA, 468 bp, Homo sapiens
atggttgcatatttttgcactgagatttctatgtgtagaaaataaagattctacagttaaatcataagtattaataagtttaggtgaatgctgaatccaaaatcaagatgcaaaaccagttgtatttctatgtatcactagcaaatagaaaataaaatataggcagggagttttacacctgtaatcccagcactttgggaggctgaggcaggaggatcgtttgagccaaggagtttcagaccagcttgcacaacatagtccagcctgtctctacaaaaagttaaaacaaattagccaggtgtggtggtgcatgcttgtagtcccagctacttgggaggctgaggtggtgggaggatcacttgagcacaggaggctgcagtgagctatgattgtgctactactgcactgcagcctgggtgacagagggggaccctgttttgggtttttttaatttaaaaatatgtttac

SEQ ID NO: 249189 - DNA, 594 bp, Homo sapiens
aattagagaccacccgtttctatttatggtggagccggcgatcggcgtgcggttggaagtggtgtccctgaggcacctgctcgcccttttcctgcgcctccgcaacgtcggctgcgaatgagtctcctaaaggacgcccgggaggatcggaaacagccgagtcccggcgcgggcagtgtcctgcgctcctccccggggtctggccggggtgggcccgaggcccccgggcccccggttaccgccgcgggcgcgtctgcgtcctgacccggagggacccgcgggccgggccgtaccagtgatgcaagatggtcctttctgagcagagctcccctcgctcagtgctcctttgtttcacgtagaagatcttcttgaggggactgtgtggccagtgcagcccaggcctccccaccctgcaccgttcaacagaagagcagctgacgcagggggccctcaacatgctcacccaaaagtcagcgagattctgcaccggcccactagccttccaattgtaaactaaaaataaaatcttggccaggcacggtggctcatgcctgtaatccccgcactttgggaggcagaggcaggtggatcacc

SEQ ID NO: 249190 - DNA, 549 bp, Homo sapiens
  misc_feature (1)..(1): n is a, c, g, or t
  misc_feature (152)..(152): n is a, c, g, or t
  misc_feature (215)..(215): n is a, c, g, or t
  misc_feature (229)..(229): n is a, c, g, or t
  misc_feature (284)..(284): n is a, c, g, or t
  misc_feature (302)..(302): n is a, c, g, or t
  misc_feature (407)..(407): n is a, c, g, or t
ngatttttagtaagcacatccgattttccaatatggtcataaacagcaatttaaattcatgtttcattttcacttgtatttacctccgcgttttttgagattttcagttttcattttacttctgcttctaaattcaggccctttaaaatcanctttgtcttcattcagcactggctctggctgtacaatcactgtacctagaatgatttcatttnaaaaccattacacntattaaatgtgcaagtgaagtacaagacttcagttcagataaagccaacattgcnggtacatagtttgtttcnttcaagctttagatattggtgtaaggacctcacaaaagtaaataaaacagggaaatagtaaaagggccaggtgtcaacagtttatttgttgaaatatagttcatnaaaacaggaaagggaggtattatggagtgattacaaaacaaatgtgtgaatcaaacagaaagcctcaacccagttctgaatttttatagtgcctatcacaaaagctgttatgaatatgaacatctatgctaagttccataaa

SEQ ID NO: 249191 - DNA, 445 bp, Homo sapiens
caaataaatattaaagatgtgaaaataatctgaaagaggactcctcagtgtgtttaggttttggctctgttcaaatttttctttgttgttaatcttttatctggtttagtaaaatctagtttgtttctaaaatgttacgctttttttttttgagacagagtctccctctattgcccaggctggagtgcagtggtacaatctcggctcattgcaatctctgtctcctgggttcaactgattctcctgcctcagcctggccaatatggcgagaccctgtttctactaaaaaagaaaaaaaaaatagccaggcatggtggcactcacctataatcccagccactagagtggctgaggctggagaatagcttgaactcaggaagcagaggttgcagtgagctgagatcacgccactgcacaacagcctggatgacagagcaagactgtc

SEQ ID NO: 249192 - DNA, 490 bp, Homo sapiens
acagcccggaagggccccggctggatggaactgtccatcttcaccaccaccatcagccgggatttgtaggtgagaggatcttctgccatctcttcctggatgctcacaaaagctcggctccaggaagacagcacacgacccctgcccgatggaatcttactctgttgcccaggttggagtgcagtgagtgcaatggctcactgcaatctctgcctcccaggttcaagtgattctcctgcctcagcctcctgagtagctgggattacaggcatgcaccatgatgcccggctaatttttgtatttttagtagagacagggtttcgccatgttggccaggctggtctcgaactcctgacctcaggtgatctgcccaccttggtctcaccaaagtactgtgctgggattccaggcatgagccaccacggtcggccagaaacacctttaaaaagacaatactacatcatgatcaggtgggtttaagagtctggaa

SEQ ID NO: 249193 - DNA, 675 bp, Homo sapiens
acagcccggaagggccccggctggatggaactgtccatcttcaccaccaccatcagccgggatttgtaggtgagaggatcttctgccatctcttcctggatgctcacaaaagctcggctccaggaagacagcacacgacccctgcccggtaggtaccctgttccgttgcaccgtaagatcccgtcgctggtggaagcacggaggccagcaggaccggagcccccagcctcatccacgctctcgcacacgtcaaagctggctgctcggagcaggaagtctcgcccatggtggtggtggtgatggtggtggtgttgatcagagtggccctggtggtcctctgggtgggtgccccctggctccgaggggccccccagctccccctcactcaggtccatgaggaacaggtcatagaacttggaggaggaggtggagaggtagatcttgtgggcaaagatgcgcacccgctcctgcagcaccaggatgacgtccgcgcagagcgggtcctccaggaggtgggcggggcactcctcgctgctggagggagggtcgggcaccacgatgatcgggggcggtggcttggggggtaggaagggtgcctgcagcagaggccgctgcacattgcggaggtgggacttccagaactgcaggtggcggcgggagatgagtgcagctcgg

SEQ ID NO: 249194 - DNA, 685 bp, Homo sapiens
ggtataataaaaatacacacacacacaaaatttaatttttacaaaaagcgaatgaaatatattttgtgttgagaagtttgtgaaatccttacaatttttttgagactcccagaatggtggtcggacagtatagcatgatggtggacagtatgggttttggggccagacttctgcaaaacctcagttagtaccttacaaacccttccttcctttcttggtttgccatgcttcaaacataaaattgtatctagacttttggctacaggggattaaaagatgtttattaggaggtcacaaatacaaattttctcttccatgtctgactattttctttttgttctaagagttttgataaagttgcttggaatactcagattgcatgattacacacagttggagtcctacaaaaaatttcatgaaggaattgaggattattaatcatgtgatccatattgaagtcaaagaagatctatatgacgaatagcctgtaaatgtatcttctggtgtgtgtgtgtgaagtgtggtggtatgatagaaaaatcctcagtaattatgtctctatttataaactcttcagactgaaggtactggaggactttgttatttaaattaaatttatgtgtagcttttttttttttggaaatgcaatactcatcccctaaattacatgttctgtaagtttttt

SEQ ID NO: 249195 - DNA, 260 bp, Homo sapiens
tgtctagtgtaggtgcaaaacatttctgaccagatgaacaataaccccaaatattattgttttattgccctgtaggaaatgaaccattttgtatctagctttgcaatcttattccggtattctcttttccttccctcctttctctctcgttttctatctacctgaatatctttctcatatcctcctttaaaccagctttgtcatcctactattcccttcatcaatgagttaaataaatttttggcatgtgtttactaaac

SEQ ID NO: 249196 - DNA, 401 bp, Homo sapiens
accagatgtttaactttacttcacaaagtaataacctagttaactgacttcccatattgtaattaattgcataatgaaaatatacttaaagtacactgacggctgggcgcggtggctcacgcctgtaatcccagcactttaggaggccgaggcaggcggatcacctgaggttagcagttggagaccagcctggccaacatggtaaaacccagtctctactaaaacaaacaaacaaaaaatacaaaaattagctgggcgtggtggcaggtgcctgtaatcccagctactcaggaggctgaggcaagagaatcgcttgaaccccagaggcggaggttgcagtgagccaagatcgtgccattgcactccagtctggagaacaagagcaagacttcctttcaaaa

SEQ ID NO: 249197 - DNA, 989 bp, Homo sapiens
caacctgtttttaaggccttcagtctgagactttattttgtggagatacaaactactttttagtcatttccgaagcagacgggacagcagaggctgacaaaccacagggaccattttaaatcctgggccttttcttctgggaagttaggcaagaaccttcccaaatgtttgcccgtcaggctctctgccagggagtgactcattccacggctccccacaggcatattttatttgggggtgggggacgcagcgagggcttggccttgatgggggaaggagagggggcatttccagcaaacccagaaggtgttttctttttttcattttcaggagaaaaaagaaaaagaatgtgggtcttttttgcttccttccaggttttgtttgctaaaagaagacgtccaaagttcattcggtaagctcaaactcgctgagtccaaactcgctgagtccggggcaggcgcttccagacggctctgcgtccctttcaatgaaattcttcttccattaacgacagggtttttaaacgtgcctccaagacctgcctgcacgtactgtacaccaaactaaggcgacattttcccccaaaaaaggcaagctgaatttggaaaagtcagaccaactagggagctctggaatttctaaagtttgccttaaagcaattaagactttcagctgcaaagattttcaacagttagagagcacgcacacacacaaaagcctgtcagtcaaaactgcaaggacagacctcggaagctggtgtcccaagcccgctgtgatcaatttgttactgtcctgggattcacacttggagcctaggagaggtataaataaatcaaaagatccgtctacttagcagggcaggcagagaggcccccacatacacaggcaagtctagggtcagccccccaggcctggctggagagagacaagaacaaagacaggagagcctggaggatatttaggaaaacacacgtcctcgggtgcccggc

SEQ ID NO: 249198 - DNA, 691 bp, Homo sapiens
gcctgtcttaacctacttggctttgcagcatgcaacaggagcaaagcacgacaaaggcagccagatgtggtttaaggttttgtttgctaaaagaagacgtccaaagttcattcggtaagctcaaactcgctgagtccaaactcgctgagtccggggcaggcgcttccagacggctctgcgtccctttcaatgaaattcttcttccattaacgacagggtttttaaacgtgcctccaagacctgcctgcacgtactgtacaccaaactaaggcgacattttcccccaaaaaaggcaagctgaatttggaaaagtcagaccaactagggagctctggaatttctaaagtttgccttaaagcaattaagactttcagctgcaaagattttcaacagttagagagcacgcacacacacaaaagcctgtcagtcaaaactgcaaggacagacctcggaagctggtgtcccaagcccgctgtgatcaatttgttactgtcctgggattcacacttggagcctaggagaggtataaataaatcaaaagatccgtctacttagcagggcaggcagagaggcccccacatacacaggcaagtctagggtcagccccccaggcctggctggagagagacaagaacaaagacaggagagcctggaggatatttaggaaaacacacgtcctcgggtgcccggc

SEQ ID NO: 249199 - DNA, 811 bp, Homo sapiens
ctttgatgtgttttcagtgattaaaatgtcatttcccttccttcccacttccttagtcctccctccctccctccctccctttttcccccatccccgccacgtccttcctttctttttttttttttaacttttattttaggttcaagggtacatatgctccttccttccttccttctttccttccttccttcctttctctctctctttttctttctttctgttcattcttgaagacctacctcaaatgtcacctcctctttgaagccttccttgaccctttcaggtagaattagctgcccaacccccaccccacaattaatgctaaagaagcagggaatcgatccccatgatctttgaatctccagactcttacatggcatctgaaagggaacatgattgttgatttcaattaaattgaatctcaaccttctcactaaagaattctgaagagttttaaaaagtataatttcgtccctcaacctatcctatctctacactaccactatgaagactacggatgtaaatgctgtgttttagacctgaaagtcaaacaaaggtaggaaagcaatgaaccacttctcagacttttctgccaatggatacaatctggaatctccgtattctcccaaagaggagcacatctacaccaaaacttggattttgctttatttctatttctactttgctctgagcatcccttctgctgcacatctcagctctagtcaacttgatctgaggttgagaagcaggcaccgttggttctcagacccacggggtaataagttgcatgtaatgtgggctcagcagggtg

SEQ ID NO: 249200 - DNA, 576 bp, Homo sapiens
ttttttttttaaatacaccgctggccaggcatagtggctgttgcctataaccccagcaccttgggaggccaaggcgggaggatcacttgagcccgggaatttgtaataagcctgggcaacatacactctgtctctacaaaaaaataaattagctgggcatggtggcatgtgcctgtgttcctagccactcagaggcaaaggtaggaggattgcttcagcctgctacagtgagatcatacccactgtactccagcccagatgacagggagagactgtattaaaaaagaatcttgcccctctgatgagctgaaggatgaatctaatgaccacctttctagggccttcataaatttgaagaatacagctaacataaaatggacatcaacagacctggcgtgatggctcacacctgtaatcctagcactttgggaggcagaggcaggtgccatctattcttgccatagctatccacaaattagtatttgcaggcaaatgacagtaagttttaatttttttttttttttttgagatggagtctcactctgtcacccaggctggagtgagactctgtcgcaa

SEQ ID NO: 249201 - DNA, 633 bp, Homo sapiens
ttttttttttaaatacaccgctggccaggcatagtggctgttgcctataaccccagcaccttgggaggccaaggcgggaggatcacttgagcccgggaatttgtaataagcctgggcaacatacactctgtctctacaaaaaaataaattagctgggcatggtggcatgtgcctgtgttcctagccactcagaggcaaaggtaggaggattgcttcagcctgctacagtgagatcatacccactgtactccagcccagatgacagggagagactgtattaaaaaagaatcttgcccctctgatgagctgaaggatgaatctaatgaccacctttctagggccttcataaatttgaagaatacagctaacataaaatggacatcaacagacctggcgtgatggctcacacctgtaatcctagcactttgggaggcagaggcaggtggatcacttgaggtcaggactcaagaccagccttgtaatccacctgcccagccacatgccatctattcttgccatagctatccacaaattagtatttgcaggcaaatgacagtaagttttaatttttttttttttttttgagatggagtctcactctgtcacccaggctggagtgagactctgtcgcaa

SEQ ID NO: 249202 - DNA, 783 bp, Homo sapiens
gaattaagtggaaatctacaaagtagccagtctactggttctgtagtggtcaacctattaaaaatggtttttaatttctaaagtactttatgccaaatataacatgtttatggtatatgcctgactgtagaattataactcaggggaataacgacttatttaaatgtaacagatctattcatagtctgtaaagaacaattcatcctctgatcttgtttttcagattaagcagtgtgtttattaaaaattattatcatcgcaatactaaaaagatctttagattgctgctaatctgattctgcattttaactgccttaaattctacattcacttgcaagtgggggccacagtcaggttggcaacaagttttgcagacaaaaggaaatcctggttgtaaatcccatgatatattgtactcaattttgtatatgatactgtctaatgtgctgtgctgccttattaaagaactcgatgtccatttggtttacattagagggaaacttaactgcagcttaacatattgttcattttcaacactgtcacgttacattcgtggggggcagattttaatttctttatcagtaatcaactggaagtttctttttgttaaattaaagcaagaaaggttttaaaataaagggcatgggggtaggacgccaccttttggtgataaaacaaatagaaatcccttctgaaaacagatgttcctgacataattttatttttaattacaccaaggcaaaggtgcttgtccccatttcgttatattttaagtaacaggag

SEQ ID NO: 249203 - DNA, 471 bp, Homo sapiens
cttgttttagagaagggggttcacctgggacacccctgagctttgtcccaagcctcaacaagccactcacttcccacttgggagtagtttctctgcacgcaccaggcagtgggaccagggaagaaatcgcgtccgctaagtggtgtcgtctgcctgcaagacctgcacagctcccaggcctatggctttgggcaccaggacggtgccggctgaaagggaagtgtcagctgttcttctgtctttaaaaggcagcaaagaaaaaagcgcagggttgggtttcgtaacgtcagaggaggccaaggacacagcatggaatctgacgggaaacgcatgtgggcgaggaggtgatgggcttcaaggcgcggctctctggtcgcaagccgcctgttctcagaatacagctggctgtgttgtaatcgcacgctgatctcacaataaataacgtgtgcatggaacgtgccttcaaaaaaa

SEQ ID NO: 249204 - DNA, 467 bp, Homo sapiens
acgtgaccctctgtcctctgctatgctcaaaaatcataacagctgtcatttcctgagcacctgcccggaagcagatccttgcctgatctcattttattcccacagccacccaggatgcagatattatgatccggttttacacacaagaaaatttgtctttaggctcaaagataagaagtgactttccagccaggcacagcggctcacgcctgtaatcccagcactttgagaagccgaggtggtggatcacctgaggtcgagagttcaagatcagcctggccaacatggcgaaaccctgtctctattacaaataccaaaattagccaagcatggcggcgcacaactgtaatcccatctactcgggagactgaggcaagagaatcacttgaacccaaaagatgaagattgaagtgagctaagattgtgccactgagctccagcctgggcaacagagcaagactccatct

SEQ ID NO: 249205 - DNA, 410 bp, Homo sapiens
aaaataaaaaataaaattcacgatactccccaaaagctgatgataacatgtaagaagcgacttgattttaccttctaactctccctcccttttagcacaatgctgcaaaatgactggctcataaaccactaagctgccttggcagccacttgttattgttaccagtaggtaatatgctgttttcttctgcttggcacataagcagtaggcatgaaataattgcttaatggataagtaagttgttaaattataaaactctgatggattgcttagtcctttaacaatttacacccccctcccacttatccaattcttttgtgacagattttgcactagcaaagtgcactgtttcagacaatcaaggaaataaaacatttcttgatgaaatcctacctcgcctcaacaggaaa

SEQ ID NO: 249206 - DNA, 371 bp, Homo sapiens
aagaaaacaagactggtgatggttggtgtcagcatgctcagtgaggaggctgagagcccagcatctagagtcatggatagacacctgggttctgaccactgttcctaccaagtcttactggttgtttggccttgggcaagttgtttaacctctctaggctcactttctttatctgttaaatagagacaataaaaggtcacacctaatattttgcatgcacaatcacacataaatgtgaagtgctttgtaagctgttaaccatcatctaacatactaacataaaaaggaggggaagaaggaaaatatgcatgactcacaagctccagtgaccactgctagcaatacaccctggggttgaaacagtccctcat

SEQ ID NO: 249207 - DNA, 466 bp, Homo sapiens
cacatatgcagctgttagcactatccgtctccagaactttttcatcatctcatttttgaaacaaggatgatattctcaagggattgttgtgatgattaaatgaaatatgagatgaaagtgctagcacagagagggcactctgtaactttactccaaggtttgaagtcttcccgtggtgagctatctaagcctgctgcttgggctagctgagagttcttttataaatacccaaggtggagacaggagagcagtacgtttctgcacttggtggtgtcagggttgaagtctggttgcctgttgcttcgtgagggtggttattagtttcacctggacttccgcagtgcagcctgctgtgcgtttttccctacccccaaattacagctttgagtctttcatgtgtctctgttcaacagctactctgtgtctgtgggctctgaaataaaggctacattttcagtttcctgtg

SEQ ID NO: 249208 - DNA, 397 bp, Homo sapiens
gggagtggggcacacaagtaactgaggacaagtatcacaagcaacgtaagataaagtgcaaaagccctactgtgggttgttcttagagtgtttgatcagtaaagaggtctgtgtggccacaataaacagagggaaaggggtggaagagaagatgggaccctgcagatcttgaaggctaggtagggatggtgaattttattctgagtgggtggaaaatcactgaaagcctgtgaatcattcgtatattaaaaggatcactttagtggatgttgaaaatgtgttttagagttaagggtggaagcaaggaaaccagttagaagaactctgcaatggtccaagcagaggtatccacagcggtaaagagagggtgaagaatgggcaggttctagagatgctt

SEQ ID NO: 249209 - DNA, 272 bp, Homo sapiens
cctgactaataatatagtagccgacttatgcagggcaagaatttaaactatacacaatgcttttaattgatactggtcataaaattctgaaacaatcaacctacttaagatgtagccatttaactattatcaaatataaatgcttctatatgacagtaccagtcttcaaaccacaatatttctacttttaccaatacaaataaaattaatcacctgacactcaaatgtttttaagtaccttataaaataatttgcaatattttttaaatgga

SEQ ID NO: 249210 - DNA, 611 bp, Homo sapiens
tggcgcatgtctgtagtcccagctactcaggaggatgaggtggcaggatcgcttgagcctaggaggttgaggctgcagtgagccaagattgtaccactacacctcttggtaacagagcaagactccgtcttgaaaacaacaataacaatggaatactattcggccatacaaataatgaaatcctgccattcgtggcaacacggttggtactggaggacattatgttaagcaaaataagccaggaacagaaatttaaacactgcatgttcttactcatatgtggaagctaaaaaaactgaactcatggagatagagaaacaataacgattatcagatactggaaaggacagtgggaagagaagtataaagaagggatggttagtgggtataaaaatacagttagaagaactaagatctaatatttggtagcaagatagagcaagtatagttaacaataatttattgtatacttcaaaataacaagactggaattggaatgttcctaacaaaaagaaatgataaacgtttgaggtgatgagtatcctaagcacacattatatgcttgtatcaaaatttcacatctccataaatatttacaactattatgtatc

SEQ ID NO: 249211 - DNA, 691 bp, Homo sapiens
gagatggagtctagctctgtcgcccaggctggaatgcagtggcgcaatctcggctcactgcaagctccacctccccggttcacgccattctcctgcctcagactactcaggaggatgaggtggcaggatcgcttgagcctaggaggttgaggctgcagtgagccaagattgtaccactacacctcttggtaacagagcaagactccgtcttgaaaacaacaataacaatggaatactattcggccatacaaataatgaaatcctgccattcgtggcaacacggttggtactggaggacattatgttaagcaaaataagccaggaacagaaatttaaacactgcatgttcttactcatatgtggaagctaaaaaaactgaactcatggagatagagaaacaataacgattatcagatactggaaaggacagtgggaagagaagtataaagaagggatggttagtgggtataaaaatacagttagaagaactaagatctaatatttggtagcaagatagagcaagtatagttaacaataatttattgtatacttcaaaataacaagactggaattggaatgttcctaacaaaaagaaatgataaacgtttgaggtgatgagtatcctaagcacacattatatgcttgtatcaaaatttcacatctccataaatatttacaactattatgtatc

SEQ ID NO: 249212 - DNA, 305 bp, Homo sapiens
acattgccccaattaatgtttgaattcactgaacacaaggtaggctagcaaagtagagagtaatatctttgcctcaccttggccacaaggatttattttgtcagtaaccaagtttagtgtactgctatttagctttttcactacagatgtgaaaatgtttctttttggggtttgtttgaaattttctttcccttttcaatttagcagtgctgaacctatcctcaaataaatttacatttttcccattaaatcaactttgtttctgttccatggttgaagcaaatactttataaagaaaaaaatca

SEQ ID NO: 249213 - DNA, 413 bp, Homo sapiens
tttaaatatggtagctcacttatttctcccttctctcctaccccaaaacacctcacctagttctccctgaggcagtggtgaggagcaaaaaaatagaaatgttccttctgctggtttttattctttcttttattgaataaatattttccctaacacatggttggtcctgcccagaaaagcaatgttatatcaggccaagcttcagcctgcagggggtttatccttaataagtggagatgacccatgcatacaaattataagtgcagaagatggaaagtggtaaaacctcataaaaaaaacacaaggagccacagaaaaggaagagtttgcatccagctgagcggtgtgggaagggcactgtggaaggcatgcattggatctgagccctgaaggaccggcaggattggagctag

SEQ ID NO: 249214 - DNA, 480 bp, Homo sapiens
gcaggctcgtgccgattttgcagcctttgggtggaaagccggattggactgcagcagcctagtactcaaggagagggcacggcagggagaggagacagcagcggaaaggcctgagctgggacagtcgaagagctgtgagcggcttgctatggctgaaacgtagtttgagtgtgaccacaaaacatggcagactgtgaccacattgcaaggatctcggaggcttggtaaaagggttctcttccccggagatgtggcacagtgtccgatccccgtgcctttcctcatacagtgccctcccccctttctccgcatgtctacgttctgactctagtgccactttttccacagtctccctggtccccctcccacccaccatcaagatgggatctctccctcctgggagcacctactgcactttgctttcattcattcattttttaaaattaattaattaattggtttatttattttgagatggag

SEQ ID NO: 249215 - DNA, 466 bp, Homo sapiens
agtggtggagataggcctgctcaattaaccggccccagatatcatttctctggctacctcttttctcgcctggcctggccctctataccgttttttgtttgtttgttttgttttgttttttttctgcaaaacgttttctgctgcaactttctctttatttatgcctttatctttcttaaacaagaggtccctggaaataactaactaaggaggggagaggaaccccctcacccccaatttcatgaatgagtgctacattcatgctggccgggtaccaagagcatctttagatctttagacctgagtcttctcatctgtgaaaaagaggttaaagcagatgaaccctaaaggcccatttccagtcttaaattcaacactttcaagacaaaacttttcttctgtattcctgagtgtgtatatatatgttatgtaatatatattataatgtatatatataaacttggct

SEQ ID NO: 249216 - DNA, 410 bp, Homo sapiens
gggtgagagcctgccaggacacaggaagccccacattataccaacaattccaacatatttaacttacattgttaggaagatcagtgtgcagaagggtgaagtcagtcattcacaaggccttcagacctagggagcacagcacacctgccacaggattagaaaatagacattattagaaaataattacatttattgtaattacaaaatattgcatttctatttgatcatgatatataaatataaaaactaaaatataaattttctttatcattcctcccccccgttccccagaggtagccagtgttaatagattatgtgccctttagaactatattctatgcacactcttctgtacctcctcctccatcccaagtacactatacatttttacgcggtcaagtcagctagtc

SEQ ID NO: 249217 - DNA, 570 bp, Homo sapiens
cctggagtattactttttctttattggaaagaacacatatgatcatttcttttgagaagcaaagaaatatggacgtcaagtgtccctttaaattatcttttagataaatatatggctgtgggcaatattgatgaggctttccttaagacagagcaccaacatggagctatgaaacacgagaaagcattcaagaccagccaataaagcatttcctacctccttcccaagtactagagagctcaattttattttatactgcaagttaatggtgggcaggaaacaaacatatttaaagcacacccctatgaaaagaaaggtttacaatgaattatcaccacatgtaaaaagagttctgtataacaaagctatttccatgtccccagggggtgacccagaaaaaaagagtgctttgacctggttataacaaactctctctctcggtaacctatcctggtctttaacaaattattactctcaaaggttttccttctagcaaacctaaatcctcacttttagagatgttcaagttcatttcctttttttgaggagccattttactgaagctgagtc

SEQ ID NO: 249218 - DNA, 120 bp, Homo sapiens
cccacaggccagcaagagaagctacggggagggctcacatagagggagagacaggggtgtccttccccacttcccagggttgagacaagcataagcaaatatttaaatactgtatttttt

SEQ ID NO: 249219 - DNA, 493 bp, Homo sapiens
tggcaaccggtttagcagtcacgtggccactgtctacctcggcaagctcagctccctgtaacagcacttaggaaagaggcgctgtcagggcaggtcttcgggagtgggatttaacagcctgcaaaatccatctgcaaaggtggggggaaaaaaagcaacagcctgggaagcctcagcctaggaaaatataaaatgcctggcaacggcagcacgacgtactaattccagtccgcagcctttgagagtcaattgctggatctgatggtcccaaacgttcctgaacttcagaaacacttagagcagcttatttaatatggaaagtgtcactttatgtatccgaatctagaaaggtaggcctggacatcggtatttttagcaagttaccaggtgaatcaggtacagacataaaattttacaacctctgggccccactcaaggctatcctatttgacacaattacctcactttccaaagaagcatgcgggctataaaa

SEQ ID NO: 249220 - DNA, 1687 bp, Homo sapiens
gcctcagcctccaagtagctgggactacaggcgtgtgccaccaccgctggctaatttttgtatttttagtagagacgaggtttcattatgttggccaggctgctcttgaactcctaacctcgtgatctgcccaccttggcctcccaaagtgcttggattacaggcatgagccaccgcgcccagccgccgaattctttttcttcctataggctgcacatgttgtttgtgtccttattggtatagttgacttttatcacttgtttaagatggagtctgcaaagtttctttactgttaagttgtccttccccctgaaattgctttgtgtggagatactttgaaactatgtgattgaatcatttcctgttccactttcagctgctagttttagcatccactgatggttttgcctgagttaattatcaatattatggacatagtatttatgtccccccaaattcatgttgaaaccttagccccccattatgatagtattaggaggttaggccttttaggaggtgagatttggtcataaaggtggattcctcatgaatgggattggtgccttattaagaagagacataagagcttgctctccaccatgtgaggatacaatgagaagacaaccatcgtcagaccaagaagaaagtcctcactggacaccagatctgctggtaccttgatcttggatttcccagctccagaactatgagaaatataaatagtttgttgtttaagcctatgataatttgttacggcagtccaaccctactaagacaaatataatgggttttaatgggtggttagcccattctttctatatttattatgctggcattctattgtaaggaagaacattctcctcacctctttactcccttaaaacagacaaaattttgtttatatatgtatggactaatagatgcctattttattcagtgagttgtaattcattgctgtcactattttgatgcttaaatttggccagtgagagtcccttcaagttagcttctgtggttggttggttggttggttttgtttttcaaatatttgcttgtgacaatatatgtaacataataaagtatgccatttacacaatttttatgtacacaattcatgagcattaattctattgacagtgttgaatagaattaatttaattctggtgagtacagaaacccacatttgaattgttttcaacttttggcattgtgaataatgctacagtgaacattggcctacgaatacctcttttgagtccgtgttttcagttttttgggtacatatgtaagagtggaattactgaatcatatggtaatctatgcttatctttttgaggaaccatcaagccattttccctagtggcagcaccattttactttcctgttagcaatgtataaagttcccagttgctccacgttcttgccaatgcttgttatattccatgtgtttgtgtctgtatgtgtgtaaccatcctcaagagtgtaaagtcatatctcattgtggttttgatttgcattttcctaatgatgactagtggtgatgaacatcatttcttgtgcttattgttcatttgtatatctttggagtaatgtctgttttgagttttttgattttttttaactgggttttttgtctttctgttgttgaattttaggagtatgatattaaactgtatgtgatacatga

SEQ ID NO: 249221 - DNA, 289 bp, Homo sapiens
tttttctcatctttacctagagaattgatcagatcaaatatctagtttcaattctaatttataactcaacttaccataattcattaaaaggctgttttgatggatccagaatttaaaattagggttatagaaatcagtcagtttaacttgggcctcagcaaccatggcattcaaaccaaatttaagcagaactcctggagcatctatacagaaccttatgagtctatatactatatattgtctgaagactattcttctgatatttattctgaactaaaatttggatacg

SEQ ID NO: 249222 - DNA, 407 bp, Homo sapiens
actcagttcattgctgcttcattttgaaaaagaaacaacatcttaaaaatactacccacaagaagtataaatggctttgatggctacagttccctgccattctactgggaccataagccccactcttaagagtgggcttcttttgcctcccatttaattgtatgcagactcctacggtgaaagaaatcagaatctgtgctaactttttggcatgaaaaacgtaggcgacgaggaagcatataaatgcattctttgctgattctacccccattttgtacaaacatgtttgccccttcccaattttcttgtgtactaaagctccaccttcaggacacaagttcacatttgaaaagtgtgggaaatacgaacaactgaaataaatatttaggcatgcgggttctgtaaaa

SEQ ID NO: 249223 - DNA, 355 bp, Homo sapiens
gcacatgaatgagccacacagttgtacttttcttttttgagaaagagtctcactctgttgcccaggctggagtacagtggtgtgatcttggctcactgcaacctctgcctccagggttcaagcaattctcatgcctgtaatcccagcactctgggaggctgaggtgggcggatcacttgagctcaggaattcaaggtcagcctgggcaacatggctaaactctgtctctattaagaaaaaaaatgttaacattatgatttaaaagtgcattaaccttaatctagataataaaagctttttggggcaacctccagaactgtgaaaaataaatttgttatttaaaaagaaaaaaaaa

SEQ ID NO: 249224 - DNA, 776 bp, Homo sapiens
tggtggtgggcatctgtagtcccagcttcttgggaggctgagatgggagaatcacttgaactcagaagatggaagttgcagtgagccaagattgctctattgcactccagcgtaggcaacagaatgagactctgtctcaaaaaaaattgctttccaataaaaaatttactttttatatttaataatttatcagcattagtatggtgtactaatatactgctactaattataataacttagttcagaagaaattttttacatttagagctttatggtcatgggaagtaaacactttatttttatattttgtcatagagaagtatgataaggtgataataaaaacttttttattagtttgttctcacattgctatgaagaaatacctgagactgggaaatttataaagaaaagaggtttaaaagactcacagttccacttggctggggaggcctcaggaaacttggaatcatggcagaaggcatgtcttcacagggcggcaggagagagaatgagtgccagcaggggaaatgccagacgcttataaaaccatcagctcttgtgagagttcactcactatcacgagaatagcatgggggaaccacccccatgattaagttacctcccactggctccctcccacgacgacgtggggattatggggattacaattcaagatgagatttgagttggggacacagccaaaccatatcaactttcaaattcaaaacatattagggataaattttgtaggtgaagtagaattgaaatgcaaacac

SEQ ID NO: 249225 - DNA, 401 bp, Homo sapiens
agacaggaaaaaggggatctcctggctcctttccagtttctctgagataattccaaattgacatttctattatatggttggatgtggccaaacgttaatacagaaagttaacaaagcagcccagcatggtggctcacatctgtaatcccagcactttgggaggccgaggcaggtgcatcacctgaggtcaggagttcaagaccagcctggctaacatggtgaaatcccgtttctactggggatacaaaaaattagcctggtgtggtggtgcaggcctgtaatcccagctacccaggaggctgaggcaggagaatcgtttgagctggggaggcgaggttgtagtgagccgaaatcgtgccactgcactccagcctgggcaacaagagcaaaactgtctcaaa

SEQ ID NO: 249226 - DNA, 379 bp, Homo sapiens
tctgggattacagcaaaagtggtgctaagaggaaagttcatagcattaaacacctacatcaaaaagtctgaaagagcacaaataggcaatctaaggtcaccttaaggaactatagaaacaagaacaaactaaacccaaacacagtggaagaaaagaaataacaaaaatcagagcacaactacatgaaattgaaacaaaaaaaatacaaaagataaatgaaacaaaaagctggttctttgaaaagataaacaaaattgatagaccgttaatgacattaaccaagaagagagaagatccaaataagttcaattagaaaagaaatggaagatattacagcctataccacagaaatacaaaagatcattcaaggctgctatga

SEQ ID NO: 249227 - DNA, 412 bp, Homo sapiens
atagatacacaaacataatggaactttcagagggaaattacaaactaaactttggcattgataagtcctggagccaagtgtcagagagggacagttcgctgtgggctggaaaaggcatcctacggctggacacttgagttgaccgtttaagaatatgttagattaggatcaagagcaggaaatggaacattccagatggagaggaagttaaagaagtgtaaagtgtggcctgtgtctatcgcatttggagcctgtcctgactggagaagaaggtatggcctaagtgtttgggactcagctagataaggaagctggcaccaggttttggaagcctttgaagcaccaagcaggagagcggagaccagggacagccacatgttgatgatggcttggactagtgtggcggtaatag

SEQ ID NO: 249228 - DNA, 575 bp, Homo sapiens
aaatataccatctccaacaagcactagtttattctgcactgcattcctggaaggaaggttatcagtttatgagacatcttcaccataaagtgaaagaaggaggttggatcaaatgccccttagcgccctctcctgctctgccactccgcagatctccacgtttacacatccagtgttcctgtgggatgacctttgctgtcagtcagtttcctgtctacaggtcaggaaggaaagaagttgtcatgactccttaggtgaatcatggcttcaggctcctgctggatctggcaggacctgcctggatcactccccatgtctttggacgagcgttcagtcaccgagtgagtagggtgcctataaaactgaatcttgtggggcagagggcgacagggggcatgtgggaaacttctgtactttctggtcagttttactgtgaacctaaaactgctctttatgataaagtgcatatatttaaaaaattaaatactaaacagtacgacagttcctcaaaaaaaattaaacaggattaccaagtgatccagcaattccacttctgggtatataccaaaaaaagt

SEQ ID NO: 249229 - DNA, 350 bp, Homo sapiens
gcaaataactccacagactcttttcataaacttaagggtgttcttgctgatcactccgcaaagctaagcaaaactctatccctaggaaggagcagggctgccagacttccaaaggaactttgtccctgtcggtgtagccgactctgtcctttctatggcgttcagcagtgtctctgatgagaataggcattaagcatctattttgggtcaggccctgtgctaatcacacttttacattcactgtcctatttaaatgaaacttagtgtataagtcttttgcctccttggttaaatttatccctaggtattttattatttttgatactattataaatagaattattttctta

SEQ ID NO: 249230 - DNA, 478 bp, Homo sapiens
aggcatgcatggttggggttaatatagtagccccctgtttccacaatttcactttccatggtttcagttacccacagtcacccatggtctgaaaatactaagtggaaatccagaaataaacagttcataagttttaagttgcaactcttctgagtagtgtgatgaaatgtcaccatgtcccgctccatcctgccccggatctgaaccgtccctgtgtccaacagatccacactgcagacgtggctctcccattagtcacttggtagccatctcagttcccaggtcaactgttggtggtactgcagtgcttgtgttccattccctcttatttgacttaatttttctattttattattagttattgttaatctcttactgtgcctaatttgtaaattaaacttgatcataagtatgtatgtataggaaaaaacaaggtatatttgtgtatacatatatataaaaatcatatatgtgtatt

SEQ ID NO: 249231 - DNA, 346 bp, Homo sapiens
acatgtcacagaaaattcgtcttttattgttttcttaggtgaagaatctgtatttgttgatatatactgtacattcagcatttgtatttggtttgtttcatagctaatgaaatgtttatacatgaaaaaatgagtacagtattgaaatagtccatgtgctggcattcatactttttataaataccattgcaggcaatgaagttgtgccagaaaaatctgattttgagtacaaaaggaatacttagccagggcctcgagctcaatatatttattgaaaatgtcctaaattgccataaaacattataacattaaattactcatttcaataaattatgaattaaacaaa

SEQ ID NO: 249232 - DNA, 376 bp, Homo sapiens
ccctggctttcgctgcctgaacactggaattgctaaagtcagaagccgctgaggcgccaatctaaagctaggtacatttctaaatgttgaactgactgagaatgattaggtgctccaacacttgatttaatttccaaagaaagttttattccccatctccaccccttttaaacatggattatttgctggaggaggagaaattggccatgggtgtgcagtgaaacctcttgagttgcaaagccccaaattccaataagccaagatgagatgtttatatataaatgtcattatacgggagggggaattttgattctacaccttcccctcctcccatcttgcagggaatattcatttccttttgttttgatgatacact

SEQ ID NO: 249233 - DNA, 489 bp, Homo sapiens
aagtttctcaagaatatcgttttgatcaaaaatttagcccggcatggtggtgcacacctgtgttcccagctactcaggaggctgaggtaggaggattgcttgagcccaggaggttgagactgcagtgagccaagatcacaccagtgcactccaacctgggcaacagagcaagaccctgtctcaaaaaaatcattttggtggctcataaattatgattgtaaaactaaaccccctttttctgctatttaaaaaatacttatattgacattagcttaaaaaactagtgaaatccaaatgaaatttgaagtttagctagtagcaatctctcaatgttggtgccctagttttgacaaatgtaccgtggtcatgtaagatgttatcacttggggaaactgtactggagtatatgagaattagctgtattatctctgcacctcttctgccaatctaaaattattccaaaataaaagttttattaaaaatagtcat

SEQ ID NO: 249234 - DNA, 654 bp, Homo sapiens
atcagtgtgggtccataactcagaacacacaccctccactggcccgaggtcagttcctctgtcttttaggtctcaccagattcttgtgacccaggaaggtcaaagctaatatggaaattatgaaaaaataattcagctctttagaaccaactgtgtaataggctaaatttaggcttggtagtcattgtgatcattggtgtgattcgttttttggtttgcatttttttgttttttaggagacaaggtcttgccttgtcggagtacagtggtgccatcaccactcactgcagcctcgacctcctgggctcaagtgatcttcccgaacttatcacagggttctatcctggttttgctcatttcctgcctcagcctcctgagtagctgggacaacaggtgtgtaccaccacacccagctaattttttaatttttatttgatagagatggggtgccactacattgcccaggctggtttcaaacttctgccttcaaatgatcctcccacctcagcctcccaaagtgtgtgtgaacaggtgtgaaccaccatgcccagccttgatgtgtgtatttttaagatcttttaaaacttacatagtaaagttggcatgattttgttgaaatatgtcaaatttgagtgtgtttgtaatcaatattta

SEQ ID NO: 249235 - DNA, 106 bp, Homo sapiens
tattttcccccctgcttaaatctatgtttaacttttctctaattttgataaaattaagatgacttcatttttataaaagaaataagtgatgttagtgatggttttg

SEQ ID NO: 249236 - DNA, 2826 bp, Homo sapiens
  misc_feature (1817)..(1817): n is a, c, g, or t
atgatttacatttcaagatttcagttacattttttaaggaattcaacaattctgcatcatgaagtattctttcacacaaatgttccatagtcattagtttttacagaacccttttcttatattctgcatttcatctggaatactataagcacaagttcagtttggcattctgttctccactagtgattgagtttgaagcccaaggtcaggatattgattgatgacatttccctttaaagtatttgtatccatttgcaatttggggacagagtgattcccagtatggtgcaggaaataactaaactggaagtcagcctgactcagttttgtagttaattttctttgtgaccttgggcatgtcacttaaccttccaataactgagggagttggcccagaactagcacagtcttctaatgcagacattccacgattctctagggaggattcacttccatagaggtttaaaagtggatacatttttaggttaaatggctttgttcatttagtttttttctccttaacccattttggagcaataagactgtcatggagtaaaaccaaattacctggaactctcaaaaggctgcagttcttatcctattttttttatttttaagggaagggaaaaaaatggcaacaaacaaatttatatccatgagtcaggacaaatccatcccagttttctaacatacacagtgtacataaacatattcaatgaagcactgcagattcttaaccgaaaatggaatatttggtttgacttaccatcctaaatgtgggaagaactgtactttgatatatactttttgagtatttttagcaaaaattgatataagcagttgtcttggttggcaaggacttgtgtataggaacctggctcccagctcagtgacgagtgtattctgtaactttgaataagtcactgaacctttctagatgtcagtgtcctcagctgttagatttgatactgttctgattactaacagatctgtgattagacatttccatgcatttatttcaggcctcttcctgttctcttccttgagagattaacaaatatacccaccccttccctcacacagtctcaggcaattattgatttgtgagggaaaaggggtattttaaaacactttaaatgatacattcaagaaaattatctcgtattggttatcaattgatatataacaacattaccacaaacttagtgccttaaaataatacacatttattatcccacagtttctgtgagtcaggaggagtctgggcacttcttagttgggtcctttgcaaggctgcaatcaagatgttgtcctgggctggggtctcacttacacgcttgactatggaagcataagctactgagcccactgtgattgttggtggaacttatttccttgcagctggaggactagagggacttaatgtttttgctggctaggggctgccctttgctccttgaggccacccacatatccttgtaatgtgtgcttccctaacatggctgctggccccctcagaagcagcaagggagagaacaaggcagtgctgcagtcttttggaatgtaatcacataatcatgtatacataatcatgtatgtccatcatctttgctctactctggttaaaagcaagtcacaggtccctcccacgctcaaggtgagatgatcacacaagggcattgacaaccaggaggcaagggtcatgggggccgtctgaagcatctgtcagccacaccatatttcaggttttttttttttctgtatcttcctttggatctgtgaataagtatctcacttcatactaaagcctcaataancactgattgacagaaagtctttgtgctcatttaaaacttctcagctccacagagtatttgtaccatgcccttgttttatggagtccccagatactgatgagggcagggtttgagtttgagggctgttcattcttctgcccgccaaccccccaccccgcccccagcacagaactgccagtgttaggtgctcattaagtgtttgtcaaaggattataactgttgttccaattgcagcagtaagtaaatttgaagaagctccctgatattgagtgaattgtattctccaccccccaaattcgtatgttgaagctctaacctccaatgtgatggtagtcccagctaccagagaggctgaggtgagaagattgcttgaagccctggagatgaggctgcagtgagccttgattgtgccactgcactcaacctgggcaacagagtgagaccctgtctgtaaataaatatgtgtgtacagacatacataaggttcacaattcaatttaaaaaagagaaagtgaccatctacaagccaggaagagagcccccaccagaaccctatcatgctggcaccctgatcttggatttccagcctccagaactgtgagaaaatcaggttcgcctgtttaagtcacccagtctttggtatttcgttatggtggcctgagctaagacaggccctgtgttctctgtgtagcaagaggcaggaagctaagcacaaaggttgccagatagcagggactggctggctgttagtgagccagggccagtggcatttaattgcagtcattcccattctttgctgagctttggtcataactatttgtagaggacccctagacttttttttttttcttccaggacaaaagtgatccaaaacatactgtcttcagtttttgagcattggactaccaaacaggaacatttaaggaaaacaaaatgttgctgttgtaaagccttgatggtgggaagttatgtagtgaattctcaatttcttcttcctgcatcttgtctt

SEQ ID NO: 249237 - DNA, 245 bp, Homo sapiens
gctggatgcagaagagagagatacaagaccacatgatgaaggggccatcctcactgacttcaccacctggaaggaagctatggaggagaattgcccaaacaaatacaactgcatcaaattttgcctctgtaagaaatagatctttgttatgctacaataggtccctgagatttggattttatttgttatagtagctagcattatttttacttaataaatggttcttaataaatggtttacttaat

SEQ ID NO: 249238 - DNA, 1195 bp, Homo sapiens
  misc_feature (88)..(88): n is a, c, g, or t
tccccgattgcgacacttcaagtgaatgtagaaaatcttaccactgtttacattcctttaccctctcccctttatgttataattttcntataaatcataagacttggcctcccaaagtgctgggattacaggcatgagccactgcactcagccttgtgtgcgttttagagtcttaactagtagtttccccaataatgtaatgtgattttatctttgaaacatactgtaaggaaacttttgattttaagtaaaaaagcttaaaaatgattaatatctaaaaatgcttgtatacatatatatgtcctcagaaaaagcaagaacagcttgtggaataagcacgtctttaaggaattatcgatgtcagagtctatccatttaaagctgaagaccattacaggaaagtcatgttaaaatattcattggatatggtaaaggaggtactggtggctgggctggagcttgccgtatagaaaagtaattacttcagatctcataatgttaaattattggcttatttaaaaatttccgtggcagagaggcaaattaggtttcctctgtgacataacctatttaaccaatttttcaaaaaattgtactctatgagctttcttgttataaagctaaaaaatttaatttgtctaggcatgttgtaatggtcccagaaaatattactttgtcactggtgtcagagaaacctctgtcatcagcagatgtcctaagagtataattatagttctttacttaatccaaaatttgttctgctctgatatctataaatgatatgattattcaaaataccttgaaatgattccacaattagattaggtctgttgaagataacttattcttaaatatgagtaagattaaataaaagtagtttgagagttgttactccctgcctcaactccatggtattccaaaatgtttttgtgggcactttaatacttgtagtttgattttgtttgttagttttagaaatgaacatttcttagattttcatgggtattttttggctgtatttaaatgtaaatgatataaaagtaagggaaattgtgcaaattatttcttgtgtagtaatcagtggaagtgatcaaacagcttgaagcagtttatgatgagaaaatttaaaattgcaaatgacctgaaaatttagccagtctattcttatttctttaaatttcagaaatacttaaga

SEQ ID NO: 249239 - DNA, 683 bp, Homo sapiens
tccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaagggtatagtatcttgattttaaagtattttcttttatgtttaatttatttagtttactttgactagattttgacattttatatcaaaatattgttttcagtgaagaccaaaagcagaaagttttccaagatggtagccaatgatataggtaggaaatagaaatttctattttgtttctaatccttgctatatgcagtgctaacccaacaccagaattatccagtgcattgcatttttgtgtaaatttgttgttcctatgctaaaaaaataatctcttgggctgtgtctcttctaaactcattggggca

SEQ ID NO: 249240 - DNA, 557 bp, Homo sapiens
tccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaactcgtcagaggtg

SEQ ID NO: 249241 - DNA, 1019 bp, Homo sapiens
attgttaattttctgaggaagattttccatagttttctgatcaaccacactggcagaaatagataactagttctaatttccaaaaggtaagtaatagatagttaccacctgagtttctgcttctgcaaccttttttcactaggaattaaatgtatgtcacagcattattttttggacagacacttggtcattgtgtcaccccttggtgatgagtaaattttattgaaaatatacttgctgtttgattgacacagttctataaacttttcacaagaaaagacagtcttttggtgccatagactatatttctcattttgactctgactgttttatcaatgtgtgtctctggtcctaagcctgagtgattataaatgaattagcgtaaacccatgcctctaaaggaaaagcatctcccagcaggcacctggctagctgaaggccagcagtaccaatcctcctgcctgaagaatagcagtgtagggtcatatcagaaaacatggcccttttcctatgttggatatgtttttctaagatcagtttccacctaacaagtaattttttaattgaaaagcttttatttctaggtctgtctcatgtctttaataaatacgggaatgagtctcatttagttcttaagctaaagagtactacaaaaaccctgaaacatctctgagatggtacatttactttccattgttactcttgtataagacagcaacaggtgagtttgctctcatagtggaaattaaaacagaagcagccagccagcatatatttccttccaagattgtgtacaagagaaagcctaacccatggtggctgataatgccatttaatatatagtcacctaaatctttatgtgtcagctccattgcagaggactcagtgggctactccacacccaagcctgagggatgaggagatcattagaggagatgcgtgggactctcccacggactaaggaaagtgaactgttttggtttactgaccgcatatataaatggattcagaaaaaaaaa

SEQ ID NO: 249242 - DNA, 631 bp, Homo sapiens
gttggcatggggtgcctatgttagagcaatgcaacagacaagtgggaatgagcccacaaatcagagaggcagataaaatatggacacagataaccatgaggccagggcaatggtcagggctccaacatttccaaggagggccctggcagtagggatctgggcggcttcctaaatcaggaggtggcacctgaataggccttgaaggggattaacaacccagcaagaaaccgaagagctccttgaaagcaagccctgtgccttcctcatctcactattcccagcacttagccagggtgtgacaaacgctgggtgaataattctctacgtgtttgggaaattgtaactttttatacttggctttcctgaatgtgaccctgtaggcacatagctattttcccaagggcctgtgcaaagtatcattagccccattttacaggcacagagactgatggccagagaggaacagtgatttgccgaaagttacgtaggaagtcagtggcagggctgggctagaagccagggcatctgcagggcaaggtgctctctccctccagcagccccagccccagccccagccccagccccagcacagtgcagtacagatgggggtggctgtgagtaacagcggccg

SEQ ID NO: 249243 - DNA, 391 bp, Homo sapiens
cacaaaaaataataataaataacaaagtctgtgtgagaaatgagttgaagtatagataacacaaaattggcatgttattagttgttgttgagcctgggtaacaggcctattgtactgtttcttttattttgtgtatgttttaaattttctgtaataaaacatgtataataatacaaagttgatctacactgttagctcttaagatcttagtgactttgggggagcaaaagagagaaagtggttaccaggacatctgtgaagctggttctatttctaggttacacacgtgtgttcactttgtaataattcattgaactttacatgatttctttgtatacgtctttctgcatgaatgttatacatatataaaaatttaaatattacctatttg

SEQ ID NO: 249244 - DNA, 272 bp, Homo sapiens
ctccctgaccatagctctgaagttgctgagcagcttctattacatgattatcatgttttactttcttcattgaactgataatatgtatctgaaattactttgctcacttatttacaagtttgttatcttcctagaatgtaagcttcacgaaaggtgggatcttgtgtatctgttcatagtaataaacaaacatgtaaatgagcaaaatgctatatagatataaatgctctgaagaaaataaaaagtttcaaataaggactcagtaaatattt

SEQ ID NO: 249245 - DNA, 459 bp, Homo sapiens
cagtgaaaggattaggagaaaaaagcagagcaatttatataataccagtttaaaattaaggcagccgagaaactctgaaaaaattttaagaagctggaggggtttggccgtgtaggcatgagcaacttccatgtcctgaaagagacaggggaccccgataagagatgggttgggaggccgggcgcggcgcctcacacctgtaatcccagcacttcgggaggccgaggagggcagatcacttgaggtcagcagttcaaaaccagcctggccaacatggcgaaaccctatctccaccaaaaatacaaaaattagccaggtgtgatggtgtgtgcctgtagtcccagctattcgggaggctgaagcaggagaatcacttgaacccgggaggcggaggttgcagtgagctgaaatcgagtcacctgcactccagcccgggtgacagagcgagactctgtctca

SEQ ID NO: 249246 - DNA, 584 bp, Homo sapiens
ttctcccacaattctggaggctagatgtctgaaattaaggtgttggaagggtcacgttccctctggaggttctagagggaaagctgtatcttgactcttcaagctcctggtggctaccagcatctctgggcttgtggatgcatcactttaatatctaccttcacagtcactttgcttctttctcctttctctgtctatccctcctctgtgtctctcttataagggcgcttgtcatgagatttaggacccacctagataatccgcgattatgtaatctcaagatccttaatttaattatatctgcaaaaacttttttccatgattatctaatctcaagatccttaatttaattgtatctgcaaaaacctttttcccaaagaagttaacattcacaggttctggggattagcatgtggacaaatccttttggtcaccatttaatctactataacatcttaacttattacagtctacctttaagtaatattacttccattttactcttctgtgtcctattgttgtcatgtgtctcatttctatagaataaatttcacaatatattatttttgcttaaaaatgtcaat

SEQ ID NO: 249247 - DNA, 265 bp, Homo sapiens
ttttgtccaatggaatggaatttgaaattcctattatggttattttaaaggagggactgctaaatcatatagagatgtatgaccattgtgccttcctttcttgcctttttttttcccacttctactggagctaaggtgcatgaaagtgagttgcacttggaagggcacagtaggagcagatcattggatgtatccaaagagccaccatctgtcagctttcctgttgctttaagaaaacttgttttccagccctatcaagagagag

SEQ ID NO: 249248 - DNA, 390 bp, Homo sapiens
ctcctaatgactctacagttcctggcttcctcttgccactgactttcccctccaccgctgcctgggacaaccttacagctacagtgactttgagtcttgccaagacaagcccaatagttactttcagactcaagtgcttgccaagcctgaaatagtaattgcctgaagggttccaaaaagctgggctttatctgcagcagagactttagtaaatcaaaacacaggtcttatctccctattctctcccctctgttgtgtggtctcctaaatgaaaaatgttacctaattgcctaaaacagctggcttgatgtttaattacttcagcttgctaacctgatattctggaccaataaactatacacagggagtggataatgctctttacagatc

SEQ ID NO: 249249 - DNA, 252 bp, Homo sapiens
gagatagactgaaagttgggaggtataaaaataagataaggatgtgaattaaagcacaatgtctaaaataaagtaaacaataaaaggcaacattatcagcattatcaccatcatcatcattattgtgactactatggtaacagccttggtaatgaaaagaaagaggaaattataagactatgggaagaaataatatatagcacttgatcactagtaacaaaaacaggaagttcaggaagagatggtcatttt

SEQ ID NO: 249250 - DNA, 851 bp, Homo sapiens
gtatttatttgttcatttataaaaaataagacatggtctctgatctcaaggaatttaaaatctggttaaaaagacaagatatatatgcatgaaaaattaaacactcttgatgatacaagaaaatgtgtatcgagtatcaaatgaatagtatggactgtgagtgctgtgagaatttaggagagaggatcatagtgggccaggacaggggaagaaagctttgttgcccatgtgggacctaaattgagtctcaagcgtgagtgggattaaaatagtcagatatgatgaaaggtattccttatagatttcaggtcatggggtagaaagtgtgagcaaagatggagacaactcagcttttttttggagttggggtaaaagctgaagaattcatgctcattttgactgagaacaatttatgttaggaaagaggcgttgcagtgaaaaggtaggttgggccaaaattctttggtctttaaatgccagtcttctatctttagactttatctcttccattacagtctttaagtcaacgaaaatatttgaacaatgtgtgagatgatgacaagattaatcttgaagcagaatttaaggggaattggaaagggagagatttggggagtaaaacagaagtaagaagttattttgggggctgcctgcaataattctggcttatgtttgttcagactagtctaaaataaggggtggagcaaaggcaagcagattggggtatgtgaggcgatgtgaaacctccacaactgataggatatgagtaggcaagagtgagagtgaaatgaaaggtaactaggaagattaggctgggagactggaggagtgattatcctactgaaaaaaaa

SEQ ID NO: 249251 - DNA, 592 bp, Homo sapiens
ctcgactgactggctcatctccccttgctgtaactgtgccattcaaccccaagacaagcctgggggatggcgtgctctctcctttgtggagaaaggtatggaaattcaggattgatcccagctgcatagttcattaatgtcaaaagctgaacgcaaaagctaaaggcctgatcagtgatttgcacagaatgctgggcagcatccctagaactccaaaacgtcctgtctggcctggtgtgaatagccctaagtgtcccagtgtggactcaaatcattcttcctgcagcttgccccagttaaagaacatccaaactgttccctttgcaaaaatgacatggcagggtgcatttctacagatgcaaccctgatcctctgtgtgagctttcatcacatccctcgccctgctgggaggaggtaaggatcagagataggggccaagcaggtagccaacaaatgtgtgccagggccaagcaggggccaagacttcttggggtctggtgccagagaatgctaaatgggtgtggcttaaaattaatgatggagaaatgagatcttctaggccattctaggaagtccagctagcaaaaaaaaa

SEQ ID NO: 249252 - DNA, 459 bp, Homo sapiens
ttcacattcactcaccactcactcactgactcactcagagcaacttctagtcctgcaagctccactcatgatatgtttctacacaggtgtaccatttatcttttgtgctgtttttactgtaccttttccatgtttagatatgtttaggtacacaaatacttacaactgtttaccgttgcctacagtatccagtacagtaacatgctgtataggtttgtagcctaggagcaataggctacaccatatagccttggtgtgcagcaggctctaccatctaggtttctgtaagtacactctatgatcacacaataacaaaatcacctaacgacacatttctcagaacacatcgcatcattaggtgacaactgtaaaaagcaattgtcagtggttatatgtgtatgtgtaattatgtgagtatatttatcaataaactatataaaataagtacttacacaagca

SEQ ID NO: 249253 - DNA, 430 bp, Homo sapiens
caggcattcatggctgtgcttcagaagtggctcagtagaaataataataccaatacattgcatctcttttgtattttttttctccagtgggcttggagaactttatccagataatctcatttttctcacacatcactgtgttagagaagaaggcccctgaatttacccaagctggttctctgctatgaccgtatatttgaaactagcaactggaaattatagtgaatagagcaagaaccccaagaatggatctttctgtacctgttttagattcaggtaactgagaaaagtatgttaattgctttttggggacatctgttcctagcacagtgctcagtgaaatcccttgggtttatgagtacctgacttggagaagaattataagaaacaaaatttgggggagaatttaaaatgtcattatttactttac

SEQ ID NO: 249254 - DNA, 312 bp, Homo sapiens
actcctggggctggaatctgcccccaggcttgggtcaccaggcacagcagaaggaagggcctgatcaggccttctgcagaattcaccccatctgctctacagccccaaatgcccctaaacagggccaaggccggcccttcctcagccattgacgctcaggatgcagagtggggctgcgggttgaggcagggctaccagctgtgtggcctcaggaaaagtactgacctctctgagtttcagtttcctgaaaggcaaagtgtgggtaatagcacccagggattaaacgagatagtccacgtacaacacttagca

SEQ ID NO: 249255 - DNA, 721 bp, Homo sapiens
aaactcctgacctcaggtgatccacctgcctctgcctcccaaagtgctgggataacaggcatgaaccgccatgcctggctaattttatcacctttctagacataaggggaggagaaccgggaaaaaccaggtccaacccccacttctactccctgacccgctgcttcctctagaaaccagtccccacctgaggttgcccttcatcagaccttgctgggactctggtccctctggtgcctacctgccctgaccccacctgggccttggtacaactggccctgaatgcctgccccatgaagctatatagcccaggctccccattggaattccctgttctgggaattgacagagagaagaaaacccctgctctcgtctgtctctgctcatccttctcagtggacagggcatcccagggagcaggaggcctgcagcttgcctgggagtttcaaactggcaaaccaagggccacatttatattcatatgtgttggttcggcccacatcatttgttttaaatgcaagtcaaattttaaaatctggagattttacataaaaatatatttttccagcttttcatagaaatcagggccaggcgcagtggcttatgcctgtaatcctagcaccttaggaagccaaggtaggaggatcacctgaggccaggatttcgaggctaggaggttgagactaacctgggccacatagcgagacccccttttctacca

SEQ ID NO: 249256 - DNA, 491 bp, Homo sapiens
ttttgggctttcaattttattctattgatctatatgtttatccttatgtcaataccatactgttttgtttattgtagctttgaaataagttttgaaatcagtgtgagatcttcaatttagttctttttcaagattcttttggctactctagttcctttgaattcccatatacattctagaatcaccatgtcagtttctacaaaatagccatttggaattttgataggtattgcattgaatgtatagatcaatttgatgagtgttgctattttaacaataacaactcttccaatccatgaacatgggatgtctttccctttattttggtcttttaaaatttctttcaacaacgttttgtagttgtacaaagtgttacattacagcatcatagtattcactgtgaaagtcttataatttttcattaaatttgttcccaagtatcttattctttttggatgttataaataaaattgctttcttaatttcaatca

SEQ ID NO: 249257 - DNA, 712 bp, Homo sapiens
cacttttaaattaaatgcatgttgtggaaaaacagtcttttaaaatgaaatttcagattccatttgagaaggttctgtagatatttcagtccatataaaataatacatctttactaaacttatataaggggagagaaagttatgaagttttggacattactaaaagtacagtatttgatttcactttcaatgaatgtgaagttaataaaactaaatctcataatgctcttggttcctaagaatgagtagtaatcatcaactttataatactccaatattccgttttataataattcagagccctgtggcttttacacaccgttaattatgtactctgttggaagtgcacatgaaaagtgaagaaaagttcctcttgtgattaaactaatgggaggaaataaatcaacaaagtctccattaagttctacattttgagaccttttaaaaattcccctcacaattctttaaggagcccccctttttatggaacatgagcctaaaaattatagaaagaagaattttaagttaataaagtttgtatttataaatgctgaaaaaatacagaaactttctgttccaaatgtgttgcctttgtgtattttataatacagatactacattgtaaacatttccattgttttatgatttagccagtgattccccaaagcagcctcttagtgttttaatatattaataactgttttgttaaaaa

SEQ ID NO: 249258 - DNA, 708 bp, Homo sapiens
tccactgtgaatcccttggggcagaagtcaggccctcccaggacccaccaatgggcttctgcagcatgggcgcccagcctatatccacgtgaaaaggaatgggaggaattcatgacaaagggctttataaaatataacgtatgaccgtgatcataactagcatcatctctattttgagtggctcccaggatatgccattgaattaggcagtaactcatttctaatcctcatgatgaacttaggaggaatttggcaccattttccagaagaggaaaccaatgtgcagggaggtgaagcgatttgatcaggtcatgaaggtaggaagtggtccacaggactttacagcaggtctagccctgtaacaggggagaccaacaccacatcaggaaacaggaagacgttggaagtcgtctctagggcagaaatgtcccttgtaggggaggaggggaaatgataggaagttcccggctggcatgacaatgtgattatttcaatgagcttcttagaatggaaatattggggccgggcgcagtggctcatgcctgtaatcccaacactttggggggccgaagcgggtagatcacgaggtcaggagtttgagaccagcctggccaacatggtaaaaccctgtctctactaaaaatacaaaaaaaaattggccaggtgtggtggcgcaatcctgtaatcccagctactctgaaggctgag

SEQ ID NO: 249259 - DNA, 410 bp, Homo sapiens
tttcaccatcttggccttgaactcctgaccttgtgatccactggccttggcctctcaaagttctgggattacaggtgtgagccatcgtacccggcagccctggtttcttcttagttttattggtctgtgttttgatcagcacagtcacttttttgttctctttcctggtaagcagggagtcaaaacaatagcaagaaaatgccagaaatagaatttctactactttgtaaactctaggctcgtgggtctcctagctctcagtacctggctcactgtaggatgggtagatgggtgaatgaatggataaagaaaggaagtttgttcaccggagaggagatgaatttcagtaagtttcatgtaacagtgatcaggagaaataaaggcagttataactgtgaccactctgttct

SEQ ID NO: 249260 - DNA, 769 bp, Homo sapiens
attattcattttcctaatgcttttaacaccaattgataattcttgcctgaatcagtaactttacagaactgtcatattctaattctgtcattccttccacattagctgacatttgactaaacacagctcttctttattaactgggactattcgtagccatcaaacacagttctgttggacaggcaggttaaatgttgaattttttactttttaattcccaatttcagagtaagagttgatttaataaacaaatggtggcaaatgaaccttttcctttctttcctttttagaaatatttttgtggactaatggagtttcatgaattgaatgtttcaattaactacagtcattattctttttatgtttaatttgtttttgttttacgttcaatttattaaaatgattgccagtgatagttccttgtggttggttcctatcttctttaaatataactctccattaattgtgagcactttcttgcttccttgcacagcaaaatgcataagcttatcttgcagcttccttgtcccaaatgtcaatcagccacttcactaataagccctaatttcttttggtgggaatgatatagacatgaaattcttgtaacttagaatatctatggtgtgctggggtgacaaggtttatggaccttttcagtagtctatttagttcatgaatttttaatattgaaagtttgtacaatgaaaattcagatagtaatggaaaactgtattttgaaaaataatgggatgtattatatacttaaaaa

SEQ ID NO: 249261 - DNA, 220 bp, Homo sapiens
tgatatcaagtttgaaatttgttgaaatgttttcctattgacctacttataaatgggttatttacatattcagcgtaattacttgtgcttaaaactgttttcaagataaatttgaactatgtcattgttcatataaaagaaagatgcttcttttcaattaatttgtattagttaataattctacaaattgtgtttatttcaatggagattaaagaatata

SEQ ID NO: 249262 - DNA, 541 bp, Homo sapiens
aaagtcttaaagtagtagaaagactggatctgattggcaggtcaaaaaatccacctttgcttctctttggagaatgagattgtggaggagcaagaatggaaggaaggacctcagttgagaggactttgcaatcctacagatgagttgggccaaggtaatagaagcaaaaatggagatggactaattctgaatccttagggggttgagccaagaggcctgcaaacagattaactctcgggaataatggaaagagaggaatcacagataaagcctagattcctggtttgaacagttaagtaagtggtggtattattctttgagatgaggaagcccaggagagcaggtatgcattatgaatgttcagacaggtggtgacacagaaaggagcattctacaaacttggccacgtcactcttcttattttatagagcatctcactgcatagggttccaaggaacatgcattgagaaatagtggcttgtgtcactgagctttgctaacctgaggcatccatttccatggtaggcgtttgttttcttaa

SEQ ID NO: 249263 - DNA, 280 bp, Homo sapiens
tttacaaatacctctcttgttccagttacacaagtcataatttactgagcacgatggtaaaatcctttaaaaatgtagtaaaaagaacagagtatgcatatgcaaaggaggagattggggaaagcaaattagaagtctatgcattctgtagacagtgaaagctggttcaagcagaatgaataagaaagtaatttaaaaagaaggcatcacttattgactaaggtcaaacaggaggaatacacataaaaaccagaaactaacttcaagcagaatgaataag

SEQ ID NO: 249264 - DNA, 571 bp, Homo sapiens
gagaaatgtgaatgtttaattcattacaagctaagcagaaggcttttgcctgggaaattcccattagattgatgggatgggagagcaaggagaaataggagaagcttaatgaagacgttgctcctcacaccagtatgtggcacttactccctgccaaaatgtttactcatcatcttacagatccttgcatgctcattatttatagataatattgattttttaattttaattactagagtatttcactgccttgcttcttgacttacagagcaaaagccttcatggtctttttaagccatgcgtgttggcaaataagtcacagaaggttacctttaggtttggtttggaagcatgctgtctccaaagtttgataggagatttggaaaatgggccatagttgatgtcatcgttaacctgcttgcaagttctctgtatatgtgctgaattacaataaaaagaagtgcctgcagggtggtgttacattttaaatccctccaaattctcatcttttcttggctataatgcagtatcacctattaatttctttaatgactttacctcctcaaattta

SEQ ID NO: 249265 - DNA, 872 bp, Homo sapiens
gtggcattcgagaccttctgggtgggaaggaggcagccatgtggtgatctggggaagagtgctgcaagcagaaaggcaagtaaaaacaaaagccctgaggcagaaatgtgctccttatgcttaagaaacaccgtgaaggccaacgtggttggagcaatgtgagcaagaagaatagaggggccttgggaacataggtagctgagtcctcatggatcaaggcaccttgactttaagtgtctgttacaccaaaggttatggcaaactgtgtctgcagcccacagtaaaatccagtttaaggctctccacactggagtgcagctatccagtttttcagccatttccaaaaggaattatattgatgtgttagttgacaagcctacaatgaaaagatagatgggaaaagaagaccatcagacaggtggctggatatgtggagacaagcacgaagaagtccaggctctgtcacgacgttgctgactggcttctgtcacattttcaggcatcttttagctagaggtgcgcgtgtgacaccacatggactgtgagaaatagtcaagttcagcctagtgacgcttctggcaaagcttgttttcctgatttttaaaaaaggagttgggggagtgccatgccttttgtccttcctccctcctcctgcctggaacatggatgtgagaccaggaagtacagcagccatcttgtgaccatgaggactaaaggcctgcgctgaggatggtacagtaaaatgaaagaagcagcctggatgcctgatgagcagctgtgccagccccagggtcatgcaaatcagtgtcaatcattgtggttctggttttctcctatttgtagccaaataaattccttactgatataggcag

SEQ ID NO: 249266 - DNA, 280 bp, Homo sapiens
accaagtccatcagagcagcctggacataattgggaatggtgcctgcacttttaagaggcgaacgagtgcaatgaccagttgtagagaagagtttatgcatggccttcggagctaagcagtgacctgaattcagtatgtcaccaaatttggtgtgctttctcctttgcctgctgcttctttcaagtaggacatggagacaacagccaaatttgtgcttcagtgatgtgaccttcccttcccaggcaggcaaataaatttagttttgtttctgattatcat

SEQ ID NO: 249267 - DNA, 224 bp, Homo sapiens
aacaacacaataaaataacaaaaaatgtaaataactacttctggggcagtgagagaacattactaccagtctgataagattatattctccttggaatatgcctccatatcacccctgaagtgtataagtggtgtttgcttaggggaaagaatgacttaaaatttagtaaaagattaaacaccatctaaaagattaaatgaaggatcattttacttgacattttc

SEQ ID NO: 249268 - DNA, 333 bp, Homo sapiens
ggagtcattctgtttattcagtacctcttttgtgatatatcctttatggttggtgttcacttgtaatgcaaaaatctttacactttgtgccgagtcccataggtccatccacatactttctcatcagacttcctagtcctaaactttctaacatttcttcttccttaaagtaggctcttctactacttatcactgctataacaaattaccataaacttagtgactgagacaacagaagtattgtctcttacatttctgtaaaagtctgacacaattcttactgtgctaaaaatcaaggttttagcaaggctctgatcctttctggaggcttta

SEQ ID NO: 249269 - DNA, 411 bp, Homo sapiens
gtaatcctaagtaaggggtgatctcttgcaaaatactaataaccttaatttcatagaggaaagtttaggagtctggtctcatgggatgttattcaaagttgacagcatatcgtgaccatacaaatgtataaaagtgacattttggggttatacatctttagaacgtggaggtaaactcatactctatttgcagtgttacatgattatagaatcacatcctattttactcctaagagtagtggtcaattaaatagctttttttcacctactttagtttagggtaccttaagataccctattgagcgtgattaactattatattgtaaaaagagaaaaaaaggactactctaggttagtctatattcttgaaagattttgactgattttgagcttttgatatggtaggaaaat

SEQ ID NO: 249270 - DNA, 317 bp, Homo sapiens
agtctcctgtgaagctggttttatatactcggggaagcaccaagcccaagcagttttgaataccagtggaaaaacaagactctcagcagttccaggaaaaataaattattaaagccgaaagagatggtggaacaattcatcccccaaatgtacaaaggattcttgggaaggaggaaggcaaaatgctttttttctttcaaccaatgccattaaaaataaaatttacattttactttagaaaactggctttccaagttgaaggttgtgacatttggccacacacctttacttatacaaataaacacattaatctcaat

SEQ ID NO: 249271 - DNA, 392 bp, Homo sapiens
atttgattgtgccctttcaggatgacagaggagtttataacactgtccttccaaaagtggtcagtcactctaagctttgaagttaacacaacctacgctggttgatctcttaagaaacaccacataccattttttcccaaggtttccatttggaaaatagttattagtaccatggtgaacaggagttagaagatgttttctgtaaaagggcaattagtaaattgttaagatttctgaaactttgttggaattacttaattctgtcattgtagtgcaatagcaaccacagatcatgtataaatgaatggaaataactgtgttccaataaaactttatctacataaacaggttgcaggctggatttggcttttgggtcataattaaccagcccc

SEQ ID NO: 249272 - DNA, 504 bp, Homo sapiens
cctttcttgtttttgagccttttctggttgtgtttttttacccattcatctcctcctaaccttttacctggttaactcctagtcctctttttaggttgtagcttagaagttactttcttgaggattcacaagtgtaaggtatttctaaaggaccctatactatttttttcataacacgaattactctgtgatttcattgactgtaggcttttgaaaatatgtggaagatttttcgttgttacagacttggggcagggtgttgctgacatctggtaggtgaaggtgaaaaacaataaatccccactgaaagaagccactcagagcaatcagtttccttaatttattaaggcatcatataactgtaaagccatttcagatacctttgcattttaatttgctttgatgataatgattatgttaatattatcatccctttcaaatcatgggtgggtctatttgtgcatcaataaaagcagtctttgatttccctttccaaggtcaata

SEQ ID NO: 249273 - DNA, 394 bp, Homo sapiens
gtatagaaaatacaactgatccacagtaagagagcagatcaatggctacctcgttgtgggtgggagcaggaaagaagaaaatacaaaaagggaatgaggaaacctttgggggtgatggatatgttcattatcttgactgtgataatggtttcacaggtgtatacatgtcaagacttatacactttaaatatatgcagtttataatatgtaaattataccccaatgaagattttaaatatgtgtataggtatatttaaaactgttaagaataagtttcttaaataatattgggcatataacaacactaaagttagtcttagccctaagaatctttatgccaagaaagataaattttgttgtttaaaaataaaacaagatgcagttccttacctca

SEQ ID NO: 249274 - DNA, 337 bp, Homo sapiens
ttcggaatctcgcgcggcccgtgcgacgtcgtgcgctgggaggaaagttggagctacctctcgaagtgggggaggctgcggccgggagggcccctttccctctcgctgccccgcgagggaggctcggcccggccctgggccgccgccgcctctctgtcgcactctgtcccatttcctccttgtggcctacgcgtctcccgccgccttagctggcgaagcctgtccccgtccgggtgcagggtcctacgggggggggggaaggggctccacgccagaaccgccacagacaccctcctccctgcagtggaaacgtgtcctgctgagcttccgggcgctc

SEQ ID NO: 249275 - DNA, 679 bp, Homo sapiens
ctgtgaagaacatttgaatcgagactctccattgacctggtaaaacatagaaattggttacattaactcaagttgtcaaacttcatcataaaatgtgtgtgttttagttactgtgttatagtatctctgttaagtggaaaagattcttcttatcaagtgtacccaccacctggagaacagggaaaaggtacaaatctgtctttattctcatgttttttggatgaggtattttgttttggtggtctttatgtatactttggcttatgggttgcaagagccaaagactctgttaatctttcatttgaatatgctatatgaaattgctttaagatatagagaaggccctattgaggcttttaccctgagctgctgggtgatccggaataggtgagaaggcaagatcctgtgaatactttttcttagtttgatctgagatcatgccattgcactccagcctgggtgacaagagcgaaactccgtctcaaaaaaaaaaaaaaaaaaaaagcaaataaccttaccatagtttacaaggccttgtatgatctgacccctgcttacctcttagtctgatctcctgccagtatccccttgctttcctgtgttccatacattttgtacccttacataatgctgttccttctgtctggaatgctttcttcaccagcgccctttccctgga

SEQ ID NO: 249276 - DNA, 153 bp, Homo sapiens
ggaggaggcggaggagcagcagcagcagcaacaacaacaacaagaggagcagcagcaacccaattaaacatcttaaataaagattttggtatcttggccaggcatggcagctcatgcctgtaatctcagcaccttgagaggccgaggcaggtg

SEQ ID NO: 249277 - DNA, 462 bp, Homo sapiens
ttcctgtggctgagctccactggctcctgactgcctgcttggtttgtctgccagcttgccttacccttgggcttcaatcttcacaatcctcataatcttgctctgagcatagggtaccatgcagcccaattctacgtggttcatctgctcctgacttaactgaatctacctcttacttgagccccttatattaaagagggtcgatggcttttataatgaaagtgactgcaatacaaatacattttaatggtgtcacaacctttaaacattagcagtccaggttgttcaaggaccaccttaagttctgaacttagtgtgtagaaaagtttccacaagtaaaaaatattttcatgcttctgaatattttatgggttttgtcctacataggaatacttgctatctttattgaaaggggtatgtggaatcaaatatctgaataaattatgtcatatatatacagca

SEQ ID NO: 249278 - DNA, 470 bp, Homo sapiens
cagtctgtacacctttattattagtttttgagttatttatgtaccagatattatacttttaaacattttaatattctctgatctttacaattatttatgttcaaatttgtagttgggagttttgtttcctacttaagctcaggacttgataccctctgagttgagtggctttgagtgacatgctaacagcaatttcatagtaaatgtaaataaggtcagaggatctaacatagaagctgatgacgcattaatgtaaaaatggaacttatttttgtcaaaaataagatgtacacttgtcatgttttatatacgttgaccttttgtgtttattgctgttttgaatagagccatgttcattttctttccagttagagtaagtacttctgtggttaatgtatatttttattctggcttttaaaatgggaataatttgtatgtatctgtgcaaataataaatgcgcatttggaaa

SEQ ID NO: 249279 - DNA, 504 bp, Homo sapiens
agtgcgacaaggcaggccacgccccctcgctccgcctccgcagcttcgggtagacacacacaaacaaccagcttgctgcagcctggcacaaagagggcgcactgcgcaggcgctgccagcgagctcttttgggaagaatcggtcccgcgaacaatgaaattgggtttccgccccaccctctttactcctccccagcacgcccctgcgcttcgccgggctagggagtggtggtactgaaatgtcccggcggagtttgttgatgggggtggggaagggagggggcagggggagggcggcaggaagaacgggggctgggaagaggggatgactttggcaaggccacggttgcctcctccgctgctgaccttggggaagtatccgttttattttcagcccaacataacagcgttatcattttaaaacaaagatttctaagtacgctgtaaggatttcttccctagcaatcgtgaagaaaatcagtctacatttaaattttatctactg

SEQ ID NO: 249280 - DNA, 392 bp, Homo sapiens
tttacaaaaacaggcagcagtccagtttgggttaaagggccaaacgttactgattcctgctgtaggtagtacttacctgaaatagcaaaacctgggttgtaaagcaaggtctgtaattaatttccaacagttgatcagccgtataaccttgggaagtcatcctacctttactgagcttctccattctcttactggactaaacctatacaaatggggacctgtatgtgtgtgcaggtgaaagtccatgagtgtgtgagagagaacatgcatgtagctttcatggatagactttggaccctagctagcccagaaggtgtgaccaatatgcttatacatgtatttatgtttctcataaacgctctaacacttcatgagatacagcagaaacagtt

SEQ ID NO: 249281 - DNA, 503 bp, Homo sapiens
aaatcaggtccactattcatttattttgttttgtactttcatgtaaatgttttcttgtatatatagatatatgaaaaatggaactattttcttacacatactatgcaacatgtttgtaaaattgcaatattaccaaaattacaaaagctgtgcttttgtactctatcttgctttatgtaaaatcactttttctatttaaatggactgtctgccctataaactgtagataacatatctattcaaaaatcagtctattgtatcttttgtttagatggaacttaattggggtatattttgggggagagaaaatgcagcaaagttttggcaattggaaacctttttttctctgaaatgagaccttttgaagcatgcaatgagctcatataatttaagatctctcctgtgattcttgtaatttgtcctaattttggtgctactatgtaaccatgattaaatgtgatagtcaaaacaaagaggataaaaacttacatgatatcatttca

SEQ ID NO: 249282 - DNA, 1085 bp, Homo sapiens
ctcaacttttttatttttaaacaatctcaaaccctcagaaaaattgcaagtacagtacaaaatttttttatctgaaatatcttaatgtaaatagccaacaaaatgccccttcaccattaactatattattgtgtattttctccaatgagaacattctcttacataacaatacaatcataaaaattaggaaattattacattgatacaatgtaataatgtcatctaattctcaaacccattcacattctgctatttgtcctggtaatatcatttttagcaaaatgatacatattttgtgaatgctataaagaaggcaccaagattaactttttaataaatgaatattcagttgaaataacatcatttatttaaaaggccatcctttccgtgctccattgcagtggtacctttgttgcaactttataactttgttataaatcttgatgtaaagtaacgtgagttttacaactttgtcttcttcaactttgccctggctattttggccctttgcatttattctcatatttaaaatcagattgtcagtttctataaaattatgctagacttttgattgggattgcattgaatatatagctcaaattggtgagaactgaaagcatattgaaactacaaaacataatatatctctccatttatttaggtttttctttaaattttgtcaaaattgttttgtagttttctgtttaaaaattataaacttgtttcactagttactcctaaatgtttacttttttgtatcattgcaaatcatatctttattttcattttataattgtttgtggcaaaatacagaaatacaatttttgaacatagaattatattaaattgatcatgtgtcaagcagctctgataaatttgctcattaactgaaataaaataatataataaccagtgtatagattcatattttttctacctattaattatattggcaatgagtaatggaaattctatttcttcccttttaatccttatctttcttattctgttttgcctgtgatactggctaggacttccagtacacggttgaacagaagtgatgatagtagacattcttgtctcat

SEQ ID NO: 249283 - DNA, 404 bp, Homo sapiens
ctcaacttttttatttttaaacaatctcaaaccctcagaaaaattgcaaatttgaagcctctttcctgaaatctgcaaatttagagagagacattacacaatgaggaatggcatcctgatcttaccctgtttgaaaggaaaccaatggatagattgaatacttcttttcccactaacatttatcattgataaccattcccttcttctcaaaagttgttccctggctcccaaaatatccattctctcctcactctttgcttactacttgggctccttcatggttatcttccaccaactccttaaatgtggcagtttctaatgtcacagatgcttcctttctccctaaggggagaagttaatccccagccggtctattcaataaaatccttaattattagtctaaa

SEQ ID NO: 249284 - DNA, 477 bp, Homo sapiens
tttaaagtacagcacatgcaatacataagacaatttttttccctcaaaagtaaaaattctcgtggaacttttagatagagaaataaaaatgtaggtttgaaactggctgcaatcttcatgtatttcaggatatccacagaagctgacttataaaaagcatttatattccttaatttcaacatagatgactaaaagaaaattaagtcaataactaataaagttagtgaaacaaacacttcctacttctagagaagctttcacccacacactataagaccaaaagacatatttaaccttcagagtgcaaataagcccacacatttcaagcagcttgggttttcaaattctgtgcatgttacctgtttcccatgtaccagaaaagtagtaatgtgtggggctatagaggaagaaaatttctgggtaaatgcagccccgtagcgcaccgccaacctgggtgtgtcagtggaaagccataaa

SEQ ID NO: 249285 - DNA, 709 bp, Homo sapiens
gcagcatcttttactcagctgggtagtttcctccatatcacgggcttgagcaattactggtgactcttggatctataatatagctagtacagacttccttttttagcttcagacccacgtatcccactgcctgcttggcattttcacgtgcgtggtttatcaaaagtatgtccgaaatagcccggacattcttccgtcttcctcaaacctgttcagcttacatttgtgttgatgaatgccaccagcagccgactatgcgtgggagccaaccttgaggacacctgatctctcacttcttatgtcagatggtttgaattcataattctaaatatccatcctctcttgtttattagcattgttgttctggtccaggccttcatcaataaagcaattgcagcagcttactagtaggccactttgcctcatttgagacagaatttttccattatacatacctgaacacataactcttgcctacagctatggttcacaaactttactatgcataaaaatcccttggggtgctttttgtcatccagtccagggactgattctgatttcagtagggtgggagggaacccaggaatctgtatttttaataaacatttcagttggttccagtaggagaccagtctgagaaacaataaagtccaaacttatcacagcacccaaggaacaagctgttaattcaactacctacagactctta

SEQ ID NO: 249286 - DNA, 695 bp, Homo sapiens
gcagcatcttttactcagctgggtagtttcctccatatcacgggcttgagcaattactggtgactcttggatctataatatagctagtacagacttccttttttagcttcagacccacgtatcccactgcctgcttggcattttcacgtgcgtggtttatcaaaagtatgtccgaaatagcccggacattcttccgtcttcctcaaacctgttcagcttacatttgtgttgatgaatgccaccagcagccgactatgcgtgggagccaaccttgaggacacctgatctctcacttcttatgtcagatggtttgaattcataattctaaatatccatcctctcttgtttattagcattgttgttctggtccaggccttcatcaataaagcaattgcagcagcttactagtaggccactttgcctcatttgagacagaatttttccattatacatacctgaacacataactcttgcctacagctatggttcacaaactttactatgcataaaaatcccttggggtgctttttgtcatccagtccaggcaccccctttgtaggctgccgtcctttccgtcaagcccttctttggcttattatttttcctgccaggaggttacagcaagggctcggtcttgtatacaatatagttcttgatccttttagaaggcaatgtacaatgtgttgaaaaaaaaa

SEQ ID NO: 249287 - DNA, 300 bp, Homo sapiens
taccaggagggggaattggaagactaccctaagcatgccgaccggagactgtgtgtgtgtagtaggtatttcttactgggagatcacggaaaagcaagtttgagaaacactcccatcagatgggtgggccgaggataacctcaaagcctttggttctccgaataggtgcgtaggactcacccaggcactctttccttttttaaattgtggtaaaaactacataacagtggccaggcgtgatggtgcacgcctgtaatcccagctattagggaggctgaggcagaagaactgcttgaacca

SEQ ID NO: 249288 - DNA, 762 bp, Homo sapiens
gtacaggccgtagacctatcctctacctacattgactccccaggttttcttagtccagttgtttaaactaccctgtacctgctgataactcctctaaattctagactggtacatctaattgcctcttaatatcaccagagtataaaataggaaccccaaatttaacataccccaaacctgagattcctctttcctgcaaatcctgaccttactctgtggaagctagtttccaagatgtcctcaatgatccccacttcctagtattcacacccttatgtagtcctctcccacaatgagtaaggctgacctgtgtaagcactagtatattgcagaaatgatggtgtacaacttctgaggctgggtcataaaaaaggttacacgtttttttgttgttgttgttgagacagagtttcactcttgttgcccaagctggagtgcagtggcgtgatctcggctcactgcaacctctgcctctctggttcaagtgattctcctgcctcagcctcctgagtagctaggattacaggtgcccaccaccacacccggctaatttttttttttttgtattttttagtagagatggggttttaccatgttggccaggctggtcttgaactcctgacttcaggtgatccaactgcctcagcctccaaaagtgctgggactacaggcgtgagccaccatgcctggccaaaggttatggtttctactttgttctctcagctcacttgcaagatccaagtgagctgaggaccatcgttg

SEQ ID NO: 249289 - DNA, 307 bp, Homo sapiens
cggcccgtggccaggcttgcaagcctgcacaggttgactttaagaggagttcccctttccaaaaaaaaaaaaaaaatggttcaggccaggcagcggtggctcacacctgtaatcccagcactttgagaggctgaggtgggtggatcacctgaggtcaggagatcgagaccatcccaacgatggtgcctcagcctccaaaagtgctgggactacaggcgtgagccaccatgcctggccaaaggttatggtttctactttgttctctcagctcacttgcaagatccaagtgagctgaggaccatcgttg

SEQ ID NO: 249290 - DNA, 223 bp, Homo sapiens
caacgatggtcctcagctcaacgatggtcctcagctcaacgatggtcctcagctcaacgatggtcctcagctcaatgatggtcctcagctcaacgatggtgcctcagcctccaaaagtgctgggactacaggcgtgagccaccatgcctggccaaaggttatggtttctactttgttctctcagctcacttgcaagatccaagtgagctgaggaccatcgttg

SEQ ID NO: 249291 - DNA, 373 bp, Homo sapiens
aaggcagatatgaaagagccatggactgctgacctttgaaccctgagaggagtgcagagctcactcatattctaatgaagtatttttctacccttattatgattctgactcactatacttcttatcaaaattacatgatgaggaattgtatgtttgaatagcagtcaaatgagaagagactttatcatttagcaaatctatctgcccaatttcgtagcttgagacaatgcaaaaatgtcaacccatgatctctatcccattttcttttgattatctctacagcttgtaaaaatctctgtactttttttccagtttaattctatctaggttatattatacattgatttagttgaataaaatctattacataata

SEQ ID NO: 249292 - DNA, 393 bp, Homo sapiens
tttactgagggcttcctatggaccaggcactgtgctttgcaacaaaccagcatattggaaggatcgccagaactgaacacagatttaacatatcaatctgtggggctttggcaagattcttcaccactctgaggctcaattgcctgatccctgatgtggaggtagtattaacagtcttgcctgcctcggggagttgtttgtgatgacatgcactgtgagcaggatatggctccatggtgggagtatacgctaatgtgtaagattacaggttcactcctcagcagccccactttataatcccagaagaaggcctgcgagaacacaatctctgcttcacttcctggtgtatctccagcactggggcccgccagtaaacatttcctgatgacatga

SEQ ID NO: 249293 - DNA, 409 bp, Homo sapiens
gtaaaatgtgtttaggttaaatgtgacaatgttattgataggatacttaatacttttagtctttctgtggaaaagcaataaaagtaggacaagtcaacaaaccgtcttttcaaagtgatgttaggtgaagaccaccaccttcttggagaagcaggagccttcaggaagtctgagatctgcaaaaggaggtagtggaggaacaaaagggttgcatccctcatatgaaggacatttgggtaatgttttaaattataaagatggaaccataggactaaaagacagtcagtttgaagatatcaaaacttctcaattttgtttatttcatgtacagaacattaatttactgataatgagcaaatttctttgtaagtactaaagatgtattaaaagaatgattgaaataatgtga

SEQ ID NO: 249294 - DNA, 340 bp, Homo sapiens
tcccagctactcgggaggctgaggcggaggttgcagtgagccaagatcgcgccactgcactgcagcctggcctacagagcgagagtccgtctcaaaaaaaaaaaaaaagtgattactacccacccttgtcccatggaatcactcctattttgaagccttgaaaatgataggttttgaatatacctatcccttcttttttgttttgtttcgtctggttctgacaagtcattgtttcatatatataataagtatatgcaacattctaacgttatggggtataatgtactgttttgatatgtgtatacaatgtggtatgattaaatcaaactaattagcagat

SEQ ID NO: 249295 - DNA, 500 bp, Homo sapiens
aaagagtggtttcttgagatagaatttactcctggtgaagatgctgcgaacattgttgacatgataacaaaggatttagaatcctatataaacatgattgagaaagcagtggcagggcttgaaagaattgacttcaattttgaaagaagttctactgttaataaaatgctatcaaacagcatcacatactacagaaaaatctttcatgaaaaagagtcaatcgattcaagcttcattgttgcctttattttaagaaattaccacaaccaccccaaccttcagcaaccaccatcctgatcagtccacaggcatcaacatggaccgaacaccctccaccagcaaaaagattagaacttgctgaaggcttagtttattgttagcatttcttagcaacaaagtatttttaataaaagtttttaatttaatgatttgtttgacataatgctattacacatttagtagactacagtatggtataagcagaacttttacatacatta

SEQ ID NO: 249296 - DNA, 1057 bp, Homo sapiens
ataaaataaacaactgtgaaatacttagaattgtattgaataacctgaggagagagggagaggggagagagaaagagaactccacttttccctttataaattatgacaaaatataatgcttgctctttttctcaaatttagttgctatcttataagaatatatgcttattttacaagcttgaggatttgtgcaaaaaaaaagtatgtatatttatataattattccttaaatttctgtatgtgcttctttttttcttaagcataacaaaatactctttcattaattctgaatgctgtatttcgatattacattcaataattgaaattttagtgccatagagatcagggaattcttcacatcttgtaacctaaagatatcaacaaataaaacgtcttgatatttggctttccaaagcaaaacattgaaaagaactcactgtattgctctttaccttttgaaaattgttacccattagacagtggaactaagtgatactttttcagtagtgttgcctcttagtttcaggattcattttgtgactggttgttatttaagtgtgtgaatggacaagagtattgagacgactttatgggtttgatttttattaaatgattgaaatatttcattgttttccatatttctagtattatgagaagtcatgtgagattaatttccacaccattactgatgctaaattatttaaacatgagagaagtctacttacctatcatcatacatgttatcttgcagtatttctgtacatttttttaaaccttctaaaatgcttccatattaatgcattccctcctagttttggaaccagactttttttcaaatcaaaggtgaacccattttcctttaactttccagctgacttctttgtattggtaatttcgtctatacatccattttaaagagcagtgactatgtagaatcattgacgctgacactaactataaatgtttaataattaggattgatttgatgcatctaaaaccagcaggttatgctgtctttgtattcaaaatgcaataaattccattcatagctagaaaa

SEQ ID NO: 249297 - DNA, 460 bp, Homo sapiens
ttttttgttgtgaccttgtctgattttggaattagagtaaattgttgtgaccttgtctgattttggaattagagtaaattgttgtgaccttgtctgattttggaattagagtaatgctggcctcataaaatgagtgtggaagtattccctccttctcctctttagctgtctgaaaaggtcgagggtcagtattagttctttaagtgtttggtagaattcagcagtgaagttttcaggtcttggttttttctttgatggaaaacgttttattcctgactcaatttactcactacttatcgctgtgttcatatttctattttttattatttaatcatggtaggttgtatgcttccaggaattgatccatttcttgtacattatcagatttgttggtgtatggttgttgttcataatactgtcttataatctttttaatttctgtggtatgaattgtaatgta

SEQ ID NO: 249298 - DNA, 488 bp, Homo sapiens
cgtgaaactccgtctctactaaaaatacaaaatttagccgggcgtgtcccagctactcgggaggctgaggcaggagaatcgcttgaacccgggaggcggaggttgcagtgagccgagatcccgccattgcactccagcctggggaccaagagccagaactccatctcaaaaaagaaaaagaaaaaagagggaggaagggaggaaaagaaaaggaaaggaaaggaaatattgtaaggatgcagaacccacagatctgaagagctgacttcatatctgctgtttggcagggccaactgtaggacttgagcgcctgcagatttcggtattcacaggcggtcctggaaccaatccccagcagttaagcatgtataactatcaatcatataactatgtaacggttgaactatccgtcttagcaatatacaagtgtattgcaaagtgccagaccgggtaggtactcagtaaacattccctttggctattctctg

SEQ ID NO: 249299 - DNA, 3164 bp, Homo sapiens
  misc_feature (1019)..(1019): n is a, c, g, or t
  misc_feature (1042)..(1042): n is a, c, g, or t
  misc_feature (1299)..(1299): n is a, c, g, or t
atacagtttctctttgccagactagactaaagaaggagcactactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctganagacccaggttttataccatgtnttttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcntccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgcac

SEQ ID NO: 249300 - DNA, 1144 bp, Homo sapiens
atacagtttctctttgccagactagactaaagaaggagcactactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacgggtagtgaagcactttcagatattctcccagctaggcagaaatgatcaagatgttttctgtcttaatcttggtggcaattctattaatccagttgtttaagccaaaaatcttgggaatcaccattgattcctttcctttatgtcactcaagcagtctctcagtaaatgcttttggctgtaattaaaaatc

SEQ ID NO: 249301 - DNA, 264 bp, Homo sapiens
cttataaaggcaatactggtttgttgttccaaagataaaagacaataactgggttattcacagatggctgttcatttaccatttttacatagtaaaatttatgtgtattatggaatttttgtctcaaatcattatggaagaatacaagaagtcttgggacttcatcctggctcctgatcaaaattaggcacatattcaattaccggataaatgaaacttcaggaattatatccaatagtttttttttttatttaaaaatttatc

SEQ ID NO: 249302 - DNA, 742 bp, Homo sapiens
tgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaattt

SEQ ID NO: 249303 - DNA, 744 bp, Homo sapiens
gaggaggcaaagctttggggcgggagaggcaattttcacacaacggaagaaagttgagagtttgtaagggagaaactacaggcgcttggaagcctgctggctctcagggctcccaggctggcggcagtgtgaggaaggactgaaggtatgtgggctaaacacaacaaaagccactgccttactctagattaaatatgcaggaagaggcccctttgcataaacacaaacactcagcaaatgaataactggctcaatcagacgcccgctgtgccttctacctgtcctcactctgacaggagacactgcctattccaggggacaccactaaacaggagtcagttaaatgttatgttgctataataacaattaaaatgaattgtattcattagtaattaagaactcactcgtggggcgggggggagtgctattgttgtatctccagctactccaaaaagaacttgtagtatacccatccctggagttctactatgggttgcatttcaatctttaacattcaacgaattttaaacaatcggtttgtttagtcacaattgtcagatatacgtctcgtttctctgctttgtcacattgtaagttgatacttgtgactctgtacctacaaagatctgttatatatatgcatataaagtgtacatataaaaatatatacacacacatatatatatgtgcatatatactcacacgtaatacattcaagcatatctagttaaagagaataagcca

SEQ ID NO: 249304 - DNA, 395 bp, Homo sapiens
ggtctggacctttacgtttcacagggaaaactgtgttcatgctggtgtttgcaacttggggaatactgaaaattctcgggctctgtttcaaggaaacgtgactcctactgtgtgtatcatttctgtggcttctgctggccttgaaagcatttaggtgccctggtcccgtgcatggaggaagcagcggtaactcgaactacagcgtatcttccctccaccagcaatggctgagtctgatttccttctgaatccgtctaaggggaaacacgctttatccacagatgcaagaactttcttccaaatatcaacattctagtcttaggcaaagaattcgcattctttctattattttgactctgcttcttgcaaaataaaactcctggcatcatggcgct

SEQ ID NO: 249305 - DNA, 298 bp, Homo sapiens
gcccctgcaggagccatggagggaagtcactcagttcatggagtcaggccacatgggaggagaaggcagcctagaactagccatggtgaaggcttcccaggcagttcacgcttttgaaaatggccctgagagagatgctatcaggaggcgtatttaatgggttttggaaattggctaattttgccacaacggtctgagtgttatccgatgcatgctaagcatctggggccagcgtgcccaaggccttcaaagagatttgacagccgggaaggctgggcaaagtagctagtggtttcca

SEQ ID NO: 249306 - DNA, 1006 bp, Homo sapiens
  misc_feature (19)..(19): n is a, c, g, or t
  misc_feature (937)..(937): n is a, c, g, or t
tgttttgtttttttgaganggagtctcgctctggtgcccctagctgcttggccaacctgcctgtttctctagataatctcatcttggcgtagccccagcaatgatccacctgcctcagcctcccaaagtgctgggattacaggctgggataatgagccaccatgcccggccttgctccacagtcttacagtgtacacagttgaatattgtcatacacaagtataacgtaaaatgaatacatccttgtctgagatctcagataaaaagtgctctgctctttcctgtttagtatgatataagtcattgatttgtcatacatggcctttattgtgctggggtacataccatctatacctaatttgttgagtttcttaaagcacaaaggcatgttgaattttgccaaatactcctacatagaccagcaaaataaagatgtctagatgtctagtggcaaacttaattaaaaagggtaaccacgctctacactgagaattatataacattgataaaaaactgaaaaagacatgaaaaattgaaagatattttttgctcatgaattgaaaaaatataaaagtggctatactacccaaggtgatctacagattcaatgcaatctctatcaaaatgccaatgacttttttcacagaaatcggaaaaaaaaagattaaaatgtatagggaacaaccaaagacccacgaacggcaaaagtaatcctgagcaaaaagaacaaagctaggagcatcacacttcctggttccaaaacatactatgaagctataatgagcaaaacaggatgatactgacataaaaacagatgaaagtatccagtgagcctagcaataaattcatgaacctagagccaagtgattttcaacaaaaatgtccagaacacacagttggaaaaagacagtcttttcaataagtgttgctagaaaantttatctacataataaaaaaatgaacctaggcccctacctcttatgatataaaaaactcaatcacaaat

SEQ ID NO: 249307 - DNA, 1250 bp, Homo sapiens
  misc_feature (1181)..(1181): n is a, c, g, or t
gaggcaggagaatggtgtgaacctgggaggtggagcttgcagtgagccgagatcgagccactgcactccagcctgggcaacagagcgagactccttctcaaaaaaacaaaacaaaacaaaacaaaaaaacaaaactctcaatttacacaatctttcaggtcctagggtatattcacgtttgataccccatttctttttctcttgagcatattgcagggggggcaggttgttaggtacagttgagataagggccataaggagttccccagaaagggtggtgcccctagctgcttggccaacctgcctgtttctctagataatctcatcttggcgtagccccagcaatgatccacctgcctcagcctcccaaagtgctgggattacaggctgggataatgagccaccatgcccggccttgctccacagtcttacagtgtacacagttgaatattgtcatacacaagtataacgtaaaatgaatacatccttgtctgagatctcagataaaaagtgctctgctctttcctgtttagtatgatataagtcattgatttgtcatacatggcctttattgtgctggggtacataccatctatacctaatttgttgagtttcttaaagcacaaaggcatgttgaattttgccaaatactcctacatagaccagcaaaataaagatgtctagatgtctagtggcaaacttaattaaaaagggtaaccacgctctacactgagaattatataacattgataaaaaactgaaaaagacatgaaaaattgaaagatattttttgctcatgaattgaaaaaatataaaagtggctatactacccaaggtgatctacagattcaatgcaatctctatcaaaatgccaatgacttttttcacagaaatcggaaaaaaaaagattaaaatgtatagggaacaaccaaagacccacgaacggcaaaagtaatcctgagcaaaaagaacaaagctaggagcatcacacttcctggttccaaaacatactatgaagctataatgagcaaaacaggatgatactgacataaaaacagatgaaagtatccagtgagcctagcaataaattcatgaacctagagccaagtgattttcaacaaaaatgtccagaacacacagttggaaaaagacagtcttttcaataagtgttgctagaaaantttatctacataataaaaaaatgaacctaggcccctacctcttatgatataaaaaactcaatcacaaat

SEQ ID NO: 249308 - DNA, 481 bp, Homo sapiens
ggtgcagtcaacaaatatttactgagtgactaatgtgtgttatgcactgtgttcagcactgcaaaaaataggacaggtgtagaaggctcctctgccttcgtggagctcatcttctagtgagggagacagacattaaacaaacagacactacagattaagtattagaaaggaaacagggtcatgagttagcaagtgaagggcaaaaaccagggaagaggggaagaagtgactttaggtaaatttaatttcaaagcccaatccctatataccttaagattatgaaatagggtttatctcccctgtccccataactgtataacacactaaccagttattattataattatttttggagacagggtctcactctgtcactcagactgcagtgagctgtggtcaaggcactgcactccagcctgggagagagagtaaaactctatctcaaaaaaaataaaaaaagaaagaaaggaagacagaaaga

SEQ ID NO: 249309 - DNA, 398 bp, Homo sapiens
ggctctttcagtgatatgaagttaaaaccaggtactgtgttcgctcacctgattttggttcttatgaagtgcttttttgtgtggatagttgttcagctggttgttcttctgaaggagatgattactggaggcttctattcagccatcttcccctgcctcctcataattgctatctctttattgattttctcatgttgtttgtatattggttgtatatcattttcctgatttccatttattctttgtctatggtttcctttagctcataaagcatatttaagacagtcgatgatgtctgtgactagtaattccaatgtctgtgcttcctcagagatggtctctgtcaaaagaacttttttttactataaataagccatacttgcccgtttctttgtatg

SEQ ID NO: 249310 - DNA, 783 bp, Homo sapiens
gttatctccgaattggccaattgatggtttcagcagagcatttcagcatcggggaagccaatacaatttgagttagttgtgatggctgccactttaaataccgcagtgaatttctgtcagcgagctaatgcgtggaatagggaattgcagaaaacttgatcatcagagtgcttcagtcgattctgaccccaagctacagaaaatgaacttaaatctagttgactgtcgccacatactttctttggtgttattttgctggcagcgtcttcttcagagagagctggaagagaagagactaggaggaaatcaggatgtttgccgcgggtccctgggattttagagagtgacagtcttcatgggaggttgaccattgggagttggggtggtgagttcttggtgagggataaatttctaaacgacagcattatggcttagtaataatgagttttctatttaacaaagcaaaccagtgcttattgagcacttactatgtgttcagacccttaaaaggcattcttaggtatctccctgttggacaatgtaggggacaggcattcctcccatttcgtgacggaagaactgataacaatagcaaacaattattgagtgctaaccgtatgccaggcactgttgtaagtgctttaggttttgtctattgtcatactcaaaacagccctgtgagttaagttctgttattcctattttgtagagaaggaaatgaggcacttagagggattcagtcatgggcaaggtagacttaataggtttgtcttcttaatttaa

SEQ ID NO: 249311 - DNA, 729 bp, Homo sapiens
gttatctccgaattggccaattgatggtttcagcagagcatttcagcatcggggaagccaatacaatttgagttagttgtgatggctgccactttaaataccgcagtgaatttctgtcagcgagctaatgcgtggaatagggaattgcagaaaacttgatcatcagagtgcttcagtcgattctgaccccaagctacagtgctggcagcgtcttcttcagagagagctggaagagaagagactaggaggaaatcaggatgtttgccgcgggtccctgggattttagagagtgacagtcttcatgggaggttgaccattgggagttggggtggtgagttcttggtgagggataaatttctaaacgacagcattatggcttagtaataatgagttttctatttaacaaagcaaaccagtgcttattgagcacttactatgtgttcagacccttaaaaggcattcttaggtatctccctgttggacaatgtaggggacaggcattcctcccatttcgtgacggaagaactgataacaatagcaaacaattattgagtgctaaccgtatgccaggcactgttgtaagtgctttaggttttgtctattgtcatactcaaaacagccctgtgagttaagttctgttattcctattttgtagagaaggaaatgaggcacttagagggattcagtcatgggcaaggtagacttaataggtttgtcttcttaatttaa

SEQ ID NO: 249312 - DNA, 591 bp, Homo sapiens
aagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagactgaataaccctctccatgatgatcccttagagttcccccactgtgcctttttctttacatgtgcatgcaaacatgtgtctccacatacattttttttaacaaaaattgaattatgttgatatatgtcctgtaatttgtgttttaaacttaatatatcttaggcattttccctgtgtgtgtgtataatgcagctattaaaaatgagtctgaggccaggaat

SEQ ID NO: 249313 - DNA, 723 bp, Homo sapiens
tccccagcctcttgtatagagcctacacatagcaggcacttacttatgcataatagtggatatgaaccgtatggaatacttcctcattcctcatcactcatcatttgcctggtgaaatgctttgtcccgaacctgccctatattactttatacatgttgtaccttcttcctgctatgttattcttcctcttgcccctgtttccaccccatccacctagcaaatttctgcttttattatctcagtgaagctttcacccagctacagtcaggcattccctcagggtgctctatctctagtctgctatgaatctattaatagttgtaatataacttttctcacctgtgttttacacacatatacacaacacagatgtgcacatatatgagtatctgtaggctgggagtttaactactacgacagttttttttggtttccccaggggtttggcacacatagccttattaaatgtgtaaatgaatgagtatagaaaaaatttgaacttgtaaacataaatagattttccccagtctcggcaacatagtgagacctcatctctacagaaaattaaaaaattagctgggtgaggtggcacatgcctatagacccattgacttgggaggctgaggcaggaggattacttgagcctgggaggacaaggtgccgtgagccgtgatcacaccactgcattccagcctaggtgacagagcgagaccctgtctcaa

SEQ ID NO: 249314 - DNA, 451 bp, Homo sapiens
atctcctgacattgtgatcagcccgcttcggcctcccaaagtgctgggactacaggcgtgagccaccacgcccggctaagagcttatattcttaaattttgagtaattaaagggctctggtcaactgcttgagatttagtgtctaaggatacctatttaaaattagagcacagcttttgtccaataaaatgcaatatatctaattgaactgacaccgatatctagttaacctgccttcaacaggctttcatacctgttactatgtcacctttggctgtttccaaaattagctttactttccagagactaaatcctgtattaaaaaacaactgtagctgggcatggtggctcatgcctgtaatcccaatgctttgggaggccaaggcaggattgctcaaggccagaagttcgagatcagtctgggcaaaattggttgagagtctatctctac

SEQ ID NO: 249315 - DNA, 275 bp, Homo sapiens
gattgcagactcagctcttggacggctaagacgaattccgccgcctcaatttttaatcattcattgagcaggtatttatggaacaactaggaagtgccgagcttcccgtatagcaggaaacgtgcaccatcaggtagtctatggacagtgtctatggacgctggagtgtgtattttgtgacatgggaagcacaagaggttaggggagcaataatcagaggacccgaccacattcatccaaacgagtaagtagcacccttatatttaaaaagaaaa

SEQ ID NO: 249316 - DNA, 505 bp, Homo sapiens
atttattagagttagggaataggtatgtagctaattgggggaggaaaagacaatgaaggaaaactcagatatgacccttccccaaacatataaacaacttggatacatgagaaatgtttagcgtattgttgccttcttatgttgtattgtctaagtcattttcttattgagtgttttggattgttgtctcccagaggagaaatccctaggtattttatgtgcattgttttgtgaataatttgcagttttactcaaggattgttgtctaatggttccctctcagtctagaagtttgtcagtaaaggtacacaataataatgagaagcagaataatttagtaattaagagcaaggattctggagccagactgcttgggtttctggttctactcaccagctgtgcgaccctaggtaaactacttaacctctccgtacctccactgtttgatcagatgtaagaaaataatcacatctgccttattagtttgtagtgagaataaattgag

SEQ ID NO: 249317 - DNA, 453 bp, Homo sapiens
agaacatgtggtgtttggttttttgtccttgcgatagttttctgagaatgatgatttccagcttcatccatgtccctgcaaaggacatgaactcatccctttttatggctgcatagtattccaaagaacatgttttgtatacagttctactgaccagatttgtaatccctgagtcctgttcaaagcttgtacattgtgggtgctcatttgatgtttgatgaatacatgtatcactataatggaaattagaacactatatttttatttttggaaaaaaacttaacccatcatttttctgtacttcagagttttatcatttgtcctataggagtttttagctctaaatatcattggatttaggaggaaacattatcaaaagcagcactcttcattagccaagttagcagatttttctctgaagattatatagaatcttacaataaatcctcagct

SEQ ID NO: 249318 - DNA, 588 bp, Homo sapiens
agtagtgcagcagtccaagaaagaggcagatttctaccttgaaagccccactggaaagaaggtcctgcagccagatcctgcatgtaagcaccctggggagatggttaaattctgctcctttgacctgcaggcctaaccgtgaaggctactactgggcagggagctacttaagacaactgctcggctgacatctcggagtgcctaaaatgaacttctggccctttcatcagtattcctcattctcaaaatgttccctttccccaacatcacccatcatcagaaaaacccaaaagacaggtaataacaaaggctggcaaggatgtggagaaaaagaaaacctcatacactgttggtaggaatgtaaattagtacaaccacaatagaaaaccatttggaggttccttaaaaactaaaaatagagctatcacatgatccagcaatcacactgctgggtatataacctaaagaaaggaaatcagtacatcaaagaggtatctgcactcctatgttcattgcagcactattcacaatagccaagatttggaagcaaactaagtttccatcaacagatgaatgaataaagaaaat

SEQ ID NO: 249319 - DNA, 433 bp, Homo sapiens
tcctggtgttgaggttgttaactacgctgccctaagaaggaagaaactgtgacttaatcgggcagggtaattcttttccagggcaacaacaggaataagccagtcagtcaacaaatattttttgagggtcagacatagtgatggcctcagacctcagagactacacaaaggtcaagatgaagagagctccagctcattctggagggagacacagaaaaggccagaggcactgggagataagaaataggacggggaaacctgaaaactgaagacaaacgcgccgcctgtgcaaaggctggacagccccagagaatggtcagagtttaacatggacctggccagcgaagcttccagttctgcctgtgttgcaggtgacttctatttccccatgtgatctttacacttgttggataaagtgaaccacttcctctta

SEQ ID NO: 249320 - DNA, 483 bp, Homo sapiens
gcacatatttatcatccttcagatcctcctaatacagcctcctccagaacactgtgaccttcagcaatcttgagacagtgcattgtcagtagccttagtgttgaatgccaccaagccccaagcgatgcaggtcaagctccccatgaactccatcgccgggctacttcatgtcttggcaccagagacttacagatcccagtagtcagcaagaactcagctgaggatggaggtgccagtctctgcttcttgcagaacactctgatgttgacaagtgattttctcaatgttccaacagggccacagggagaaaacacttccctttctccccttccatgacatggagaggaacaagaatggcctccaactgtgaacacagcatgcccctcactgtagcccacttcccagtctcccttttatttcgtctagaagccaggcatgaagctctgatctataatctgtgaataaactcttgggaaagcgaaa

SEQ ID NO: 249321 - DNA, 213 bp, Homo sapiens
atcagagtaaacacagaaacctcacatctcagggaggtttgcttaacaaacatatcaagacctgggatacctggaaaactgcagatgaaaagaatatgtctaagatcctgttaacagcagaacttagactgctagccctgctggaaattttccatgctcttcattcgttctcctgtatttcctaacgccaataaaagaggagatccctgagga

SEQ ID NO: 249322 - DNA, 338 bp, Homo sapiens
gggttcaagtgattctcctgactcagcttcccaaacagctgggattacaggcacacaccaccacacccagtagagatggggtttcaccatgttggccaggttggtcttgaactcctgatctcaggtgatccacccgccttggcctcccaaagtgctgggattacaggcgttagccaccgcacccggccaagaatttaacttacatctttaaccaaaaagctaagaaactgtgatttaatttttgctgttcttcattcttgaggcaagagtttcaatcgaagttgaacgtaattacttttccctccaaaacctattcaggctctaaaaattgctgtctt

SEQ ID NO: 249323 - DNA, 427 bp, Homo sapiens
tattttgtttcatttgtcataatattgtaaaatggatcatatttttgtcaaggctgtattttaaaacccatttttatggtgtcatacttaacatatttggctaaatttctatagcaacagcattttgaagagtagtcagccttgtctatttaacaaatgtatataaatataactggttgggaagagacaaaaacaaattctatacagaggtttagcaaatgaatttaaagtaacaaatatagtaatgttgaagttaggctttttttaaagaagtgtctctgagactcccaagaaagcaattaaatcaatagcaaatagaaaataaaaatagattacactataaaactttatgtaaattatttgtatacaatatatatatttgtgtgtgtgtgtgtgtgtgtataaaaattctacttgtaatgtatat

SEQ ID NO: 249324 - DNA, 386 bp, Homo sapiens
gatgacaccgtcgatgccgagttgttctacagatctagagcacacatgaccgttcagaaagtgatggcacgatcccgacgatctgctcgagacacccgctcctcagccaggctaagccagagttctcaagattccagtcctgttcgaaatctgcagtcttttggcactgaggagcctgcttactctaccagaagagtgacccgtagtcagcagcagcctaccccagtgacaccgtaaaaataccctcttcggcagactcgttcatctgcttcagaaactgatctataggagtggcgcaccactcatatagatcagttctcagttcttgtctttctagacctatcaacagcacttaaacagctgatcaatctctcccccaagaactg

SEQ ID NO: 249325 - DNA, 367 bp, Homo sapiens
tcgtagggctgaaggtggcagagtactctacttctcgctgttgcgtttctttatttgacactcacctaagataaaaccttttgtgactcctgactcttaatttttctcctgtttctcagttgacagtggacttatgcccaaactctagctgaggagtggaagaacttgaatagaacctcatccaaattcctgggtagcaagtctgtgttcctgctggtgatagtagtagtaaagttattgtagtgtttgcacaagaaaaatgtgaaaattcaggaccaagtttgggggaaaagtagagcaaaacaaaatagaagatcaaaagctgggaattagtaaaaaagaagtggatgaggaagaatggtatgaa

SEQ ID NO: 249326 - DNA, 373 bp, Homo sapiens
tgtcctttttaattgttgttgttattgttaattctgccttattctctgcactgaaaagaaaggttgggtgatgttctgccccccccccttttttttggcactttgaggtgacattataacataaaggttgttgcttttttctctccaatatttgatgtattttcaaaggctttaaaaaggaaataactaaatttaaagtaccacctgtcttgtttaatttgctttaggaatttatccctatatgcttagttagaatgataggattgatattgcgtagtaatttctgatgtttttgttttagtttgtcaaaagtaaaactaaatagcatgaatttgcgtctgtaattaaagattgaccgcgcttgaataaagtt

SEQ ID NO: 249327 - DNA, 212 bp, Homo sapiens
ggtgagtgaggctctgagacatgccgcctcccatggcgcctgaaagcgggtgcctctcatcctcccctggagtccatgcatgtaagtccaaggcagggagaagagacttcattttagctacagtcaattcagagtgaggaatgagttcttagttcctagaggagagaatatgggagtctaggatctgagaaactgaggctgtttctgccttg

SEQ ID NO: 249328 - DNA, 395 bp, Homo sapiens
cgtgggagttataaaatatcagcgacgcctctgggtgggttcgaaccgccaaccttttagttaacagccaaacgcgctagccgattgcgccacagagacatggctgagctcctgatttcgttctaaaagagggtaagctgtcactaaacgctagctagcaccatccgccttttgcaaaatgattgggtaatctccaaagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctca

SEQ ID NO: 249329 - DNA, 402 bp, Homo sapiens
gcccttctatgtctgtctagctcttggcttgctgccttgccacctgggcagcttgtccttcaccaaaaggtgtgtcccaggtatctctgcacatctcagcatccacaccaaccacaccagaccctaggggagaggagagtatttttcccatccaaactatgtgcacgtatgtgcatgcttgtggacacacacacacgagtctaaagctataccttgaaaccccatttcctatcacagaagaggattaaccaagaaaggctttgggctaccaaaaactgaaagtggcaaggaaggatccccacctagaggcttcagagggagcatgaccctctcaacaacttactttcagacttctagcctccagaactatgagaaaataaatgtctcttgttttaagcaact

SEQ ID NO: 249330 - DNA, 416 bp, Homo sapiens
tccactgctccccggggggacccccacaattgagatgagtgtgagtcatcatgcgtcatcccacacaggccctgctgcacacattcacactgcctacccagctcctgcaggcattggacagtgtaatttcttttgttgggacactgaggctgctgttgtaaaccaaagaccttaatgtcctcctggttgtctgtgtggtggggttgctagatttagcaaacacaaaatgctgaagcagaacaaccaccacccaagaacaaaataaaatggaatgtccaggtaaatttatatttcagacaaacaacgaatgatttttcaatataagtatgtcttcagtactgacattttctctagcctctttgtgaagcaaagcagcattggtgctgagatggtgtcctgaccttgtatttctggta

SEQ ID NO: 249331 - DNA, 434 bp, Homo sapiens
gaaactgccatactgttttccagagtagctggtttcacttttccaccagcaacgcatgagtgatccagtttgtccacagcctcaccagcatttagtgttactactgtttcttactttaatcattctgataggtgggtagtgatagctcactgtgatttttaatttgcatctccccaatgactaatgaacatcttttcatgtgctacttgccatctgtacatggtcgtcagtaaaatgtctgttcatgtcttttgcctactttctaactagactcctttgaaaatttctcatattgtttttaacaatagattttaaaagaatttacagagtaagaatacatttttgagacaatggggaaaatgatacggagtgaaaggtgatattaaagaattaatgttaatttcattatgtgataatagctgagtggctgtgca

SEQ ID NO: 249332 - DNA, 443 bp, Homo sapiens
tcagtctctaccagattctttcaaatgctaaagcaacctcttaaccattagtactaattcagctttctgaagccacagataaattgctattttctatacaatgttaccagatcgataataaatacctaatatatgagaaacaattgtaatgtataaatatatattagttttcattagatttatatttcttttataaaacattataaatttaaccatttatggtgtttattgtacatttaacttagaaccttaagcacaacatcttttaaagaaaccttttttaaaataaagcattaactagaaatgttaaaagttttgaattctgaaattaaaatcctttatgaattgtagcttcatacaatttaaatattaaaattcagtgttttcatttgtagcatgtttgaatacacagatgacttcagattattaaaagttataaaatc

SEQ ID NO: 249333 - DNA, 405 bp, Homo sapiens
caaacatgtgcaggcaaaacctagttactttaggcctgccagagtcccagactgtgcctctgggtgcagggggggactgtcgtcctagggctagatctgattggccccatttcacatggaagcatcaggctgagagctcatgatagcgtctgggacagcgactgcccaatctccctggagtctctgagcctaaatctctgggaggcccttttatcctgctcctactcgggtgcctctccgtgcctggactgtatcccccacacccacaggcaagccaaggcaagcaacattgtcatacgatttttttcttccctgaagcaaggaagatagtcagtcctaagggacgatgaagcctccaggtctgtctctgtcctgggggctggaagtgggtgaaaaaattattga

SEQ ID NO: 249334 - DNA, 509 bp, Homo sapiens
taaaaatattattttaaatactaacttagaaatggaaaaagattttaaaagtccgtgctgttactattcaacaacatggttacgaactaatttgtgttttccccacaattcataggttgaagccctagaccccaatgtgactgtatttggaaacagggcttttaaggaggcaattaaggctaaatgaggacattaggatgggcccctaatccaacagtgctggtgtcattatgagaaaaggaagagatgctttttcactctgcatgcatgcaccgaaaaaatgttgtgtgagattgcctgcaagtgaagtagagaacctcaccaggaaccaccttgctggcacctcgattttggacttgcatcctccagagctctgagaaaatacatttctgttgtttaaactacccagtctatgggttttgttatggcagcccaagcagaccaatacaaacatgtaagcatttttagccaattcaatacaaaaataaactaaaataatgaaaattaaa

SEQ ID NO: 249335 - DNA, 415 bp, Homo sapiens
gatagcattggggtatgggatcagacccaaagccccatgatgcagagtcacataggaaagccactatctggtgctcctgccctgggaagaacatcagttgtcctctctcttgggacgaatagaggcatcccaaatcgtgatcttggatctgctgtgccttcactgatcctattcccctacaaattcatttcccgggaagttcctaggaactggtgtcaaacatcctcatactttccttcctttctcatgaaactgttctagtatctggctgatatccccgtgtctacctttacgtagctcagtttttgttgggtttttgttgctgttgttgttgtttgcttgtttttaatgtgccaacattatgtttgggcttttttgcttgctttttgaaataaatttttacaattcagaattc

SEQ ID NO: 249336 - DNA, 703 bp, Homo sapiens
agccactttgcaccatggcttcgtctctctgtgcctttaggcttcccacatgtgaattaggaaggtgggagctacaggccaagggcgtcccacccctagccttagcctgtgcccctaggtgaaaagtgctcagtggcagcccctgggggaccctgcaggcttggcccagcctccacctccctcgtccccacctgctggctgagcgggtctctctgcttccagtttccaactctttgcagatgccagttcccatacctggctcacgcctatcaaccctcccagcctagcaggaatgacgctaggtcttccctcacttacagtctggcggtaccctgctatcacctgtgagacatgcacacttgacacgtgtcagacacaatcctgagccttctacaagtgttccctcttactccttgtggccgtcttcaaaagtaggtccttcagcaccataggaaaggttaaaaaaaaaaagtaaattctgttacagtgctttttacagacatggaaactgaggcacagagctagtgactgacccaccaagggaggtggccaggctggggctctcctgggtccacctccagagcttcctcccctaacaccgtgcggctcccccatggcatgcatagtcacagggaatgacacactgatttctctttggcctacatctacctccccgatgtgtttattccacgggcacagggac

SEQ ID NO: 249337 - DNA, 450 bp, Homo sapiens
ttgtttgtgcctgctagagaaaggtcagaaagccactgtagtaccagccctgcttcctgaagttcagctgctttgccctgttggggcagcagcagagggcctcagcgtcattgcctgatgggatgctcagcctgacaaccaacgttcctgtggccacaatgcccagcattaacagcagcttaaattggaagagtcagccagggcaggggaaggacaagtattctttctcatcccacctgtgtcaccccaaccagctgtatgcctgaaggcaaattacctcccctctctgggccttattttcatcattatggaaggggtttaaatgggctgaccttgaaggtccctttgtcaaatatctatgagtcacaggagtgtctattgaagacagagaagtagtcagcccatttaagaaaaatttccatccagatagtttaaataaaacattgggtt

SEQ ID NO: 249338 - DNA, 423 bp, Homo sapiens
gtccggcggtttgcccagtgtagaatgactctttgaattttggttcccgtctgggttgagggagatgcagcagcagcacagcagagtagccgcatcagtgactgttacggggaagtgtttagatacagcctcatcttagagaagtagttctgatcgggaatgcttattgatgggaattgagttactttgtaaagccaatatgatatgagcaaggaaacaaagacctgactacccctggggatgttacctccttccctcaccctcctttagtccttggtggtgtgctggtgccattcctgcattttagtctggaaaaagaatagaagtccttagttctatttaagaagtggttactcctgaagatgatgctttccgtctttacttttaaacaaatcaatactatctttttcctccaaaaaaaaa

SEQ ID NO: 249339 - DNA, 611 bp, Homo sapiens
gtatgcccattatccttccctgacaagccaggatcagccctgaggattagaggagacttcatcttccaccacttttgtgatcagatatggtccagtgtttgagcgtaaaaccactatgtgaataacacggcataggtcacgtaggttaatattgacttgcagtatgtatttgaagcaggttcttgtctggaaaaatatatacaaatgttgaattgaatgcctaggtgaataggcaggtggaggtctccatcccaatggcttgccagatcttttggtgacccagttatgctgtgtcttttctgagtttcattctgcattgggaaggtagctggacaagttctttttctgcagcatttttcagaaatagcagatatgtcctctctgggcaactgtactttggatttgggaaactgtacttcacccagttctgggactccaactcagcagttttcaaatttagcaggtcctgttccgtagtttctttgtctaatagagctcggttgtaatatctaacttgaccagaaggaggcgctattgttaagcaacacagtacactgaaaagtctggattttagactgtgggtttcctcaataaatagcttgtcttccata

SEQ ID NO: 249340 - DNA, 316 bp, Homo sapiens
gctttttggaagttgggtgagagcacgtgaaaatgctttgtgagttgtggtcccctttgagaaggctgtttcagatgtgcaagaagaaggagacactcagtttccagatggggacactgaggctggtgacacagcaagcctggggccaccactgacttgagaaaacctccacctaagaggctggcgcccgtgtctgtgtctgtgccatcctttaggaattttgcagctttctttgggagaggctgagagcttcctgtggcctttggccatccagccggtgctgagggggcagatggcccagtgggcaggcctggtg

SEQ ID NO: 249341 - DNA, 436 bp, Homo sapiens
aagatggatacaatgtataattgagattaaaaataaccttctctttttgggtagtctgacagtttatcttaaagggagggttttctttgttggaaatatttctgaatgggcttactagaggcaaaggctgagatcaaaaggcatctaagcctggggggatgggctctggggagccctggtatggatctagctatagctaaaggggaatggggctggatgtggagtttgagaacagcttgggcaatagagtgagacttcatctctacattttattgtttgtcttaaagttagcagagtatggtggtgcgtgcctgcagtcctagctactctagaggctgaagcaagaggatcccttgagcccaggattttgaggctgcagtaagctgtgtctcacccctgttctttagtctgggcaacagagtgagaccctgtcact

SEQ ID NO: 249342 - DNA, 345 bp, Homo sapiens
gctaaaggttgagtttgtctgtttcatcctgtcttggctgatcacatgcacatacaaccacacactcacttgcatacaaacatataagtatgaggagaattcaaaatgttcatggaaaaatgagattaaaagataaaagtttaaagatgtaaactttacttctcaacataagcaccatcacattcaagatactgttataagctatgatagcggccatttagtccatccctaaagaactgagggtcctgggaatttaatcacatcaatgcaatctttcttacattgttaactaaagaaaaatgggtgccctttgaagatttttaaagattaagtaacaaaaaaaaa

SEQ ID NO: 249343 - DNA, 475 bp, Homo sapiens
gtctaactgtcaggcggtggcagtggagctgcttctgaccctgcagctggtgctctgtgtcttcgcttccaccgacagccgtcagacatcaggctccccggccaccatgattgggatctctgtggcactgggccgcctcattgggctgtctctccaggaggacacaaagaaaagatcaagacagcatgtagcaaatgtagcaaggaggcatccaatcatctgcaacccaaggggcaaaccctcgccacacaccaaccctgctggctccttgcttttggacttccagtttcagaattatgagaaaatacatttctgtgtttaggccatcaagtctattgtattttgttctgacagcctgaacagactaatacacagtataatacaattgaattgttgattcatctaagaaatatataatttctacatggtttgttgcaattatctgggaataaatattaccatgaccacttaaaga

SEQ ID NO: 249344 - DNA, 436 bp, Homo sapiens
agcccatctactcacgtgcccttgactgaagatgggtccttctccatcgcggatggtcatcctcttttaccgagcacacagctttggaaggaacgcatatggagtgctgtctctccaggaggacacaaagaaaagatcaagacagcatgtagcaaatgtagcaaggaggcatccaatcatctgcaacccaaggggcaaaccctcgccacacaccaaccctgctggctccttgcttttggacttccagtttcagaattatgagaaaatacatttctgtgtttaggccatcaagtctattgtattttgttctgacagcctgaacagactaatacacagtataatacaattgaattgttgattcatctaagaaatatataatttctacatggtttgttgcaattatctgggaataaatattaccatgaccacttaaaga

SEQ ID NO: 249345 - DNA, 1259 bp, Homo sapiens
cgccgcacttctccctgtagcggcgggcctgaccgtccggaacggccggagtgtgctgatgcctgctgctatctgcttgatcccttcaccctacctctcatccaggacttcttccgcggatgcgcagctagcgatttcgacaggcgagattgaaaattccgggcgagtatatgaggttgagtaagtcccgcttcagggaggaacgaccagaatgacatttctttaagcctaaatcaaacttttattttcgtttataaaaagcagaaggccagcaggaaagggtcgcggaggactggcacatccacaaccgtaggactcttggatccaagtttttaggctgagactgggcggtccggggttctccttcggcgctcacaccccgcaaactcgtgggcagtgcagtgctggaggccgggggcagtggcggacccgcagggtaaccttgtctcgcgcacctcccgagcccccagcagcccactctcgtccgaatgctttgtttatttggtgacaccagggaacgtggagaagaagatcgaagttcagtttttcttttttctttattttaaatatttttcttaactaaatggtatgtttatgtgaacccatcatctcttggaattaagtgtcctcagcgaactccagattcctaggggaaacctacgtgcccagagcaggaaacgcacaagtcaattcaggttccggtgccatccgcagtaaattcccttccttttgctccaaattcctcctctgcgtccaggagagggacccccgggactcccgcacacccaggaccgggagcggcagagcagagggcgggtgcgagggcgcgagggaagggaggcggcctgcggacctggggcgcgcagtttcccggctccgtgggaacctccaaccccggggcgcgcggcctaggctccgccctgccaggcttggggccgagcggcccacctagtgggtcctgacctggggaagccgagtccgcgcgcgggtcgggccgcgacgagggaagctcgcctgggcaagtgccgcgcggggtcagacccaccccaggggttgcaaaccgcaagcgaaagtcgagaggggctggagctttccctctgatccgttttacactgtgaaaaccgcaggcctgtcgcctaggcggccacttttaaattgggaagcaaatagacgaaaaaccaaaacaaacgtacgagctgacttttcccagctaagtttcccctcaataaaaagcccgctttctgggaaagacagaaact

SEQ ID NO: 249346 - DNA, 468 bp, Homo sapiens
ttgccccgactacacttattatttttaatttaaaaaggtgttttttaagtagaagtgttggttttgtaatcctcaggtgttctggaagaaaaggatttcagaagcatgacagtctcccgtgtctgtgctaatggtgtgtttagcataacgtggtggggagttccgtggttctccaggattctcctcactgttcttttcgtgaagtgaatcgttcatttgataatcgtgaaatgcaaaaagcaaggctgtgttttaatggctgtgaagtgggaacggggtagccaggtttgaggttctgtttccactgaaaatacctactgacagagaagccagtaccaggtaatactgttttgttatctgcaatgccagtcttcaaatgattgtttttcttggaaatagctaaactgttggggaaaattaaacactgagattgaagtttagtgactgtgttaataaaacaagggaaat

SEQ ID NO: 249347 - DNA, 381 bp, Homo sapiens
aaaaaaaaaatctggacatacccaagctgtgtatgtgcctgagatcttcccttccaagtgatttattaaactgggaagtcagaagcagtcctgtgaacatttgtttgttgaagcatgaaaaggcagaattgatgagtccttgcttgagtctatgcctccacccagtagtttgttcttagtctcctaggggctgatctcagcagagaaatggagacagttcagtcaccaacagtttgttactggattttggaaaaggtaccaaagtaagaatccaaggcttgtattcttatcttagctctgtgattaacaagcttaggtaaggcttctaatctttctgggtttctttccttatcaataaaatgcgcaagtcagactgcataa

SEQ ID NO: 249348 - DNA, 605 bp, Homo sapiens
cccttaagccagtagccggtggcactttgttacagcttccctggcaaacacgctgccccgacggctggtgctttgagctggcagcattctatctgccacgggcctccaggtgatgctctagctgcaccagcctctgcccacgtgcaggggaatcctgttggggcccagatccagccccaggacactggccctgcagaagcagcaaaccccccagtgcccccagtgacactgagtgggggcccggcccatagcatgggtgtgatgtggtggagcccatgtcgggaggggacttggtcacaggacagggaggggccctgcctcatccagtgggcaagagtcagggtgcttgggcccccaacggcctgtgtgggtggatcacgtgaggtcgggggttcaagaccagcctgaccaacatggtgaaaccccatctctactaaaaatatgaaattagccaggcgtggtggtgcgtgcctgtaatcccagctacttgggaggctgaggcaggagaatcgcttgaacctgggaggcggaggtttcagtgagccgagatcatgccattgcactccagcctgggcaactgagcaagactctatctcaaaaaaaaa

SEQ ID NO: 249349 - DNA, 473 bp, Homo sapiens
tctgtaacgtattagaaaccttcgaatgaatgagctatgtcttaaagtgttttttttttcataatatggttaaaaagccctagtaaatcttctcttagaagatttcttacattcaccctttcctttcagttttcacatcactgccctgtgaaacactcatgttcagggcctctgtctcaggcttggactggttttaagattttcctcattgccctaagtctctcccattctatacttcatatttttgtgatgttgagcttcctaaagtactctaaatataagccttcatctcttaaaaagctttgaaaggaatatgacctaaaagatattaataccctaatactctgtaaaatcttcctagttatatactagaaaacttaatgtatttcagaagacatgtatagcctacatgtaaaagtttttagcagcactgtaatagtaaaacactggaaacaaaccaaatgtccaacaaa

SEQ ID NO: 249350 - DNA, 667 bp, Homo sapiens
taccctcctatctgtctggattttaattctacccattgatatcttttcttttgggtgatgaaagcacagacactggattttagactagaatatggcctccaagtcttagtttgtgggtagccttcagaaagttacttatccccctttggcactgatatttctctttaaaattgatgtattactgctaaccttatttaattactaggaagactaaaaaagatatcagcgcaacatatgtcctgcacagggccttccacttagcacaacctctctcccttcctctatcagctgctgtaatgatgaccaaatcaggaaattctggtcctaaccccactgtatatcttaggaggttcaatcagctgaagttggtgctggtgtgtctaccctagcaggttgctgagcaacccacagtgagttgtagcagccctgaaaacagtttgcatcaacaaggcttcaatgatcacagacaaacacaagcatttactaaagctgaagggacagcaaattgctagagtgctttcccaacccctttgcatttatgatttcttttctgagaatgatatatgatccaattacagagttcacgaaagcattagggagttcatgaaaagcaaaggcttatactaaacatactaaacagcttgtcctttgaccatcactgatggtg

SEQ ID NO: 249351 - DNA, 386 bp, Homo sapiens
ggaaaaaataaagtcaatttgaggaagccagaaacaagcattccaactggcaactgagggaaaaaatttaaatgttagaatatgcacacatatatttctacctggctagaccatttttaggttgtctatttaagtggcctaagagacagtaactattctataaaatgtgtggagtggggcagaaaggttaaggaccctccgaccctgattttctccctctttgagcattggcattcaacatgaaggaaggaacaagtcaagccacagagaggtgaatgcactggaggaaagcttcaggaagggttgtatgtatacaatgtataggttagtttccatcttttaaaaagcttataaaaatgatataagaaaatgataatacattttta

SEQ ID NO: 249352 - DNA, 383 bp, Homo sapiens
atttgtttcctcatttataaaatgaaataatgtaactcacttcacacagtattataaaagttaaatgggagaatggataataaaagtgctttatcaactacgaagtcataccaaaatcttagcagttattttggcttaccctctaggattagagctgatcccctgtcctagactgtagatgttcacttcacccccagggaagaggaaacaccttcctaccgtccccattgtatcttttggatgaatgttgcacttattttacttcctgtggaggttacagattacactgaggggtgtgtgtgctggggcgggggtgtctctactgaagggggtcgtcatttccagtatcaactatacatggatgaagccaagttctcaggcca

SEQ ID NO: 249353 - DNA, 599 bp, Homo sapiens
caacagcatcccaaggcagaagaatttttcttagtacagaacaaaatggagtctcctatgtctacttctttctacacagacacagcaacaatctgatttctctatcttttccgcacatttcccccttttctattcgacaaaaccgccatcgtcatcatggcccgttctcaatgagctgttgggtacacctcccagacggggtggcggccgggcagaggggctcctcacttcccagaaggggtggctgggcagaggcgccccccacctcccggaaggggcagtggccaggtggaggctgccccccgcctccctcccggatggggcggatgagctttttttcatatgtttgttggtcacataaatgtaaacttggcaaatttactcatatttttggacttttgaaagctgagctgttttatttcagtgtatttcgaaatgaattatcaataccgtgtccattgagcttctgaaagtgtaaacattttatgtctcttcctttatccctcactatttctccctgtttctcactcttttgactggtcttcctatgcattccagagtgatgtctggtttgacaatactttaatatatttattgat

SEQ ID NO: 249354 - DNA, 729 bp, Homo sapiens
tagatgtcagctgtcttaaatatgctcagtgactaaagaaaaccatcaacaaaagaagtaaattgtcagaacaatgtatgaacaattagggaatgtcaataaagaaaaataaattttaaaaaggaaccaagtagaaattctgaagcagaaaagcacaatagctgaaatgaaaatttcactagaggggtgcaatggaagattttggcaggaaggcagaggaaataatcagaaaacttgaagatgagacaatggaagttatccagtctgagcagcagaaagagaaaaatgaacaaaatctgaggaaccagtgagatggcatcaaacttaccaaaatttgcatcatgggagtcccagaaggagaatagagggagagaaaagaggagaaaaatatatttgaagatgtaatggctcaaaactcctcaaatttgatgaaagacatggacatatacatcaaaatggctcaacaaacatcaagcaagatggactcaaagagattgacaccaagacatattgtagtcaaattatgtagacagtcttgaaaacaacaacaacaaaaatgacttttcatgtacaaaggatctttaatgagattaacagctgatttctcatcagaaatcatggagtccagaaggcaacaggatgataaagtgctggggaaacaacaaccaaaagcctgtcaaccaagaaatttatatctggcaaaattactgtatcctttaagaaagaggg

SEQ ID NO: 249355 - DNA, 598 bp, Homo sapiens
tccctcatgccacttagctgcctcagaaaaactgacagtattggaggatgccaaaaaaagaaaaaaagaaactggtcaagagaccctttgtgattttgtctgctattgggcagcaactcatgagaactggccaataagactctacggttatattagaagtggctctggagaccttaaagttatgctattctcatttattttagtgcagaaaggactcaaacaatctgacatcagtgggaagagcgtatacaatgaaaatcgagtgtctttggacactctctgtactcaggtcttttgagcttttcaaataacaaggtaccaaggctcctaaaaagccaaaaaatgtggattcatactggctgctctactcagagatttgggcttacagatctaatagctccattaaatgcatcgtcattttgttggaggagacagtatagagcggtagttaagaacacagactgtggagacaggctgctagatgtagaaccctagatctgccacttgctagctgtgtagccttagataaagtacttaagttctctgtgccccagtttctgcatttgtagcatctcttaatttttacacaacatgtaaa

SEQ ID NO: 249356 - DNA, 317 bp, Homo sapiens
gtattaaaaataaaagagattacttagattccccacttcctttcctgccttgattctttccatttaaaagtgagacccctgtctctacaaaaaattcaaaactaactgggcgtggttgtgcatgcctgtagtcctagctacttagaagactgaggtgagaggattgcttgagtccgggagttccaggctgcaatgagctatgacggcaccaattcactccagcctgggcaacagagtgagatgctgtctctaaaaaaaacaaaaacaaaaatgaattgtattggttttcacagtttcaaaaacattcaataagagta

SEQ ID NO: 249357 - DNA, 501 bp, Homo sapiens
gccgcggacgcgcacgtccgcgaccatcgagtaaattcacaccctccgccctggcgtccgtcgggccctccaccagcagcgccaaccctggggcaacaggtcccagagggcacggcgccgccagcctgcaccgcgaaccgggtcgggtgtgctcgggcatgcgtgagccgctaagatagcccggcccagggaccgagcaggttctgccggccgcgactagtcccctgcgcggtccaggtggtcaggggaggacctagatttctcgctgccagggaatcgtgcggatggcacaggccgcaggactcctgcagagcaagcaggggccccaggtacgcttgagaaagcgaacgcagcagtggccccgaaaccttggcctgaatgagtaaaaggaaaagccgtgtctcgtcagttaaatcaccaccgcagttccgcaaatcctccgcaacaggcccacgcgccccaaaaaaccaagacacgaaacaccctcacactgcgcggccg

SEQ ID NO: 249358 - DNA, 764 bp, Homo sapiens
tgtttggtgctatacatctttaataaagctggtatactgctactaatttttaggtggtgattataatgaataaacacaaaggattattagaaggcatcctgaggataaaaccttttaagtaccacatagtttcctatttaggggaacaatattccattaaaattcacatttttggaatttgatttctttcttttaaaaatttatttattttttgcccttttccccaagttctgatggaatttggtttctgtttagtaatgtttgctagaatatgtacttttatatgaaacatttgcatatttgttattagtacgattaatcgtattgtcactgaacaaaaagtagaagtaaataattttgtttgacgggtaaacctcttccatgttcagccgatctttttttttaaaaaaaattattattattttccccagatcagagatgtacagcccatctttcaatgatgattctactcaactgctcctgtgccatctctggtccagaggatgtaattcctgctaacttgaaagggcaaaactgacaagtgcctatttcagtagcttattaccacttaatgacagaggatagcttccaggaaaagtactataatacatcgaaaaggggacttttaactgtatctggtagaattccaaagcatttaacacccactagggtcaacgcggtgactcccatcctactgaagtgcagccacttctggcctggagcgcagctgctggttaacagctgtccaacctcagtgctcccca

SEQ ID NO: 249359 - DNA, 431 bp, Homo sapiens
tgagacagtcttgctctgtcgcccgggctggagtgcagtggtgcgatctcggttcactgcaacctccgcctcctgggttcaagcgattccactgcctcagcttcccgagtagctgagactacaggcgcccgccaccacgccctgctaattttttgtattttactggagacggggtttcaccatgttagccaggatggtctcgatctcctgtcctcgtgatccacccgcctcggcctcccaaagtgctgggattacagccgtcagccaccgtgcccggccaggaggggcagagtcttaccccgaagacccaggaaggagaggcttcatttatttttttgtttttccccagagacagggagtcgcccaggctggagagccgagattggccattgcactccagcctgggtgacagagtgagactttgtctcgag

SEQ ID NO: 249360 - DNA, 470 bp, Homo sapiens
agttcggcagtgtggcaggccaggtttccattagcaaccagaacagtttccattaacactttactataattttgatgaatgcataagttaaacgttaaagaaattgagaaactggtgcctgagtatcagggatggaatgcgaaaacgaacccattaagaccccgcctgggtcctctcagaccctaaagtctgatcgaataataatagtattcttacacattcacctgggcctgtcttaagattcagaaactttccaagactctagagaaatctttccagaccctagaccgtagttaaagattagatgttgattgaatgcaacatttctgcttgtaggtgcagtcccaccatagcattgagcttaagatgtatataagcactagaaaaaaacttgaaactttgagttggtctggtgagttacttggcttctccgtctaaccggttgcagaaataaactcctttctttccca

SEQ ID NO: 249361 - DNA, 258 bp, Homo sapiens
tagaacatttctgtcactccggaaagaaacctcatatgcatcagcattcactcctcatttctcgctaaccccttacccctaagcaactactaaatctaccttttgtctctgtatatttgcttattctggacatttcatgtaaatggaatcacacaatacacggcctttgtgtctggcttctttcacttaatgtgtcctaggttcaagcatgctgtaacatacatagtacttcatgtctattcattgctgaaaaatatt

SEQ ID NO: 249362 - DNA, 345 bp, Homo sapiens
gggacaggaagtacgggttgaaatctttagaaaacgcttgagaaactgcaaaaaagacgcatgctgatgaaaaacagtcctgcggttgggcgtctacaaaaaaaggggaagttctgcctggggagcgccgtgcagccgtccccttcccctccgggaaatgcataggtggacacgcgagcggccggcccgcgggggaggggaggggagggtccgccctggggacccctcagatcatcttcatgttgaacttgcgcgcgcctccctggcccgccgcggcggccggcccatccaccttgcggaaggagtactccaccgagaagttgtttttgtgctgcccgcggccgc

SEQ ID NO: 249363 - DNA, 611 bp, Homo sapiens
tgtatttttagtagagatggggtttcatcgtgttagccaggatggtctcgatctcctgacctcgtgatctgcccgcctcggcctcccaaagtgctgagattacaggggtgagccaccgcgccttctattagcttttataatggagaggtaactgtcctagaaagtccatgtaaattccagttcagataatgaacaattacttattctatgaagacatttatatttcctggactgtacctttcacatctttccctatgtgaatgggttccctgaagaactttttctgcctgctgagcacttatttggaggtaagtctaacaatgagatgatatccaaacttatcactagactactgaacgatattctattttccctaatggataccaatgcttattccagaattatattctatagttttaaattttcatgctttcaaaagtatctgacatttagctgtgaaattttctgctgccaaagaccttgtcatatgatccacggacagatacacagctaggctttttaaattttgtattaattctgttattcaacacacatctaataaataactgctgtgatccaggaacagcattagacaataggaaatttttttt

SEQ ID NO: 249364 - DNA, 399 bp, Homo sapiens
ccgttcctcacggcatagtccatcatggcttcccttgggtagggaagagaattccttgacccgttgtgcttccctggtgagagccccaccatgctttagctcgctgtctgtggctacacccactgtccaactagtcccaatgagatgaaccaggtacctcagttagaaatgcagaaatcacctgccttctgcatcaatcttactgggagctgcagaccggagctgttcctattcagccatcttgccagcaatccgaaataattttatagtgaatacttgtatactcagcacttagattctgaaaactgagcaaggagctttctttgtttatttatttttttgagatggagtttcagtcttgttgcccaggctggagtgcagtggcacaatctcagctca

SEQ ID NO: 249365 - DNA, 532 bp, Homo sapiens
ttaaaatcaagtgcaaatgactggcagatagaacctaaagtatggaacctgaatgaccagctgaaatgacagaagccccaggcagaggcggttcagcaaaggggaaagcagcactgggagtgatgcacaaggtggaaccagacccagcgtgtccttgcagcccccaagcaggcctgccatgccagtcatagggtgaagaatcagtggagaatgaggagcagctgagctgcctcaattctgctcaagccacacaaattctgctcaagagcatacaaaagggttatgtccatttctttaacagtatttacaactaggaactgtgtacctggcaaataagctgccactgtctttgttattcactctggcaaggccaaatgaaaaaatgcctggtagaggcttcttgagtagtcttggctgggtgtggtaactcatgcctataatccaagcacttaggaaggccgaggcacgcaaatcactttgaggccaggagtttgagaccagcctggccaaaatggagaaaccccatcactac

SEQ ID NO: 249366 - DNA, 435 bp, Homo sapiens
ctgggacaatgagaccgttgtcatccactcagaaatgtgcagagccacacgaggcagcaagctgggcctcggaggttttttccaaggcaagaattttcacctggacatgctgggctcccatgattccatgggtagaagtcagaaggtcagagaactttgatgagaaaaaaagttacatcattgttttcactaacctccaggcgaaatttagtatttccttccttgatgaatgcaggcaacaaaccactgcaggacctgtcaccttggcctgagagcagtcacagatgtttttgtatcacgtggctctggctgcaaacagctggaatgatgttaaagctcatctctgtaatcatggtggttattacagtgactatatctactctctcacatagtgttattcaatataagaataaagaaatggctgttttataaaaa

SEQ ID NO: 249367 - DNA, 417 bp, Homo sapiens
aaccctctcattgcaattgctgataaaataaactagggatgttcagactcctccctcctggaccagcattatccctaaagaatgttccttgtggctacagagaaatcactttttctaccacaacgcagtgtttaggatctctgcttactgtggagggccccacttgagcctgaagttatgcagtcgatattggagcaggaaaaagttgaatgtgcaaggaggggactgtgcatgtgtcccctgccgggcccagttgtggcagagggtggtgctctcccacgttgtgagtgagtgtgtagattagtgcaaactctgtggaaagtaagctggctaaatgagtgaagagccacacaaaatgtgcgtcatttttgactcattaatttcatttaggataaacaaatttcatcaaaaacagag

SEQ ID NO: 249368 - DNA, 431 bp, Homo sapiens
tcttcttgagatagttttgtgtcgtagcttctggttttcacatgcattatagttaagacaccaagtggactttcttgctctgccagtatggttcagctgccctggactagtctctgcctgtcaaagcactccctatgttagaaaatgagtatagaggccaggcgtggtggctcacgcctgtaatcccaccagttggaaaggccgaagcgggtggatcacctgaggtcgggagttcgagaccagcctggccaacattgtgaaaccctgtctctactaaaaatacaaaaattagctgggtgtggtggcgcacgcctgtaatcccagctactcaggaggctgaggcacgagagtaacttgaaccagaggcagaggttgcagtgagccgagatggggccactgcactgtagcctgggcgacggagtgaaactctc

SEQ ID NO: 249369 - DNA, 719 bp, Homo sapiens
ctgtgtttaagaccaacattgcgtgctctgtgctttgatgagtgaatccttccttgtcaagccaaatctttgctagcatcccggtggtctccttaactgcggacttgcaagatccacatatagacattttaaagacttttcctgtgtgttgccaaaaggcccccttcataagcattgtaccgatttgcactcgtgccggccagcgcagctagtaaagagtatgcccgtttcccctgcatagtctcctggtcactgtaattgatcgtgtgtgtgcgtgcgtgtgtgtgtgtgtgtgtgtgtgtgtgtcttggccagcttggcgggctacaaagggtgtttcgctgtcctcggtagttttgctggaaacaaacactgcttatgaccccattcccctgtgccctcttcctgtccttttccctgttgtcagaaaagtaattcagcgtcattgcaggaaaaaaaaatcacaaagcagacaagttaccagaagaaaattaaagtcaccagtaatcatttctgatgattacacacacattccagaaacattttcatgcacacctctctgatattttctagaactacctgaaacatttttgtctgtaggtctagtttttttcttatgcatatatcatatatgtatattatgatgtacagactgtttttatatctgcttttcacacatacatgtgtgtgtgaaaaacaaaaaaaaacacttgcggccg

SEQ ID NO: 249370 - DNA, 826 bp, Homo sapiens
cttgtttaagttcagtttaataaatagtagataatgcctcttctcttttttccttttgaagaggagaaaaaggaaagaattgtagttgattcttatgtagcaacttattcattcattcagtagctatagaagcgaattgttttgtaggtaattattaacgatgctttggataattccctagctaactattccttcttttccatcccagaaagcaatgaagagaaaagctgaagtcagtgattaggagtgtctgtgtaagtaaaagcaacaggcaattactgagtgtggtgtgagaggcacggaaagattgggaattcagcaagaagaggaattgaagtcaaacctcacctacttcccagagtcttctggattttctgttagaagcttcagtatctgaggaaaggactcaggcaacaaataaacagctaagattttactagagtatgaaagggagagcactggagtgcagtgcggggatggagatgcagctgtggtggctggaagtacaggagggcagctggaggcacctggcctctgaagcctgtcttcttcatctgggtgagatctgctggagtcaggaaggacttcctgctgcaaggataaagaatcccacccatcctaaggcattacatttagtcatcatagctctttcttcacagaattagaaaaaactactttaaatttcatatggaaccaaaaaagagcccatatagccaagaaaatcttaagcaaaaagaacaaagatggaggcatcatgctaactgacttcaaactatactacaaggctacagtaaccaaaacagcatggtactggtgccaaaacaga

SEQ ID NO: 249371 - DNA, 610 bp, Homo sapiens
cttgtttaagttcagtttaataaatagtagataatgcctcttctcttttttccttttgaagaggagaaaaaggaaagaattgtagttgattcttatgtagcaacttattcattcattcagtagctatagaagcgaattgttttgtaggtaattattaacgatgctttggataattccctagctaactattccttcttttccatcccagaaagcaatgaagagaaaagctgaagtcagtgattaggagtgtctgtgtaagtaaaagcaacaggcaattactgagtgtggtgtgagaggcacggaaagattgggaattcagcaagaagaggaattgaagtcaaacctcacctacttcccagagtcttctggattttctgttagaagcttcagtatctgaggtaaggaaaagaaactgcaggacttacagaatataccctttcctttccatcctctgtattacttaataggtattttgctttgttttcattttttcattcctcctcttatcttctgccttaattttcaactccatattactaagtggcatggttttcaagttttctgtacagtgttttactattttaaataaaaaaaaatttttagttttaaa

SEQ ID NO: 249372 - DNA, 347 bp, Homo sapiens
gccacacaccagcagcattggtgtcacatcagtgttactgtgaaaatcaaagcgtttatgaagtgtgggccacagaccagcagcatcagtgtcacttgggagcttgtcagaaataatctcaggcctgcccaagcccactaagtaagaattgcacttatacaagaaccctggatgagcatttcataaagtttgagaagcacagctagtatgaagcaaaccactcgaagtgcaacctgttacctgtctgcaatgagtcagacattgagaggaaggatttagaaactttatagcaatttgataaagtaattttgttatatctaataataaaactcagagcttgtcttttt

SEQ ID NO: 249373 - DNA, 613 bp, Homo sapiens
ttttaaaatcttctttcccactaatacttgtttcattaaacattcttaagcacctaccatgtgccaaaaactgtgctaggttataaggattcaagaatatgcaaaacatagccactgtccttaagaagcttataaaaggagaatggcatgcaattaaatttttatgctaaaggacaatatgggctgggcatgaggcctcacacctgtaatcccagcactttgggaggccgaggcgggtggatcaactgaggtcaggagttcgcagcctggccaacatagagaaatccgtctctactaacactacaaaaattagctgggtgtggtggctcatgcctgcaatcccagctactcgggagggtaaggcaagagaatcttttgaacctgggaggcagaggctgtagtgagccgagatcacaccactgcactccagcctgggcaacagagtgagactctgtctcatgggtgtagatgagacagcgattcactttgaagaaagtggtgtttgggaaaggcatgcccaagagggaacaacagggccctgccccccagtgcaaagaaatgggctgacatggaagtgggaaatagcacagcacacttaaggaatgccaggcat

SEQ ID NO: 249374 - DNA, 358 bp, Homo sapiens
aagaagggagaccaggtgttcccatgcacctctgggaggatccctactgctctgctatgaactgctgtgagattgaggctagagcaaaccacattcttcacatcttcttgtctatgctgctcacttgagaatggccctgccctctctggtgacaagcccacagatggcaccgttttgaacatttaatgctgggctatgccctgtgttctggccaagtttcaggtgacacagctgcagctgccagtccacctagggaggaacagcacacttaggacaatacccactgccctgctatgggtagctctgggactgaggaccagcacacccaactcttcacagcaatactgacgtggactgc

SEQ ID NO: 249375 - DNA, 331 bp, Homo sapiens
ccagtgccacctcatgccagcacaacgagttcaaacctaaagtcggtgtctgagtgggacaaagctagagacccatttcaggcaagactctgatgcctctaaggagtgagtggaaagccagtgtgcgtgcgcagggtgtgcgtgtgtgatacatcggcaggatacagagctcccaagggcatttcccatcccctctctccaattaattaacctaattaaccagcttgcttgtgtatccaacaggaactccaaacatttccttcaagaatgggaaaatctatgtcctttgttttcttttgaaaataacttgaataaaatcttacatgaaaca

SEQ ID NO: 249376 - DNA, 743 bp, Homo sapiens
gaaaaagaaaggaaagaagaaagggaagaagttatttttaaaaaataaataaataaataaagagtgcctcggaaatcacctttataaaaatcaaactcatcttttcccaacactgtcttctgtacatgagaagcatcttaaaaacaaaatgaaactgaccttttaggagggacagggaagatgactttagtgcttatcagtcttgtcgatgtccttttcttatttttgtcctctaaatgtacttgattggaaaaaacaccgtttttaaatctctttatattgaagatatataaagagtaagagtttaggtatataaaggcaatgctttcatctagtgatttcttgtccttggttttagacagggccatcaacaactgaaaaggaaatcattacttcctgtagcaaaattaaaattaaaaattaataaactagtaaacagtcatggtgcacctaccatggaccaaatcctttgccaacaggctgcattcatatatagacaaatgaatgatcagagacctggttacacagatagacaaaccattgatggatatttgggttggttccaagtctttgctattgtgaatagtgccacaataaacatacatgtgcgtgtgtctttatagcagcatgatttataatcctttgggtatatgcacaccaacatggcacatgtatacatatgtaacaaacctgcacattgtgcacatgtaccctggaacttaaagaataataataataaaaat

SEQ ID NO: 249377 - DNA, 395 bp, Homo sapiens
tcctgaccctgcttttatgttaaatggttgtcagtgtgagagaaataaaagtctcgggcaaaacgcagcaaaaggcatctccacactttcacacccccctcccctacttctagagttctgtggagagaatctcacagaacagtgcttttcagtgaacacctgtaattttaaatttaatgatttacattttctagtagcctcatttttaaaaagtaagaagaagcaggtgaaataaattttaatacttcttatttaacccaaatatatctaaaaatctttcaacatgtaatcaatataaaaattattgagatattttgcattctttttttgtgctaaggccttgaaatggtaatgttaaatttaatgatttaaattttttagtagccccatttaaa

SEQ ID NO: 249378 - DNA, 546 bp, Homo sapiens
gctttctgctttaactaggtttgaatgtatagagtaagtgatgcaggttaaaatattttggggggatacagaagaaggtactgatggttcttgttatgagggtgtcaggaccacataatttgatgattgttggtactctggaaagaaaaaattgtgggacttggatcactgaataatctctgaatttctttcagtgcttaaagtagattattcagtgatggggcagcacagttgtatgtggtaggtatttctagccccactgctggcctttcaaacccagtcgtgtcaaaccctgccttattaattagcattttccaaaggttcagtttgcttatataattgcagtggtatagtaagcagagaaattgacccaataaatttagccatctaacaattagtgtgggaaaaatagtggagaagatatgtctattgtgataatatgagatatgaatatgaatatatgttttccacatatatgtgtatatatatacacacacctcattaccactgtaatatatatataatatatacataatatacataaag

SEQ ID NO: 249379 - DNA, 544 bp, Homo sapiens
tgccaatttatccctaatactcaatactaccactgagaagctgaatctactgacataatgaaatagtaatgtaaataaatgttacttttttaaaaatagaattgacaacattcttttcttttgcacattaaattcactttttacatggggcagaaacactcagattatgactaatgggactggtggagatagtttgaggattctgtgtaacagagcggttttcagcttttgacataacatagcccttcagagcatcatgggaatctcagttttttaaaaaagtcatttttaattgaagctataatcactctacttgagaaacaaggaacaaaacgatgcatttcttgtacccaatgtgctgacaaagctaactcatctataattaataaaggaacagtttattatgaaacaatacagagtttcaaaaatgctaaaagaaatgtacaaataaagtacctcgggacatttatacagtgcaaatgtcaaacttttgtattgatcatgcctgattagggtccttttccccaaatttgatgaaagaaca

SEQ ID NO: 249380 - DNA, 452 bp, Homo sapiens
ctacatacttaagacatccccatacctcataagaatatttttgttttaattaattttgagctgcttaagtcactgaaatctcttaactaaaattcatgcagaagaccatccagtgcctgcagcttttaaacattttctttcatcacttatctagggatgaaaaagctcttcatcacatccacagatgacatggccaccagaggtggaaaagaagggtgagtcattcacccttagaagataaattagatttccaaatgaccctggcagcagaaggaggcagaaataaaaataatgactttcaaccagcacaaaagtgcattttgaaatgagaaacaaagtgcaaaaactccagatgagaaacagctgacattatgcagctacaaaaagagagttacagatagagctgacctcaagctaaacaggtgtcaagaatggttctgtcattggtgaaa

SEQ ID NO: 249381 - DNA, 511 bp, Homo sapiens
gtaatattaaaagaaagcttagcatagtaaggttcagttgaacctgtgggacttaattctaattccattatggatttctcatatgattctactaaaaaatgtaacttgatttaactacttgaattacttatctaaattatgaaacccagttggccctgtcttcagaaactagaatccagataaaattacctattgtttgtgatgttaacatgtattatcccatcagcagaagaatctgagcagtgcattgtagtttttttaaacaatattgatgatatggtagtagaaactgaacagctactccctggactttgtcaatgtacttgttatgacttagcactgttttatttaccatccaaaaacatattttttattactcactgcaacatgacaataattccagttttgagtggtgtatatttctcattatgaatctaaatacacagaacgtttgctctgttttcagtcactaggctgcgtgaaaatggtgtattaaaaatagtctgacata

SEQ ID NO: 249382 - DNA, 270 bp, Homo sapiens
gtagattctctgagggaaaaaaaaaacaccgtgtagatggtgttctcagcaggtgagagtcagactgcagaagcaggccagctcctctgtaagacccacatgaagattactgttgccactgccagattatgttatgtctcacacagagtcgccaccttcctctctctactccccatcctgttccgccttctgaatcgcagcatcaattgttgacttaagcaggcaaaaactcaaactacatttgaataaagaatttgtcagtatctgcat

SEQ ID NO: 249383 - DNA, 656 bp, Homo sapiens
aaacagccaaactgcgcatttcagatgtgccacaaatttggatattggagatctcaggctcgtcactaaataggaaatctgtgatgccaattacagaagctctgagaccatgggaattaagagggtaggggtaaaatgtcaagtgatgagcaggtgtaatttttaacggaaaagcaattccccagccttcaattgagttcaggtattcaacacagtttcttcattaacattgttccatttttataaaaaatattgaaattttatactgtctaaagaaaaatctcagaatacatgctttcgctgttcttatttaagaagtaacttcccagtggaaagaagataatgtataaaacacttggttgtcttaacagcctgtacaaaatagttgggtgtatagtcaaaagtttgctttctttagcatagctagactagtaaggctaaatgataactgttctaaacatttgttctcaaaaaagtctcacataaaataattttctcaactatcaaatatagaaaacatttatccatatcagatagaccatatttcattgcatagttacgtaatgcaggcttgcagacagctgtgtaactagaattcatcctaagacaggcacgtccttccctttcagatcatcaatacatatagcctattgata

SEQ ID NO: 249384 - DNA, 374 bp, Homo sapiens
caaggtgaaacccatagaatgtttttaaagctggttaaaagttgaacacttttcttattgcccatgtcttcaacacgtcagtatttttgatggatatgaaatgattttgcctaaaggaagagcagtttttgtggccatttttgagaaaagatttttatgtacaagtacttgcttggattgcctcctttcctatgttcttgttctctgggttgctctctaattgtgtttacttctgtctgaggcaattgtctagctagctcttttgtgaacgagaggcatgacaagggatgggtgagaggggatgagtaaattttgctgaagaagctgaaattatgccagaagagccaaattttaataaaggaactaaaagtcaa

SEQ ID NO: 249385 - DNA, 102 bp, Homo sapiens
tcaagcgcttagttaatgttacctggataatgattatgcaaattatttttgttaataagtagcagttttaaataaataaaaactgttttaaggaggaagtgt

SEQ ID NO: 249386 - DNA, 751 bp, Homo sapiens
catattaggagaatgatggagtgaaaagacaaagtgtctggggcctgcctgcctaagaatgtggagaaaattacattggggaataaattatattaactccttctcatcattcacttaccttttgtaaatttcatctcactatgctaaacaatcctggatggcctgggaataatagagaccattatattatctcatgagattatctgcatctaaattaacagactcctctgcactagtgaacagggtgaatgcattcatttgggttggggttgggtggggttcttacctctgtatctgtaagaactatcatatcggtttcagtagcttgctcatatcccatatcatctacatgtaagaatggtgtgaggtcatctttagacgcctgtatagtaagctggtgagactcttaggcgacgcaccttatccttcattgagtgcgaccactatcataaggggttcttactgggggcctcagcttaccatatgttgccttgaactagctctggcgtcttacttcaagctcaacagcgctctgacttggggatcttccccttctcacaggcactccatatgcatccctcacctgtcctctgggcttggtctcattgcctggaggattcacctacaccctgacttaactccgctcacacatcggcacgcctgccaccattgcgtccgggtattctaattgcacggcctgtaacgccctcgcggcgcctcgcccccgtgtcccacgtgtcgcccgtccacc

SEQ ID NO: 249387 - DNA, 715 bp, Homo sapiens
catattaggagaatgatggagtgaaaagacaaagtgtctggggcctgcctgcctaagaatgtggagaaaattacattggggaataaattatattaactccttctcatcattcacttaccttttgtaaatttcatctcactatgctaaacaatcctggatggcctgggaaaaaagtcgtgcaccttctcactaacaggctcagattccttgttcatcgttaagataatagagaccattatattatctcatgagattatctgcatctaaattaacagactcctctgcactagtgaacagggtgaatgcattcatttgggttggggttgggtggggttcttacctttataactcttgctttttttaaaatgattttggagataaagcaaataaaaaatcattatcttgatagagtagttttaaataaacatttgatggaattatctttttattgtttcattcttggcatccattcaataataatgatggtggtagtgatggtgatgactgttgattgcctgggggtgcaagagccttacctatggctggtctgtgacagagcagggaccccaacccagtactgcataattttctgtggatattgtcatccccaatttccccattagaaactgagacctaaattctagtctgagattcttcacttgattatgtgccccttagcataatcctagttcagttttaatagtcactctgaagg

SEQ ID NO: 249388 - DNA, 661 bp, Homo sapiens
catattaggagaatgatggagtgaaaagacaaagtgtctggggcctgcctgcctaagaatgtggagaaaattacattggggaataaattatattaactccttctcatcattcacttaccttttgtaaatttcatctcactatgctaaacaatcctggatggcctgggaaaaaagtcgtgcaccttctcactaacaggctcagattccttgttcatcgttaagataatagagaccattatattatctcatgagattatctgcatctaaattaacagactcctctgcactagtgaacagggtgaatgcattcatttgggttggggttgggtggggttcttacctttataactcttgctttttttaaaatgattttggagataaagcaaataatttattgtttcattcttggcatccattcaataataatgatggtggtagtgatggtgatgactgttgattgcctgggggtgcaagagccttacctatggctggtctgtgacagagcagggaccccaacccagtactgcataattttctgtggatattgtcatccccaatttccccattagaaactgagacctaaattctagtctgagattcttcacttgattatgtgccccttagcataatcctagttcagttttaatagtcactctgaagg

SEQ ID NO: 249389 - DNA, 462 bp, Homo sapiens
atctggatctcctcggcaggaaagtcaagggccttcaccctttgctcctatcttccgccagtcccctcacccatcctagtcaccaattacatgagacatctagttgctgcttgaatacattatgtggttccaagcttacatatggcttataccctattttctacccgattctaattgtccaactcttatcctttcttccagaatcagctcaaatccactgcctttttgaatccccatctacctggtgatctccttgcccccctgcgtctcgcttacaagcactgcctctgtggacccatctcccgcctcctgctttactattagggttagcctttcatgaactaaactacgttcttggagggaaggaatcagagactatttcttagatacctttatgtctgtcccccaatacccagcaaaggtcttgcacagtaataaaagtttccctgtatgattgacaaa

SEQ ID NO: 249390 - DNA, 437 bp, Homo sapiens
acacctgcaatagaaacctgtacgcaacaagttggatgtcacatcttgcagtagtcgtgccgggttagatgcagggacagagcacggaggagtcggtggaggctgctgccctcaagtttcctgaacttgaaggggtttagaatgtgccacggtggcgtgaaaattattttgagcagaaggcatttgaattcctgaaatttcttgtctgctgaaaagcagagcttcccaaaagatctcaaaagaactcagttgtcataaatcccttcttgggaaggaactaggaaagattgacttgggccaggcgcagtggttcacgcctgtaattccagcactttgggaggcctaggcaagtggatcatctgagcccaggagttggagaccagcccgggcaccatggtgagatcctctctctattaaaaaaaaaaaaaaaaaaaaga

SEQ ID NO: 249391 - DNA, 674 bp, Homo sapiens
ggagaaaccccgtctctactaaaaatacaaaactagccgggtgtggtggtgcatgcctgtagaattgcttgaacccaggagccggaggttgtggtgagctgagatcgcaccattgcactccagcctgggcaacaagagcgaaactccatctcaaaaataaaattaaaaactcccttccccaagagtgaccagtctcctgatctttatcatcgtaaattagtgtagtctgtccttgaaacttctctaagtggaattatacagtatgtagttatttgattctggctttcttcactcaacattgtggatgaaatgtggatccatgctgggtgtttttatttttattgctgtgtactatttatcgcatgaatgtattacaacttattgtttcatccctcccttcatgaacattttatgtttctagttttgggatactatgaatgaagctaccatgaacatttctgtccatgtcttttggagcacacaggaagttttttccctcagatgtctgcctagcagtggaatcgctgagtgatggtatacgtaccttaggctttcgtagttactgacaaaccatttctcaaagcagcttaccagtttaccatcctgccagcaatgtgaggaagcttcatttgccccatattcttgcagatagttggttgttcgtcttttccatt

SEQ ID NO: 249392 - DNA, 954 bp, Homo sapiens
tcaattccagggaagtgtcaaacaatgctgtgcaatgtagccaggcttctacggcagagacatggagccctgaactctcctaagaaggtgaatgtgtcccctcatgaagtgcagctaatgggaccaatgcagtggagcagctactttctagttctttcttgaagccactcatgcataagaggtatgagaagtcatatttgagttagagccagatgaaaacctcaagaattaccagttattccactgaagtaaagcactgtttccagaggacttccatttgaaggaaaacatgcttcttccttcattcagtgcacacttattggatgccttctctgagccttgtgctgagccacaagagctaaagcataaacccaccaggaactaacaatacctaacataagttgattttttttcagagtgcattgatcacagtagatcatagtcaagcattatcttcatagaatagaacttgatgtctgtaggtgtaatttctgagtggttgataaaggtctcctgctaaggtgctagtaaccaggaaggaattggagggttggtgggtactgtgggtacagcacgggacctaggctaattgggacagtagaaaaaggcacctaaagaaaactatttctgattttgtgtttggcctgagactgagcctgctctctgtattgtaaaggaatggtacattatttcttacatctggttcaaggcccaactgcagagggtgtatacatacatcctgaacattccagagggacttatctgacagtagaaccagtaaatgttacatttctagagattagaacatcctaaaattgcacacagctggcagtaaacttgggagaaccgcttttttgtgtggtcaggacagtttacccttccctgatagaacaaaaattagtcaaagggaagtatgggtaaaaggaaagggaaaactttcctttcctctaggtt

SEQ ID NO: 249393 - DNA, 377 bp, Homo sapiens
cccccaaaggagctccattatttaacggccagcacgaaacgctggcactggatggaattcgatgctcttccacagtaaaatgttggaccctgtgcctctcatccacactgccccagggagcagggcagcagagactcccttgtggaaacaggaaaaccggtcagatagctctttgacctgtttccatatgtgagccaaattgtagaagagcattttggtttagaaaataacttcactgttgcacagaaagatctctggaggcccacactccccacctgactgccccgttttccttcaaggacccagcaggggagatggcggccctaactgagctgctgtcacaggaggggaggggctccatttcctgtggccttaaa

SEQ ID NO: 249394 - DNA, 402 bp, Homo sapiens
tctgtgaaccactccatttttcatcagatagcagaacaactacaacagcaaaacctagaacatctcagacagcagctcttgggagcagcaacagcctcaaaaggccactcctcaggatagtcaggaaggaacctttgggtcagagccatcagcgtctgaccacatagttcagcgtctgactcagacgctgaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatagttcagcgtctgatg

SEQ ID NO: 249395 - DNA, 472 bp, Homo sapiens
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaaggaacagcaatggaaaccttccatgtacagcagcataactccagtttgctttccaagccctctgattgagaagccaataggcaaagtaagaatgaacctacttttatcagacactatgattcgagcc

SEQ ID NO: 249396 - DNA, 573 bp, Homo sapiens
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaaggaggctgtgttccctgtcacgtggggtgagccaatgggctgaagaagcatgaggaaaaggagactcgagtatggcaggtggctgtgtggagaggacacttggaacagcaatggaaaccttccatgtacagcagcataactccagtttgctttccaagccctctgattgagaagccaataggcaaagtaagaatgaacctacttttatcagacactatgattcgagcc

SEQ ID NO: 249397 - DNA, 482 bp, Homo sapiens
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaaggataattgaaccagggcacaaggagacttttgtacttgttcaggtcacacagtaagtgatggagccaggattacaacctgcccttccttacaacctgctcttccttacaacctctgacaccatattctgaaagagg

SEQ ID NO: 249398 - DNA, 617 bp, Homo sapiens
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagtttatgtattcatcctcctgtagcttcctgagaagtcatgggagaccaccattttcagcacattggccagtgagaagtccttatctgactgcaaaaaggaggctgtgttccctgtcacgtggggtgagccaatgggctgaagaagcatgaggaaaaggagactcgagtatggcaggtggctgtgtggagaggacacttggaacagcaatggaaaccttccatgtacagcagcataactccagtttgctttccaagccctctgattgagaagccaataggcaaagtaagaatgaacctacttttatcagacactatgattcgagcc

SEQ ID NO: 249399 - DNA, 656 bp, Homo sapiens
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaaggcatactcagaccagaccctggaacggagcaggtttttgatgaatgcctgttgaatgatgaataaacggatgaagggaaccaagaggctgtgttccctgtcacgtggggtgagccaatgggctgaagaagcatgaggaaaaggagactcgagtatggcaggtggctgtgtggagaggacacttggaacagcaatggaaaccttccatgtacagcagcataactccagtttgctttccaagccctctgattgagaagccaataggcaaagtaagaatgaacctacttttatcagacactatgattcgagcc

SEQ ID NO: 249400 - DNA, 1003 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagattgatttccaccatcaacacctttacctcttcccgcctgaaaataaaatatgaaatataacaagtaaatcgcaatctaccttgaatcttctggagaggaaagaagaaaccatgtctagacaaggtgctggaaagacccagggaagacacagggaaatcatctttcgggaatttatctaagaagaacttcttatgatatgaagtctgggggtaagacctgcagtaatttcccttaagatactacagaatttccaaggacttgaggaataattgcactcttgaaagagcctatgaaaaaagaagagacttgggaaatttaacagaagttcactttccaccactgcgcaaactaaggaaaaacttaaagcagtaaatagctgcggttggcaaagctgttttggctcaggagcagctatcaggccttgataaggtccacaagtctgctgttctaaaatcaaaaaaaaaaaaaaaaccccctaattgttgaagaggtattggggga

SEQ ID NO: 249401 - DNA, 2094 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagattgatttccaccatcaacacctttacctcttcccgcctgaaaataaaatatgaaatataacaagtaaatcgcaatctaccttgaatcttctggagaggaaagaagaaaccatgtctagacaaggtgctggaaagacccagggaagacacagatatgtgtgcctttattagcggagccactacttgagggagatgaagcgggaggagtgggtggacccaatgccaggccggccgtgcttcacgggcttgtaggtgatggagaactcgcccaggtcgtggccgatcatctccagcttgatctccacctggttgaaggtcttgccgttgtagacgcccaccctgctgcccaccatcttgggagggatgatcatatcgcgcaggtgcgtcttcaccacttcctgcttctctatggtcggcgcctccttcttggcctagcataggcgcctcagcagcgaatgcggcttgagcctcagcattccgccacaggccgtggttcagccgccgcagctggcgcgcgccgtacagctgcctcagctgctcaaaggacatgtccagcagctggcccaggtccacaccgcggtaggtgaacttgcggaagatccgctgcttcttctcctctacctctgccatcttgccggatcctctgaaaatgattccgtaagtgccagagtccttcacatatggattttaacctaattctgtaatgattttaattagctgatatattaaaaacaacgtcagtaagtttttcccttcaaggaagcctcaactttgagaaacggtgaattacgtgaggtgaacctcgtatttatgtgaggaaagctctgcactggttttgattctcacattttaattagctgatacattaaaaacaatataagtaatttttcccttccgggaaacctcaacttggagtaacgctggattacgtgagctaaacctcgtaattatgtgagaaaggctaagtattggttttgtttcccacatttacgtgaggaaattgaggcacaatgttaagtgtcacaaggtcaagtaactagtaaggggcaggccaagatagaaatctgtttgcagaactcttgtgcttaatgactaagaagcgtgcgcagatgcaagggccagacagggaaacaagagatccatttgtaccaatagcatggaagattgactttgtttcagggaatcgcgttttttcataaaaacttcgggattaacccacctcacatattttctccaaagttatagttatgtattggatttaagaatagactgaacctgggctccccactgcacaagataaaaaactgatagaggctgggcacggtggctcacgcctgtattcccagcactttgggagaccaaggtaggcggatcacctgaggtcagaagtttgagactatcctgggcaacatggtgaaaccctaactctactaaaaatacaaaatcagctgggtgtggtggtgggtacctgtaatcccagctactcgggaagttgaggcaggaaaatcgcttgaacctggaggcagaggttgcggtgagccaagatggcgccactgcactccagcctgggtgacagagcgagaccccgtcacc

SEQ ID NO: 249402 - DNA, 919 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagaatcttctggagaggaaagaagaaaccatgtctagacaaggtgctggaaagacccagggaagacacagggaaatcatctttcgggaatttatctaagaagaacttcttatgatatgaagtctgggggtaagacctgcagtaatttcccttaagatactacagaatttccaaggacttgaggaataattgcactcttgaaagagcctatgaaaaaagaagagacttgggaaatttaacagaagttcactttccaccactgcgcaaactaaggaaaaacttaaagcagtaaatagctgcggttggcaaagctgttttggctcaggagcagctatcaggccttgataaggtccacaagtctgctgttctaaaatcaaaaaaaaaaaaaaaaccccctaattgttgaagaggtattggggga

SEQ ID NO: 249403 - DNA, 1073 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagattgatttccaccatcaacacctttacctcttcccgcctgaaaataaaatatgaaatataacaagtaaatcgcaatctaccttgaatcttctggagaggaaagaagaaaccatgtctagacaaggtgctggaaagacccagggaagacacagatgggatcatccagttgctggaaaacaaactcaggtctcccactggttctacattatgacggagtctcactctgtcacccaggctggagtgcaatggcacggtctcggctccctgcaaccttcacctcccagatggagtttcactcttgttgcccagactggagtgcaatggcgcgatctcggctcactacaactctgcctcccgggttcaagcgattttcttccctcagcctcccgagtagctgggattacaagtgcccaccaccacacccagctaatattttgtatttttagtagagacagggtttcaaccatgttggccaggttggtcttgaactcctgacctcacgtgatctgcccacctctgcctcccaaagtcctgggattacaggcgtaaactagtatctttaaaagaacaat

SEQ ID NO: 249404 - DNA, 1099 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagattgatttccaccatcaacacctttacctcttcccgcctgaaaataaaatatgaaatataacaagtaaatcgcaatctaccttgaatcttctggagaggaaagaagaaaccatgtctagacaaggtgctggaaagacccagggaagacacagatttgttcctttctccaccatgcctcactatgtgtcaccaaacttaattcagcatcagtgctccaaatactccatcctacaattagagaaaccactgaattccgatatcctccacccaaatggtaatgaagattggagaaagtgacgcccatgcatagcggagaagtggattgcagatataacaaggagcacagtaaactgagatgtaaaacaccttattcaacaacgaggatgctgactcaaaagcaaaagttgaagcacattatgaatgaatgtcaaaagggaaaaatctaaagctaacataaaagagtgcaactacatcaaattggataaggaatagtattttatagccaattaatgaatatttaaaggacatcaacctcatctctttgaaacacatatgaacatagttgagctagagggtgacatgatgtatatatttaatc

SEQ ID NO: 249405 - DNA, 1177 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagattgatttccaccatcaacacctttacctcttcccgcctgaaaataaaatatgaaatataacaagtaaatcgcaatctaccttgaatcttctggagaggaaagaagaaaccatgtctagacaaggtgctggaaagacccagggaagacacaggctttggtatcaggatgaagccagcctcataaaatcagttagggaggattccctccttttccattgattggaacagtttcagaaggaatggtaccagctcctctttgtacctctggtagaattcggctgtgaatctgtctggtcctggcctttttttggttgacggagtctcactctgtcacccaggctggagtgcaatggcacggtctcggctccctgcaaccttcacctcccagatggagtttcactcttgttgcccagactggagtgcaatggcgcgatctcggctcactacaactctgcctcccgggttcaagcgattttcttccctcagcctcccgagtagctgggattacaagtgcccaccaccacacccagctaatattttgtatttttagtagagacagggtttcaaccatgttggccaggttggtcttgaactcctgacctcacgtgatctgcccacctctgcctcccaaagtcctgggattacaggcgtaaactagtatctttaaaagaacaat

SEQ ID NO: 249406 - DNA, 969 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagattgatttccaccatcaacacctttacctcttcccgcctgaaaataaaatatgaaatataacaagtaaatcgcaatctaccttgaatcttctggagaggaaagaagaaaccatgtctagacaaggtgctggaaagacccagggaagacacaggctttggtatcaggatgatgctggcctcacaaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcggagcctgttattggtctattcagagattcaacttcttcctggtttggccttgggagggtgtatgtgtcgaggaatttatccatttcttctagattttctagtttatttgcgtagaggtgtttata

SEQ ID NO: 249407 - DNA, 998 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagattgatttccaccatcaacacctttacctcttcccgcctgaaaataaaatatgaaatataacaagtaaatcgcaatctaccttgggaaatcatctttcgggaatttatctaagaagaacttcttatgtgaactcctgtgcttaagcaatcttcctgccttggcctcccaaagttctgagattatatggatatatgaagtctgggggtaagacctgcagtaatttcccttaagatactacagaatttccaaggacttgaggaataattgcactcttgaaagagcctatgaaaaaagaagagacttgggaaatttaacagaagttcactttccaccactgcgcaaactaaggaaaaacttaaagcagtaaatagctgcggttggcaaagctgttttggctcaggagcagctatcaggccttgataaggtccacaagtctgctgttctaaaatcaaaaaaaaaaaaaaaaccccctaattgttgaagaggtattggggga

SEQ ID NO: 249408 - DNA, 579 bp, Homo sapiens
tcaacaatagcctactgtcagcaagttaaatggctggggctgtttcagtctcccattacatgaagaatcttctggagaggaaagaagaaaccatgtctagacaaggtgctggaaagacccagggaagacacagatttgttcctttctccaccatgcctcactatgtgtcaccaaacttaattcagcatcagtgctccaaatactccatcctacaattagagaaaccactgaattccgatatcctccacccaaatggtaatgaagattggagaaagtgacgcccatgcatagcggagaagtggattgcagatataacaaggagcacagtaaactgagatgtaaaacaccttattcaacaacgaggatgctgactcaaaagcaaaagttgaagcacattatgaatgaatgtcaaaagggaaaaatctaaagctaacataaaagagtgcaactacatcaaattggataaggaatagtattttatagccaattaatgaatatttaaaggacatcaacctcatctctttgaaacacatatgaacatagttgagctagagggtgacatgatgtatatatttaatc

SEQ ID NO: 249409 - DNA, 1056 bp, Homo sapiens
gtgcagagtatcattgcagcgcttttccagggagtaacgtgctgcactggttcagggctttgtctttattcacaacacattcatgtgcctcagcatgggggcagctgcactgttgcctgccagcctgtcctctttgactgccgaatgaaccaaaggataactctccattcgtgagagagagtgagctacagaggaagaaagaccacgcaaaagggagggggagagaggggggcgaagaggatgttctccggctcactcctacattaggtctctgtgcaaaggcagaggctgtgggagcagcatcaagcaagacttcgggcagtgattctaactattgcctatgaacaccgtggctgggacgactttgacgaggcaatttattacttacgcatagaacactggctgtgctgaaactgggagcgcaaacagccccttgttttctaatttagagacttgcatcttttcgacactcaacagtatcaagacactctgctactacagattgatttccaccatcaacacctttacctcttcccgcctgaaaataaaatatgaaatataacaagtaaatcgcaatctaccttgaatcttctggagaggaaagaagaaaccatgtctagacaaggtgctggaaagacccagggaagacacaggtgagctaagaaagcagtagaaactgggtaattaaaagtcaacataatggctggaaacttgttcaaggagatataaaaagaaagaaaaaccaaaagagagactgtatggatgaactttgtctatttacaattttgtctaaggccaaatctgcagtctggtcccaccgcatgttatctaagttgttcatataccaatactaagagctactgaaattcttccaaaaaatcaaaatcatttcccctttgatttgctagttttccctcttggtaaataaagattcattttttagtaataactgacctgccctaagggttcaccactttcttctgatctcaaatcttgtgctaggtctttaggttacaattcatgaaactaaaaaataaacaaaaaaattctcttact

SEQ ID NO: 249410 - DNA, 865 bp, Homo sapiens
aaaaaaaaaaaaggcaatttgtttacttaccttaaacccttccatgacacatatagttaactggttttcaacaaaggcacaaaagcaattcaatggactgtgaaagggaaatatcttgggcctcttcaagctggggaccccgctgagggcaaatctgcctcccattctattcaaagtcatctctcagctcacagagatagatgcatattctgattgcctcttctggaaaaacttatcagaaactccaaagaatgcaaccatccctctctcacctacatgtgacctggaagtccccaatgggggggccttgctttgagctgtctccacctttctggatggaactaatgtatttcttacatattgattgatgtctcgtgtctccctaaaatgtataaaaccaagctgtgccccgaccaccttgggcacatgtcatcagaacttcctaaggctgtgtcacaggtgtgtcctcaatcttggcaaaataaactttctaaattaactgagacctgtctcaaatttttggtgttcataggacaaaggaatttttggtgttcacagaaaaggctatcgccttttcaacaaatagtgctggaacaagtaaaccttaatccaggcctcacaccctataataaaaattaacctgaaaagagtcacagacctaaatgtaaaacctaaaactatgaaacttctagaagaaaggataggagaaaacctttgtggcttcatattaggcaaagatttcttagatatgacatctaaagcacaatccataacaggaaaaaaagatcaactggacttcatcaaaattaagaacttctgcatatggaagactattagaatggaaagataagccacaaactgaaaa

SEQ ID NO: 249411 - DNA, 358 bp, Homo sapiens
cagtctcactgcagtgtgggagatgatcattctctcatctcttaacagtaaatataccctagtgcatcatgttaagttgtaatagccaagctaattagctttggacctagagatggcagagttgtataaagttaagagtcttggctcaggagtcaatagacttgggttcgaatgttgcttttactacttaacagctgtgtagctttgggcaagatacattgtctctgaaattctgtttcctcttttgtaaaacggaatgataatagtacatgcctatagaattgctagaaggattaaatgagatttgtaagtagtacatctaatacataagaagcagtaaactgttattatgactgta

SEQ ID NO: 249412 - DNA, 272 bp, Homo sapiens
caacagaaggaactggtggtgtgtcatgtgaagacttaaggcagtggttcttaacctcttggggtttgtgtccccatttagaatctgatgaagcggtgggctttccttcttcaagaatagatgaatatgtatgtaaaattttgcatttaatttgagggattctacaggtttacaaacttccttcagaaaacataatatgtaataaaatgactggcttatgactaaagttatctgttatgtcaataaatatgtatgatatactttcctactga

SEQ ID NO: 249413 - DNA, 578 bp, Homo sapiens
gacaacggcttactgacattctcaaacctgagccctggcagtattacttcaaacccatgatgaaggagttcggcagggagagctattaggaagctccttggatggcccagacatgaggtcatcggggctggaaatactgcgtgacaatgggagatggcagggtaaggaaagaacatatgcaagagacactctcagagaatggacagtatttgggaccagtgtgtgtggggaggagaggggaagaaaggaaagaagaaaaggtcttaaaaggccactgcagggaccctccaactgccgctactcagctccccagagcagaatctcttttcttctacctccaccttcccgcactcctttccctgggtcaccgctccatttggaatctctgtacctcccctcttaccccctcatcagccaccctctgactcctgccctctccctctccataagcttcttcctctcttgctacaagtaaattggatcacctagagaaaatattttctgaatcatgttaaatattaatcatctcaatctcttcttttccttttaccaacattctcaaaggagtaatcttaatt

SEQ ID NO: 249414 - DNA, 148 bp, Homo sapiens
cctttgttgagatttttctcttgcatgagcatttcatcatttcatcctctgtggtcctttcgatctctctgctgaaatttgctatattcattcatattcttcaattttccattgaagcctttaatatattaatcaaaattatttgaca

SEQ ID NO: 249415 - DNA, 473 bp, Homo sapiens
tgcccagcccgtctctaaagagtatcagcatggctgggcatcagcattctacaagttagagggagcttgcagacatcgaaccaatggatttaatccacatcctcagaggcttaggctttctgagaaagatgaataggaaaccaagtcactgtgcatccctccactcattttagccaacgctgcttcacttttactgccttatattgtgaagttcttggggagatttttaatagtcctcatactgaaaaattaaaatccactcataagccagcagttagaaagtcgagtcagtacccagctgaatcgtgaccacccgaaccaaggggtcctgcccccatggagccaggtccatgcggaatgaacagcatcctcctttacttcactccctggagcggctgtgcagagaatctgtgagaatcaatctcctcccttctttggctttttgttttcatagagttgaattgaagacaatg

SEQ ID NO: 249416 - DNA, 263 bp, Homo sapiens
aaagaaaatctagaaaatggagatgtgtttgcttttatgtgataaaactaaggaaatgcaaagggttcagcacagtactccttgtgtaggtaataattcttataaatgacaaagccagaaggcattaagttttaaccatacatatatgcagttatgtgtttctctaatatacatactctacattagtttctcttgcatattgttgatggaaattaacatcttctttaaaatgctcttctttcttaccataattaaatttaaaa

SEQ ID NO: 249417 - DNA, 400 bp, Homo sapiens
ccagcccaagaagagatgaagcacatcactgcaccagctacccttactgctatagctggaatgtttatcaccgccgaaactcctgttgaaactgaatccccagtgctgcagtattgggaggtgggcttttaagaggtgattgggtcatgaggtctctgcccttatgaaaggatcgatccactcatgtattaacagattaatgggttagtagatgaatgggttttcactggagtgggattggtggctttataataaaagggagagagacctgagctggcctgcctgggaactctgcagaggccctgccccaggaaggccctcagcagatgtggcccctcgacctgggacttcccagctgccataactgtaagaaatacattctttatctttataaattacc

SEQ ID NO: 249418 - DNA, 147 bp, Homo sapiens
aaaaaggaaatgagttgaaggccactgctgtggctactgaaataattgatgcattttatcttaatacttgactggaaatttcctgtttctttggtttgtatcttgttattaatttttatcattaaaatgtataatagctttatagta

SEQ ID NO: 249419 - DNA, 393 bp, Homo sapiens
cctagaggcaagggatgataaatgtcttaacaggagtgcagaacagttcagcgcagtgaattgcccatcccctatgcacattgagaaacgctgattaaaaattgaaaacttgtcctgtgaggaacacctgaaagttcgaaggacttattggctggcgaagaaaagatggaggaatgtgttaattttaagggctggcatgtggaagaagagcatttatttgtgttccgatgaataactgcctcaaaatagtccctctagcagagattacttgttactaatagaagatgataatttacctctcagccctagatgattgcatatcagataggatgatatatgtgaagaattattcataagttataaatttgtaaaaacatgatgtatttattattg

SEQ ID NO: 249420 - DNA, 1181 bp, Homo sapiens
tctacacttgccagtatataagcaggttgcctctgactgcaaatctctcaacaaagcattttcaattaaagcagatgattttttttttttttcactatatgcaatctgctggaggtttctatttgcatggaatgtctttttccatcccttcactttgagtctatgtgtatccttacaagtcaagtcttttgtgggaagcatatagttggctcttttttaaaaaatccattcagtcactccaggtctttggagaatttaatccctttatatccaaggtaattaccgacatgtaatgtaagaacttcctactgccattttgttaattgcttctagttgttttgtagatcttttgcttctttctctttctcctttcctttatgattatcttctgtactattatgctttgattccttactttttatcttttgtgaatctactttaggcttttcctttatgattaccatgagacttacaaaacccatcttatagtgataacaggctattttaagctgataacaatctaactctaactgctaaaaagaaatcctctacacttttactccactatccccacatttaaaaaattttaagtcacaatttgtatctatagcaaagtacatcttgcataaagatggataaaatacactgctgtctggtaagagcttacaggaaggaaagacattcaaataagcatctatgataattgcaagtcactgaacaaaatcgagcaggatatatcagatcacagctagattttatttgattttgtgaataatttctgacaaaatactgatccccatctggtatctgccctgaaaaagcaaattttttaaagctcatctgagattttctacaactctgttttagctggaaaatctttcttttaaaaaaagataactttggccagatgcagtggctcacacctgtaatcctgaccctacaatcacaattttaaacttttttttctggtgtcactcactctattttaaatacgtctttacatctatatttgattttccttttaaatctattgattccttcctagaaaaatgtaggacttgcttcattattttgcaccttcttgggaaatctgatgtttgttctctcgattccctttgggttttgaatactaatatcactcttcctctattaacttatcttgaccttatgctgatatgacg

SEQ ID NO: 249421 - DNA, 412 bp, Homo sapiens
tgccacgggcagtaccaggggtgaccctgcgatggaccactcctgctctttttccctccctgagttttagagtctccggcggacctgtccagaggcctgcggccttttcatcctttatgctctccaccccaggagagccccttggtagatccatcttggagctgtgtccagcagcctggaccacctcaaggccctgtccctgagaaaggatgcaggatgaacattacaaaatgctgatgaaaaatatcaaggaacatctgaataaatggagagacttcccatgttcatggatcggaaaatgaacataataacatacacaagcttattctacgtggaaaaacacaggtccaaaaatgtccacaagatttctcaaaaagaataataaagtggaagcactcacttctcccaatat

SEQ ID NO: 249422 - DNA, 485 bp, Homo sapiens
tccacagccgctcccacctgaagtgaaaggcaggaaaagccagcctggccccctggcctgaagtccctgcctcagtcttcggccaggcacagtggtctctgaacagccggcacaggacagtaaagctcagtctgctaacagctcggctcaggacagcagcaaagtgaaactgccgccaagtgctgatatgtctggcacggcccaggagagccccttggtagatccatcttggagctgtgtccagcagcctggaccacctcaaggccctgtccctgagaaaggatgcaggatgaacattacaaaatgctgatgaaaaatatcaaggaacatctgaataaatggagagacttcccatgttcatggatcggaaaatgaacataataacatacacaagcttattctacgtggaaaaacacaggtccaaaaatgtccacaagatttctcaaaaagaataataaagtggaagcactcacttctcccaatat

SEQ ID NO: 249423 - DNA, 410 bp, Homo sapiens
agatgctcactttcccagcctcccttatgcctagggatccccatttgatcttgttctgactaatgagaggtaaagagaagtcatctggaagtcttctgggaaactttttggtttcctgtaaaaggaacaggcatgaagtcatacatagaagcgctttcacctcatcccaccccacctacaaatacatacactgtatcttctttgaattcagatgcaatgcctggagctggggtagccaccttgtgaccaagaagcagtaagtttgaaggcaacagtcaaaagctaagtagagagaggcagaaatgaagaatgaccctggatacttgacgagacattagagctgataaatcaacctcaaaatacctacctcatagttctcaagtgagattataaatgcttgagtacttaag

SEQ ID NO: 249424 - DNA, 478 bp, Homo sapiens
ctggtacagctccagaacctggatctatgtgtgatatcacctgttctgattagctaggtcttaggtaagagaaaggacaagaatactctactccagtatcacattttacaaataggtaaacttatgtcattgctctgggtattttgtggctttgatctctccctgctgacatgcatgtttacacttacagattgtgcaaccagattctatttacaccagcagcctctcacataaacatagcaggtcactggaaaagatctggaaagctcaaagggatacactctgaaaggagggctttaagatttctatgctgacatctcacagatcagaaaatgtctcctatgggttttctgtacattctcaatccaaaatctggctctctcctgtgattcccagggagagctcagctcttatgtacagattacaggtaagatcaacctgactcttcattctttggtgttacagcaaggagagtaaa

SEQ ID NO: 249425 - DNA, 111 bp, Homo sapiens
ttttaaaagatttcttttttctctcaacaccatgattcctttaacaacatgtttccagcattcccaggtaggccaaggtgtcctacagaaaaaccttgggttagacctaca

SEQ ID NO: 249426 - DNA, 285 bp, Homo sapiens
aagtaaggagaaaggtgagaattttcagctatgctgattggcgaagacaaacctgagggagtatttggataggaccttactcagagaatgggtagaactttaatacataagaagaaaagcaggtataaatgggagctaaacattggtacacatggacggagacgggaataacagacactggggactacaagggaggggagtgagggaggagtgagggttgaaaactacctattaggtattatgctcactccctgggtgacaggctgaatcataaagcctcagcat

SEQ ID NO: 249427 - DNA, 284 bp, Homo sapiens
aaaggtagatgagtaggaagattaggactcctgagttgcccatgatttcatctaatttttggattcagaatgtattttatgaataatatgcagagatgcatattaggaatgtgaagccagaatgggtcagttgtagctgctgcaaagttctgtagctgatggtcatttaattgcatgggggttattttatctttcatgattgtggtgcacctgatgctggcggggtatttgtgtgtttttgtattgttatttgattacaaaaataaagcaaaaactaacaaata

SEQ ID NO: 249428 - DNA, 430 bp, Homo sapiens
gagccaaccaatcaccacgcagatcactggaaagattaaatcagtccaatagatggagatatttctatgaatatagctgatattaacattccaatatttcattacactgacaaagattgcaatgagaacagacaatggaacaaattaatctattcttctgacagtatgtaatgagaatgggatgtggtttaaaaaattaagccattcttagtgcaatctcaagattgcaatctcatggtctctctcagatgctatacactctggtgatacgtcattgaaaagtgtcagtttaacaaagaatgtgtcttagctcttgctgggattgtagaacacatttgctttgtctcaccgcagccctgcccattaaaaacaatgaagtagaatcaattatacttttcagaacacacataaacacaatcaaagttgaaaa

SEQ ID NO: 249429 - DNA, 827 bp, Homo sapiens
aaatgatgcttgagacacaccaagatacctgcacactagaggctgcagtcacctcagaagaaagatgccccctgctctggctggtcaaacggaaccaagtccgtcttcctgagaggtttggtccccttcaaccagctacagcagggctggcaatgcccagtccttggagaaacagaagagattcaactgcaactgaaattacctactaaaactttccttgagaaaacaattctggttttttcaccatattcttatgctcccaggaaggaagagaagaggagtcctggagtcaaaagtgagcaagattttaatgctcaacacacactgttctgtgcctttgcactcacagctgcagccacttacatgcttttgacagacacacagtcaagaaagagtttgaggatggagtttgtgccaaccctaagccagccaggggaagagcatgagacatagaagacagggctcctgctcactaggggctaacagtctaaggaaagaaattagacatgtatatatggtgtgatccaattgaattgcaagttatagcatggctagttccaaggcataattcttacctatcccaccaaatatgcctagcacattatgtatcatcaagtctctattgatctattcagcccaagatatctattcactaagcaatcatttctcagttccctgatctgtagaatagggataatagtacctgtcacaccaggcacagtggcttatgcctaaaatctcagcatttggggtggctaagacaggggattgcttgaggccaggagttccagatcagcctggtcaacatagcaagatgctgtttctac

SEQ ID NO: 249430 - DNA, 232 bp, Homo sapiens
taatgtccttctctgattcccccagtgaatgatacaggaggatatcaggataagaaaggcaaatagttcctggttaggctggagggaactagcatgaacctcctgccacagccacatcatgcaaggtactatgtccaatcaccctctcaagggtactgcatccaattaccctcagcttataaattttcctcccatgaaaatgactgtcctggctcagcagaccccggtttta

SEQ ID NO: 249431 - DNA, 313 bp, Homo sapiens
gtcccacttgtgtctgtcttggagctttcctaatcccgggtttggccagactcggcaggaatttctgtctgatttcattagggccccaagccattcattggaaactggtgatgatttccaacaggggatcgactcacattactgttttctaaattagggataattttcgctaacgatgaaaagcaagaatgtgtaaagttcctatggggaatctttaaaatacaaggtattcaggaccttcttgtcacaaattaatagacgtagtatgttaagtaatctagcctgtggtaataaataggcctctaaaagttta

SEQ ID NO: 249432 - DNA, 614 bp, Homo sapiens
attttctgctgctataataaaatatcacagactaggtaatttataaagaaaagtaatttatttatcttatggttctggaggctgggaagtccaagaccttggtgctggcttttgctttgcttctggtgagggccttcttaatctgtcatcccatggcagaatgtggaagggcaaggaagcatgagggacagagagaacacaggagctgaacttcaacttttttatcagaaggcaacttccacaataactaacccacttctacaataaattaagtgaacctctggcagtggccagattactggattctgcgggtgacatgctccaaagcacagtgtctctgctcaaagctcacgagagtgagccgacattgctcaggtgcccaggcttgaagggtgtccaccaacacacagccaacactctgtgttctccagagtgcagggcactaatggtgatctctggagtcctgggaaagtccttgtcctccctctcatcttcccccagcacagaacaccacagccagtcaagaaagagtgtggcaggctgtgggtgaccggatgtgtagactcataatctaattacctcttaaaggtcccacctcttcatattgttataaa

SEQ ID NO: 249433 - DNA, 476 bp, Homo sapiens
gatcacctcctttacactcatctatgtttctattaatctggcccactgtttaatgaacactatactttcatgttgtgccatgctattttttcatttctctcgcagcaccatatcttcccatactctgctggaacagttcattttctcggttagaattcagtaacccagtattaatggggaaaacatctaacttgtagtaagaagacctggcctccagttttgattctgctgtatataggctgtttgatcctcaaaaaaaaaaagggcgagttgctctatgagacgcctcatttttaaaaggttatctggtgccttccttgagtcaccaaatgtaattgttgtatgagtgaaataataacatgttttgtaagtggtttataaattgtgaagtgggtcacaaatatttctaatttcacttatttttcctggttaaatctcccctatttgatttagctaacactcctgcttgccttaaa

SEQ ID NO: 249434 - DNA, 445 bp, Homo sapiens
ccagtcatggagccatggagatttctgcctctcctatcctgcttctggtccccgacaatgaagcacccaggtcttaggtggggataggagtacctccaagccagatcacaccctctgcttactacaagcagggatacctgtgctgcaatagagaatacgagataacctctgaatcaagttcaggattagagatttttaatgaaaaagaatgagttctaaataccaaaattaggccactatagtagccaagagttactattagaccactatggtaactgaaaatttatggagtctgggaaaaaagatgtggcaaaaggacctagaatgtaatgaaaaattggagttcaacagagacattattgaaggacagttattaaagaaaaaaatatatatttattgatgaacttttaataaaaattatttgttctgtattttctaggaaagt

SEQ ID NO: 249435 - DNA, 507 bp, Homo sapiens
ggtccaatgtgtgagttaccatatgacctaacaattccacacctaggtatttgcccaaaagcaatgaaagcgtgtctacacaaaaactgtccacaagtgtttacagcagcattcttcacaacagcccgaaggtgagagcaacccaagtgtccattgcctgatggataaacacagcatctccatctacacagtggaacactgttcagcagtaaaaatgacgagtgctgaggcatggcactacgcagctgaacctcaaagacacagtgccgagtgagagaagccggacaccaatggacaaataccgtgattccatttataggaagtgtccgggagaggcaaatccatagagacagagagcggcttggtggcgattaatgctggagaggagtcgggggtgacagctcaggggtacaggggtctctctggggagtgacgaaaatgttttcatgattgtggtgatgcttgcacaactctttggataaacaaaaactcacagaattgtgtgta

SEQ ID NO: 249436 - DNA, 543 bp, Homo sapiens
aagtttgactcttcagtctgctgcatctcagccaggagttcatccatcttgaaggtctgaggggcacgggatacaagggtacactgtggtcctgcaggaattcacccaccaattcatcttcagaagctactcccaaaggcttggagactgcctcagaggctggggctcggaggcggggcaggggtcaggcgtcaggccttagtgccttctgctggggtcggcgggtgttttctttttactgtatttaactacattaatcgtgctcagtatttcggttcactaatctcatcagctgagactaatttaatatttaacccgtatgttgtatattaagtaggttgattctacttccaactgtttgtatttgcctctttttcaaatatggcttgtcaagcttgtagtcatttgctctttaacattttttttcctatttttctcattgtgttgacttaaacatttaaaaaataagtcctataactgtgtgtaacatatgttttaattttcttttcacttatgggagacattacatttgacacatctgca

SEQ ID NO: 249437 - DNA, 384 bp, Homo sapiens
acaaatcaccagatagcctattttatagccagcagctaagccaaataattcagaacactagaagggaactgaaaagatgaaatgacttgggagaaatactttggattgctgggaaacctatttggaatgctgataatgggtgattatttggtcaaagcacctgtgttaaaataagctttgctgctttgaacccttacttagtgcagtgaaatttctttatattaagtgtttctatttggaaagatcatttggcagaaaatgtttgttttgtcacttaaaatgttttaaatttagtctttctttttgcaatttactataattggttgggtaatataatgttgcgacctggggcttatttgttattgtggctttgtatggtgtaaa

SEQ ID NO: 249438 - DNA, 372 bp, Homo sapiens
aatccccccagttttatttttttattttttgtcatatctgattcaatacttttatttatttttattttttatttttgagacagcatcttgctctgttgcccagtgtggagtgcagtggtacaatcttggctcactgcagcctcaacccccgggctcaatcaccccaatttcatatcagactcacttgcttataacagcacacttcaaatccttctcagaccattttccaaccactaagaatcagtatatttcatgccagcttctgtcctagatactatggctataacacagttttcaaggaactcacaatttggagagagagagagaaatactaagtatgtaactagctgtcatagttctttaaaaaaaaaa

SEQ ID NO: 249439 - DNA, 229 bp, Homo sapiens
atattagtcttcctggagaggcatttggatttataactctcctctacccggaaagtgtccatcatagcaacatcttccagggattcttaaatataacgatgctgttgacatgtctggttatccctttaccttttcagaatttgtgggaggtgagaagtctgggagaggttatctgggttattatgaaacctacacacttactgaattaaaaaaaaactatgtaacacaa

SEQ ID NO: 249440 - DNA, 817 bp, Homo sapiens
  misc_feature (766)..(766): n is a, c, g, or t
ctgtgtgatctgtttttcgcctgttcttccctgccctcattcagactttactctaagacaatatgggctgctttttcccacagctagccccttcccctgccaccccctgctccccataggccttttattgcttctgtgcttttactcatgatgttccctaggctaggagctgcctgcatcttcacttgactggccagtttctactcattcctcatggcatattgcttgagtaacctctgctaggaatcgtctccttattctacctcccccctagaaaaaactggcttacgtgttcctctcctgtgtttctactgctctccatgtatgtgtctatcattctaagcctttttttgtgtctttttccccataccataacatgaccaccttcaggaaaggaattatgttttactcaatttgtattttcttgtttctggcattttatggattagaataatcggaaggatttactcccataaacaggtgagattggcgagagaagaaattatttttcaacgttattattaaatagaagctctcatgctctttatagccacattcctccatttacaatgtgctgttgaggctgagaacttccttgttctttaggtttctcacagattatttttctgttacaagctatttgttacttactcagttctgagttactgagattgtttaattctatacttagttgtatggcagattacagctcacacctgtaatcccagcactttgggaggatcacttgaggccaggcattcgagancagtctggcaacatacacatatctggatacaatttcacatcaggaacaaca

SEQ ID NO: 249441 - DNA, 339 bp, Homo sapiens
cgcctaagcagacgtgacaactaaatgtagtgtgggatcctgggtgggatcttgggacaagaaaaggacattaagggaaagctaaggacatctgaataaaccatgaactttagttaatgtatgggtagtggttcattaattgtaacatgcttatcatactaatgtaatatgttaataataaaggaacctattttagtctaaaaaatatttttgggccaggcatggtggctcacgcctgtaatctcagcactttgggaggctgaggcgggcggattatgaagtcgagttggagaccagcctggccaacatgatgaaacccccatctctactaaaagtaga

SEQ ID NO: 249442 - DNA, 905 bp, Homo sapiens
actccactcaaaaaaaaaaaaaaaaagacagtgtttcaccacgttgcccaggccggtctggaagtcctaggctcaatcgatcgccgcgctcggccgtccacagtactgggatcacaagcatgagctaccacgccaggccgatctattcctttctggttactaaattggaccgggggcgcggtggctcacgcctgcaatcccagcacccagggaggcggaggcgggcggatcacccgaggtcaggagcttgagatcagcccggccaacacggagaaaccccgtctgtacaaaaaaaaaaccaccaaaattagctggcatggtggctcatgcctgcaatcccagccactcaggaggcttaggcaggagaaccacctaaccgggaggtggaggccgcggtgagtcgagaccggaaaacactctagcctggaaaacaagagcgaaactccgctcaaaaaaaaaaaaaaaaaagaccgtgtttcaccatgtcgtccaggctggtctggaactcctagaacctgtagatgttacctcatttggaaaaagcatattttcaggtatgattaagttaaggatcttgaggagagattatcctggattgtctccgtgggcattaaatcctggcacatatatccttataagagggagataaaggagatttaacttcagacagaagagaaggaggccctgtgaccaagaaggcagagcctggagtggtggagctgcaagccaatgaatgccagcagccatcagaagctgcgcaagtcaaaggatggattttcccctcagcctctgagagcactggctctgctgagacctagatttcagcccagtgatactgattttggacttctgatatccaaaactgtgagaaaataaatttctgttgttttaagtcaaaaaatttt

SEQ ID NO: 249443 - DNA, 416 bp, Homo sapiens
acgtggttctttattcttttcatacatagtgtcatttaatcttcttgagaaccctaaatgagtcagggcctactgttctcattttataggagaaactgaggctcgctgagattgagttgcttgcttatggtcatatatctaaccaatggcacctatttgtgactcttctaactatacaactgattgtttttgtgttattctcaacccctggttatttcttaggaaataagttaaaattctagctgaaaaatgcgcttacagcaaattatttcatatcttggctcccacatctctaaaatatggataacaatcttttttaatagggtgattccgttaagtaagatgatatatgtgaagcatgtagcatgcaggatatgtaataagagctcaataaatgttacagtacctttcttact

SEQ ID NO: 249444 - DNA, 267 bp, Homo sapiens
tttgttttgttttttcttgaactgttttgttttgttttctttgaattttatcaagaatacaaaacccccagatgcaatattttaaactccctatcaaagcgaagaccttaaaattaaaagctttatgtctccaaaaagcaaaacccaatgacaaaggtataagccaagcatgcatcaagttgttcaaattagaactgaagtgagatttcttgaataaatatagaggaattaactccaaacaacaggaaaaatgaagataggagacaa

SEQ ID NO: 249445 - DNA, 669 bp, Homo sapiens
  misc_feature (646)..(646): n is a, c, g, or t
  misc_feature (648)..(648): n is a, c, g, or t
ctcagcctcaaactcaaacggactgagccacgcttctggtttggtttccctggttctctggcttgcaagcatcatatcatgggacttagcctccctactcacacgaccaattcgcctaataaatcccctctcatatatctatatatctctctatctctaatcatctttatatcatctatatttatctatatctatataccttatcagttctgtatgtacagctgtgactaatacactgggctaggggctgacagtgagagacaggactagctgaatttcctaggccaactaagaatccctaagcctagctgggaaggtgaccgcatccacctttaaatacggggcttgctacttagctcacacccgaccaatcaggtagtgaagagagctcactaaaatgctgattaggcaaaaacaggaggtaaagaaatagccaatcatctattgcctgagagcacagcaggagggacaatgatcgggatataaacccaggcattccagctggcaacggctaccttctttgggtcccctccctttgtatgagagctctgttttcactctgttaaatcttgccactgcactcttttatgttccatgtttgttacagctcgagctgagcttttgcctgcactccagcctgggcgananagtgagactccgtctcaaacc

SEQ ID NO: 249446 - DNA, 322 bp, Homo sapiens
ttatgtgtatatctttttttgctgcctgtgcatcattattccaaatgaaaagtcaaattaggctgggcacagtggctcatgcctgtagacccagcactttgggaggcttagacaggaagattgcttgagcccaggaatttgagaccagctgggcaagatggtgagagcctatatctacaaaaaattaaatgggcatggtgacacgcacctgtagtctcagctactaggaaggctgaggcaggaggatggcttgggcccgggaattcaaggcagcagtgagctatgatcgggccactgggtgacaaagtgagaccccatcttg

SEQ ID NO: 249447 - DNA, 325 bp, Homo sapiens
gggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttaaat

SEQ ID NO: 249448 - DNA, 1202 bp, Homo sapiens
gagactagtgtgtgcaaagaggcaggcggatgatccccatcctacaggggcatttattttgtggacaccggggtcacctgggaagcaggtctggcctcagttctccggcctggggcactgtttgttctgtgtctcgcttgtggaataaagaggattcctgtttcagtgaggaaccacacctgctcagagggaaaatactctgcttgtcagaatctttcactttctgtgaaccagctccttggcctgatagggtcacagggcccaggagtggtcaaggaagcttctgtgaatgtattgaacgtcaagagtgtccagggggatgtgtggtgtttggcccgattcctgtcattgccagtggaaatgccatctctggagtttgccccaggtgtttgtgaagcaggttgggattcggagctgaacgctcctctaaagatatgtgctggcttcttatgtcatggctagacagcccctgctgggcctgtttgctgtccctttctctttgcccctgagttgtgtcaggagatttgaggaacttctgactcatcctagcaagtggctatggcctttttgcaaaaagctgtgtcccaagggaagaggcaaatgtgacccaggtaggtgccagcagtcacatggcttgcagggatgacaagctcaaacaggacttgatggctgggtgtgatggaaaccataacacatgattcttgggagcaggtccatgctggctggcaggatatttggctctgtttgtgtttgaacagtctgacaacagccataaagcctagcagctgtgaggtatttcaggtaccggaggacttctggacttcggttaaccttggggtcttgggagtagaactttagctttgaataatttaagggcttggcctgtaacctcacgcctgtaaccccagcgctttgggaggccaaggtgggcggatcacttgaggtcaggaattagagaccagcctgggaaacatagcgaaaccccctctctacaaaaaaaaaaaaaaaaaaaaaaaaaaaaaaaaaaaagaaagaaagaaagaaaaaaaaaaagagccaggtgtgggggcacgtgcctgtagtcttagctacttgggagctgaggaaggaggattgtgtgagcccaggaggtccaggatacagtgagccatgattgtgccactgcactccggcctgggtggcaaagcaagaccctgtctcac

SEQ ID NO: 249449 - DNA, 866 bp, Homo sapiens
gagactagtgtgtgcaaagaggcaggcggatgatccccatcctacaggggcatttattttgtggacaccggggtcacctgggaagcaggtctggcctcagttctccggcctggggcactgtttgttctgtgtctcgcttgtggaataaagaggattcctgtttcagtgaggaaccacacctgctcagagggaaaatactctgcttgtcagaatctttcactttctgtgaaccagctccttggcctgatagggtcacagggcccaggagtggtcaaggaagcttctgtgaatgtattgaacgtcaagagtgtccagggggatgtgtggtgtttggcccgattcctgtcattgccagtggaaatgccatctctggagtttgccccaggtgtttgtgaagcaggttgggattcggagctgaacgctcctctaaagatatgtgctggcttcttatgtcatggctagacagcccctgctgggcctgtttgctgtccctttctctttgcccctgagttgtgtcaggagatttgaggaacttctgactcatcctagcaagtggctatggcctttttgcaaaaagctgtgtcccaaggtgggcggatcacttgaggtcaggaattagagaccagcctgggaaacatagcgaaaccccctctctacaaaaaaaaaaaaaaaaaaaaaaaaaaaaaaaaaaaagaaagaaagaaagaaaaaaaaaaagagccaggtgtgggggcacgtgcctgtagtcttagctacttgggagctgaggaaggaggattgtgtgagcccaggaggtccaggatacagtgagccatgattgtgccactgcactccggcctgggtggcaaagcaagaccctgtctcac

SEQ ID NO: 249450 - DNA, 184 bp, Homo sapiens
gcaaaaagcatacttgaataggaagaaagaaattcagtttgtagaaaaaggaaaatctcaggtttttgaattacaaacagtctttcagttgatagaaacatagattaatttgggggaaattatataattgctgggctattttcagcaatcagtcatgtaaaatgctgtcctaaacacaatgtta

SEQ ID NO: 249451 - DNA, 429 bp, Homo sapiens
tcttaatgtgaattagtacatgatgtgctacagggcgattcatattgtttatgttcttttgtttgttctttgttctgttttgtttttgttggttggttgatgtcatgtcacaaggaaatgtgtagaatgttttcataagacattaaatcctagtttaaaatttagagatgccagaaccaaagttgtcaccctttaacagggtgacaggcttcatgctctattctctcaaataattcattctctgaggggtctagatagctaagatttaaattctctaggtataaataaaattcaaaagtaaccttcagggtagcacatttcaaagaacgtagcctgaaactctgtataattttttgtttttggagacagagtcttactgtgttccccagactggagtgcagtggtgcgatcttggctcgctgcaacctc

SEQ ID NO: 249452 - DNA, 460 bp, Homo sapiens
aagattacgaagcctgcgttatttcccctaaatccccttcgaggaagatttgaatccctcatcaacaaattttcattgattatgtttctattatatatactgtagactctatattcacgaatgtaatcatactcattcagaaaaatataggaagagaaaatgagtatgacctgtagcctgaatttcattataaaagatttaaaaatatacattttatattaaaattgatgtaatcttttaattatgaagtctttgattctttagatgttttcatccataacccaagagcaagatcttggcatcagttttttccaggttatgtctatatcatctattattacttaaaagttggagttacatatagatatatagatatatagagagttatagatatatgtaattttttttcattccagtcccccacccgagcaagacccatattttatgtaacttaaaagta

SEQ ID NO: 249453 - DNA, 199 bp, Homo sapiens
aaaatcacattaaaagcattctgggaaataagagttaatatcacatggccaggagttaaagtatgtttttatgttttctttaaaattgtaaatgcacatttttaccactaagacatactaattgttacttcaataagccccaacagaaaaaaaacaactgtttcatattttatatgggaataaatgtattttggcttca

SEQ ID NO: 249454 - DNA, 358 bp, Homo sapiens
ctgcattttagcaaacattttcacagtggtttacaaaataggttagaaaggctgaaggcagaaagatctggttcttagtgagaaccagaactagagcactgatgattcagaggagggtagagcatggaatttatgaagacttgcagagagaattgatgagattggtgaaccattagagctggatgatgaaagaagtggagtaattaaggatgattccaggtttcttttaagtatgatctattgggaaacaattccagagattaggaaatactgaaggagaagctgtgttttgttcttttctatcatgggtagggtgaatcacaggttgattgggaggatgatgaacaagagaatgaaa

SEQ ID NO: 249455 - DNA, 198 bp, Homo sapiens
ttggtggtaaagggatgggaaacgtgtgttgccaaggagttcccagcacctgaaagaagcagaaagtgtgtggcaattaattgtcctataaaggttggaaattgtataaagcaaaaaaattaaagtttaaaaaattttaataattattttaaatacctgaacaagtccccagaataaaaacttatggctgttttaaga

SEQ ID NO: 249456 - DNA, 839 bp, Homo sapiens
tgttaaaagtacatccatatcataaatgttattagttctccctaaaataatcatctgtatgttcaataaaattttaatcaaaatatccaaagaatttttcatggaaattaataaactggtcctaactcttaacataaaaattaagagtaagattattattcaagagggaagatatttttattagatatccaacttaatatgtgggagtataaaatgctatataaccactttggaaaactgtttgtcatttacttgaaaaattaaacatacacctactccatgacccaggaatttcactcctaggtatttactcaagagatgaaaatcagttccataaaaagatctgtacaagaatgtcctttggatttccttagtagccctaaactggacataacctcagcatgcattaacaggagagtgtacctcagggttgttgcctcttggtgacaaagtagatgccgtatcactaggctttacatccacacttcatatggcacatgcaggaagcaaggggttttttcctaatgaggctttgctttttgatttgaaagggctgctttcccaggcttgatgtttatcttgttgaccagatctatgttacatgagccccagccagctgtatatttcagctggacacacactaaatgaagttggagttgtgtttgaaaagaaggagcaggaatggtagagggcaagaaggtgtcagctgtgtctgtaatactttattttctggaatgagatctgaagcacgtgggaaaatatcaacagatttgttaaatctaggtggtagggactgggtctttttttgttttcagtttttttttaatatttcatatttt

SEQ ID NO: 249457 - DNA, 597 bp, Homo sapiens
cagagaagaatttcatgccagggattggctataaagttcttcaaaagactgaaagaacagaagggaggtagaagcgggagccagacaaaagggaagaagggctttgcagccacagatcaggagctgctccggcccttggcttggagccccgagcccacatttgccactgagctgtcggagctgctgtggccactgcagtgctcagaagcccaggagtctctttgccagtgctgctgacaacttaacactgctgctgtccaggctgccaagcccaccaccaaaagaagaaacatctctgcactttctccaagcttctaatttttaccccagtgccaagaaatagcagaaccaaactggaagccacctggctagaagtctgggaggagtggtccgcaactgtaaacccccagcactgcagccggtggcctagaaaggcgtgtggagcaaaaagccagcacacagaagtgttaattacacctgttattctgactttgtagtcctttgccatacttgcgaataacttaagtgaatttgatgttactggaattagtttgcctttattttgccagttgaaaaaaaagatttctaaaaaactca

SEQ ID NO: 249458 - DNA, 492 bp, Homo sapiens
gcggttgtgtgagtcaggaagaggggccagatatctgagtgttcctctttagtttcttcaattgcaggaaagacagtggttcctgactcaggaagacagtctcagaaacatgtggaatgatattgagctgctaacaaatgatgataccggaagtgggtacctgagtgtcggttcaagaaaagaaacatctctgcactttctccaagcttctaatttttaccccagtgccaagaaatagcagaaccaaactggaagccacctggctagaagtctgggaggagtggtccgcaactgtaaacccccagcactgcagccggtggcctagaaaggcgtgtggagcaaaaagccagcacacagaagtgttaattacacctgttattctgactttgtagtcctttgccatacttgcgaataacttaagtgaatttgatgttactggaattagtttgcctttattttgccagttgaaaaaaaagatttctaaaaaactca

SEQ ID NO: 249459 - DNA, 392 bp, Homo sapiens
tgcaacctctgcctcctgggttcaagtgattctcctgcctcagcctcccaagtagctgggattacaggcatgagccaccacacccagccgagttgagagagtctttgcaggtgagggatggaagcactgaatcagcagccaagtttctgattaggtcatcagagaagatggggcagagcggaagagccgcacagacacactggaaactggcaacagtaagcggcaaagctccaaaaggaccaccacagaccaccttcaaatcagtgggcgcttagctgatacaagaaggtagtcttaggtatttgttgaaattgaaattacaaagacttcagatgctcttcctagctcatcaggatcctacagtgtaggaacacgagtgtttttccagtccc

SEQ ID NO: 249460 - DNA, 165 bp, Homo sapiens
gtacagacgaggttttgctgtgttgccagggctggtgttgaactcttgggctcaagctattcgcccaccttggcttcccacagtgctgggattacgggtgtgaaccactgcgcgtggccattattaaaatagttttttcttcctgatactaaggatcactgttta

SEQ ID NO: 249461 - DNA, 1166 bp, Homo sapiens
ctggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaa

SEQ ID NO: 249462 - DNA, 349 bp, Homo sapiens
cttttaaaatacatttttgtagttcttgtttttgtctctatcatgtgcatctagtggctcttccaaagcttttgttgtggggttagaaggcagtgttgtatgcattacagatgactgaagccatagagcctttgttcatgatcactgctcagatggtctgaaaagcagtaacagcaggggctactgaattagtccatttcactatattaaatccaggttcaacccaatggttctaattttatgtgctactgaatttaaggttcagcagaccaatttaacccatctatcaatcaacattgtttctgagaaggatgactcgttgttagcaatgtcagaagtctaaaccact

SEQ ID NO: 249463 - DNA, 498 bp, Homo sapiens
cacccctcacctcctgtattcccagaaagcctcgcgttgaggtgtgttggccagctccctagtttgtgcttactatacctggccacgcctccctacctaaggccgctggcttaaccctaggggcaggcagtgttagatcagacccagaccttctcatcccaccctcatcacatcggggagaggggactccaggggcgggaaggcaggcgtccctccatttggccagggtgggcggcgaggagggggtcactctgcaggaacactgagctctgaacacctctcgcctgctgcctgcctcacaccctctgcattcgctgtttcctctgttgggggagggggtttgtgaggggaatattagattacaccttgtcatttggaaagccccgtgtctccggcggccacagcgaggttgggggggtggtgagggaagtccatggattggccagaactgggggaaaaacaaaaagaaatgagagaaagagagagcgggtaccaaaa

SEQ ID NO: 249464 - DNA, 278 bp, Homo sapiens
atataatatgggaataatagtatctgactcataaacatgtttagactaaatgagctactccatgtaaagaatgcagaacagtgcctaacacctagtgtttaattcgttgtgttagtcattattgttactatcaatgagtttggcacttgaacatacgtagtttgccaagacagctaatatagaaaaatctacatctaggtgaacaaagagctagaaaagaaacagagtggttagagacaagcccaggcagatctccagacatcagagcactctaaaac

SEQ ID NO: 249465 - DNA, 501 bp, Homo sapiens
tacttaaatcctcctaaatattgtattatttgccttttgaaataatgtttattcttcatatttatatccagaatccttcaactataatataaacaccacaagggcggaaatttttgcctttttattcattgattcattgatgtatactcaatacctgggtcagtccttggcacatagcagatgcccagtaaataatgtggaacagaggaaagttacctccagaaatacctgcaaaactcctctcaagcaagtgttagggtctaaataacacagccagacccctttgcatgggtaactgcatgtcatcacatttcttagaaaccacatatttcagtaagattgaaccataaataggagatgtctttcaaatggtcctcataaccccaataaaggaaattatctctgatcatggggtttcaaaataacaggtgcaaatgacattcataaatttagtaatttaaatccctgattccaaatactaattttgaacttgtcgttaac

SEQ ID NO: 249466 - DNA, 339 bp, Homo sapiens
gaccaatatgatcacagttgctgtgaaggtgagaaaagttcatttttattatgtttccacaagagacgcactctattgttctcttgaaaacacacagctcatgtcctcctttagaacacacatcctctttaaagtaacatacaaagatgccaaaacaaggtaaaaaattacatctgaattctcacatttcaaacatatatgaaatatcaaataaaaatttatttttacaagaatttaggggaactactacatagctataaatgtaatatatatgttaactaagtatcacagataaaaaccatgctcccttcagcagcacgtgtaataatagatacaaag

SEQ ID NO: 249467 - DNA, 500 bp, Homo sapiens
caccttggcccagctcacctgtaactcataccagccccaggaacagattgcaaaaatggtcacaattcatcttcttcccgccttgcaatgtgactttgcagctccttccttcaagaggtcagggctatttctttatcctttgaatctgggctcatcctgtgactttggccaacggaatgctgcagaagagaggatgtgccagttccaagcctaggccttcagagaacttaatgggcttctcttctgtctcagaaccgtgttttcccagcagactgaaagcaagcccaggctagcctactggacaaagagagacatgtggcctagctgcctctgacattccagctgagagcctatcagccctcagagaagaactgttttgctgaatgcagctgaccagacacataactgagtctagctgagagtgtaagaaccgcctagctcagcccaggccaactgctgacccacggaatcctgagctaaataaacagttgttttaagta

SEQ ID NO: 249468 - DNA, 448 bp, Homo sapiens
agcagtaagaagccgaggaggagaatggacagatacaacaaaatctgcagcacggtggtcactcttggtgtggagatgggtctggagctcctgcaggccttgcatggtcagttgctgacttcccacctagactccgggcaccaactccttggaagaagctgtccagccagccatgattccatctcttctggtgaaggggctccaggccccagggatttctcagccactatgaggtcacagacttcctgtggtggaaccttgtcttcccagctacagtccaatcctttgcaacgagtatgttgaaagcaggactcctgatatgtctgcttagacttgctaagtgggagcgtctctcccctgcccctagaaaaatataaggcaaaagccttagaatttctctgatcattcttaggtaataaaaagtcttgcaatcactaaaaatggaaaa

SEQ ID NO: 249469 - DNA, 259 bp, Homo sapiens
ataaataaataacaagatataatggataaatacattccatttacaactgtgattctaaatggttaaatataaaatatctacaaataatcataagaagtttgaagaaaatcataacactttaaaaggaatcataatagaacatttgtataattatatacatctcacatgtttctggatatgaagatggaataatatttaaaacaatgattcttccttaattatttaatagagtaattgcttaaataattacaatgtaaaa

SEQ ID NO: 249470 - DNA, 618 bp, Homo sapiens
ctgccgtgaatcaaaaacagcttttttttttctgaggggacagagtcttgctcttgtcacccagactggagtgcaatgccgcgatctcagctcactgcaatcgccacctcccgggttcaactgattctcctgcctcagcactcccgagtagctgggactataagcgcacactaccatgcccagttaattttttttgtatttttatagagacaggatttcgtcatgttgcccagcctggtcttgaactcctgatcttgtgatccgcccacctcggcctcccaaagtgctaggattaggcatgagccaccgcgcccagccaaaaacagcatttttaagcaaccatttgccttggtttctctaggctatcaagtaggagtaacttcatatgaaggcaggagtgcggatggcatgtgtgaagaatctatccttttagatcaggctgtctttgggtgatggattgatgaaggagagtagagccatttgcaaagggcgtcagatgccaattgaaccagtttgggtcttaacctgtacaggaagatttagagcagagggatgaaatcagagtttaatcaggccaagtgcagaggctaaatgggtagggagaagtggcacgaaagg

SEQ ID NO: 249471 - DNA, 710 bp, Homo sapiens
ttttttttaatattttgtatagaggaggcctcacttgtgttgcccaggctggtcttgaacttctgggctcaagtgatcctcccattttaacctccagagtaaccaggattataggcgtgagccaccatacccaacctttagtattttcaacatcagaactgtcagagtggagagacaaagaaggaaaaatgttagaagggatgcagagaaggggagagagaggtagggggaagagaagaaagcataggtagagattaagacagacttaaatatccatttaaaattatttccctttggttaaagaatagcctaatgttctttattgtgccctccactaaagacaattgtaaagggttttaggaatagcatgaacctttcacacatgtggctaaagcaatggaaagaaaaaaaaatcatgatgtattctttattgtcattatttttaattttttttaatagagccatatttatgtactacagtttgacttcttcatatttcatttttgtggcttttttttcaatataacattttcttttgaaatagtttaagattgacaagcagttacaaagtggcccaggctatggcatacccttcactcagcttccccaattccatcgttaattttttgtatatgaaaaagtgaatggatcactttcattgtttccaaatcttctgaaaagcacagaaactaacacttgtgcagtacgca

SEQ ID NO: 249472 - DNA, 185 bp, Homo sapiens
tctcaacttactttcaaaggggttttctgactttaagaagttcttttcccctctatcttataacagttgctgagtaactggtttaaaaagaagccaacaatgcaaaagtgaaagtcaattgttagtaaattttaagtcagcctctagttgggaggagggtcagaagaacaatggggaaagaaaaa

SEQ ID NO: 249473 - DNA, 365 bp, Homo sapiens
ttcagagacctgccctgtgctcccaatctaaaaacagccctctccacctctagcatagcacccccatttcatgccctgtaacacttttcacaaggcgcggtggctcacgcctgtaatcccggcactttgggaggccgagatgggcggatcacctgagctcaggagttagagaccagcctggtcaaaatggcaaagccctgtctctactaaaaacacacaaagttgggcatgctggcccacgcctacaattcccagctacttgggaggctgaggcaggagaatcacttgaacctgggaggcagaggttgcggtgagccgagatggctccattgcactccagcctgggtgacaagagtgaaactttt

SEQ ID NO: 249474 - DNA, 461 bp, Homo sapiens
tggtatttcttaggaattccttaggaaattcccatgaattatagatgtatactgtaccgttttgtgagaacctctctctcctacacagagatgtcaagtccttgggtctgaattttctggtttcaatttgaaaagaaaccctaaaatgtgttaacttagagtttaaggatcagtctgagtaaaagaaaagtctaagttgaaggctatataaaatttcaagatcctgagatattagaggtgccgtttcttccgtctcctctcccttgtatcattcccaaaagataaataatccaaaaaggatgaagaaaaatataattgggagtcaaagaataacaacataatgttaaaccagagacctttgttcacgtgtttatctgctgaccttctctccactattatcctatgtccctgccacatccccctctctgagaaacacccaagaatgatcaataaatactaaa

SEQ ID NO: 249475 - DNA, 401 bp, Homo sapiens
aatggttttctttcacaacaggtggactttttttggcttgtttctacctctcaaattagggtcttcatgtggatgccacctaatctatagaccaaagcattgcttaatgcttaaacattttttctccgtttttcattatcaataagggcagtaggtcaaacatttttgtcatttacctaggtcctgggttgtgctgataatattgcttatggcacagattttgaaaaagagcagcaaattttagtgcagcagaaaaacatacgaaagtgttggaacaggttgggcgcggtggctcatgcctgtaatcccaggactttgggaggctgaggtgggtggatcacttgaggtcaggggttcaagaccagcctggccaatgtggtaaaaccccgtctctactaaaa

SEQ ID NO: 249476 - DNA, 1073 bp, Homo sapiens
gcctcttgacgggggagcggggttgccaggtggcaagtcggctggacgaggcgctccaaggatcggcgttgagggaccagctccgcaggcggtgccaagaggagggggatctgctaccagggctgctgggcctggtcgggggcgtggcgggttcagccagctgtggactagggctcggaggggctggggccttgtggagccaatactggaccctgctgtgggcagcctgtgctcagagtctggacctaaatctgggaccctggagggaccccagggcaacagcgcaacagctgagtcaggcactgggtcagggtgagtgatgggcttgggtgggcgtttgggaaggctggggtctcttccttccccttggccaactcactgacctgccatcctgaaggcaaaagcaggccctttagaaagaacacccctgggttcagactatagcttctgagctttcaaggcaaagtcttgctttccaccccagtcccgagtcttggaggaagcatgccttcttgcctcatcattgagtgggcaggggttgtggaaagtgagaccttgttttcaggccccagagtcatttctcccactagcatccctgcctcaggagtgtgagaaggagctggcatctttgtgtcacagactacttcatcagtcgcttatctggagctgggaccaaggtttctgccaggccttgggatcagctcttgggggtcagagcagccttcccacatcctctggcactgctgaacttttgcagcagctctttcctcctctcttggatgcccttcgagagcccaggttacgacggattttctgccagcctgcaggtgagacgaggggctggggctggggacacagagcagttgaggatatctcttttctttcactctgttctgaaatctgcctcttcccaaaggtactccatgacccctaagatactcactctgctgctcaaatccccagatcctgcgcctgtcgccctaggtctctgtacccttcagaccaccttgctctggttcctgggcagagctcagcagtacttggcagcatgggacccagcttccttcctgctc

SEQ ID NO: 249477 - DNA, 386 bp, Homo sapiens
ataaaacttttaccctgcctaaaagacggacttttttttagttggctctttatttatctattttgaataagcatctcaccctatcacccaggctagagtgcagtggcacgatcatgactcactgcagcctcgacctcctgggctcatgcaatcctcctgcctcagcctcccatgtatctaggactacaggtgcacaccaccacaccttgctaagttttttttttttttttaatttttgtagagccaggccaacatggtgaaactccatctctactaaaaatacaaaaattagctgggtatggtggtgcatgcctgtagtcccagccgcttagaaggctgaggcaggagaatggcttgaacctaggaggcggaggttgcagtgagcc

SEQ ID NO: 249478 - DNA, 399 bp, Homo sapiens
ctcctatccagcttctccatcatcttcctccacctgattcgtagagacctctggacatctgagcctaagcagggccactaaatgagagagaatcccatcactgaaaagcaacaatgaatatattaaggaccacaggagagatagaagaaatattgcaactgaagctgctagatggttatgattatctgaataggtgtgatcttgactttagcgaattaacagtcatgtaggtgaaattatcttggactctccagacaagaccagccaccagctgaataccagtgggtgaccccagtcaatcacatggaacagaagaatcactcagctgagccctgccagaattcttgatccacaaaatcctgaagtgcaattaaatgatggttgttttaagcccctaaa

SEQ ID NO: 249479 - DNA, 436 bp, Homo sapiens
gacaaatatctatttagtgtttattgtttgtcgtgtactgtcttaggcactggcatacaatggcaaacaaaacagacatggtttctgtctacatgcggcctaagatttaacagagaagacagatattattaattcataatttagtttgataagtgctatgtaagcacagcacaaaatattggagtgtaaaatacagagccctaatgtacttagatcagtgctgtccaacagaactttctgtgatgacagaaatgttctgtattctgtgctgtccaatatggtagccacatgttcatttatgtaaaatgtgggtagtgtgactgatgattgatttttatttacttatttttattttcaatcccttcgtcaatttgaatgattttaaattttaaatttaatttaaaattaatttaaataaaattataaaataaaaaaa

SEQ ID NO: 249480 - DNA, 1090 bp, Homo sapiens
cagaaatgattataaatttgcactactcttgttccatcctctccagatacctggttgtggtcagtgtctgtggtcaaggcaatgcgaggcacatccagcatccctgagcaagatgtgctcaaacacatgtacgctacaatgttcccataacatctgcctccatagcatcagcaactgacctaaatgcctgccttaatgggcagggcttttttgcatgctagatgtccaggatgcttgctgtccctacttgtaatttaccattgcagttgttatttacattattttccaagtaaccaattcatagaacagccagacaagagctgagtcatcttggaagagagcccaaaaatctcccctgcacagcaagctttacaaaaagatcatcctttgtggaatgcaaacaaaatggcctccacaatttattaatgttcccaagagctgtgattatgaatccagacattttaacaatgttgaatctaattatgccaggtgaacagagtatctatcacaagttactccaaaccatccagaggtacaatgtaagcctcttgtttttacaggttcttctgtcaaacctaactgagagcattttgtcttttgagctagactaaggttaaacaagatttacactgaaggcagccacagcaatcaatgactgatgcttagactaagccaggatgcatatgtttcagagtcatcacattctccaattttaagaagaataaaatattggcatattcccaattcaacatatttaattcaactgctgtttgttttcaaaggaaatttaaaacaatagcaaagaaggaattcaccaatactaattctataacactaaaaaaaatttcttttgtttttaattatactttaatttctggggtatatgtgcagaacgtgcaggtttgttacataggtatacatgtgccatggtggtttgctgcacccatcaacacgtcaccctacattaggtatttctcccaatgctatccctctcctagtccccccaccccgacaggccctggtgtgtgatgttcccctcactgtgtccatgtgttgtcattgttcaactcccacttatgagtgagaacat

SEQ ID NO: 249481 - DNA, 284 bp, Homo sapiens
acccttccagtgtttcatcttcattgctaatgatttcacaggtgatgaaatttaaattcattgaactctgttctgggcattgagaagacagaaatatgtatcagagagtctctaccttccattgtttcacagtgttgtgaaaacagcagacacaaaaccgagtactgtaatgtaaggcagagagaagtggtgctctaatcacagcacaataagggaagtcttaagggaatttttcattttgtcctggagtaacatagcgtagataatattttagcagctgagga

SEQ ID NO: 249482 - DNA, 343 bp, Homo sapiens
actgaaggggggaaaaggaagatactgattttagaaactagcaatgtgccacatgggaaaagacgttcagttgccaacaggacaaaggcccagccgccttccagcatgagctccccaccctcctctacagagcctctgggatgtgcctatctgccccactccctttccccaagacacattctgcctttcccccctgcatgcttttgcttctttcaaagaacagaaacataatattttgccaagactttgcgtgcaccttatctatatgagttacattgtaaatagcattctattcaactttcaaaccatccccatgaggtagaaatctctattttacaaatta

SEQ ID NO: 249483 - DNA, 353 bp, Homo sapiens
atgacgagctactcttcaaaattaagctggataacaacaagaaattctagaaagcaattgaggcaacctccaccctaagacccaggtaaaccctacatttaaagtgctgttctggggcacagtgaaagatttctgccagaaaatttgctccctaggatttacatgatgatgagattacatgctgccttgtggcaacaaaatcaaaagtctgtaaaagaaaaagcgtgctatgcttctgaatgtttggagatcctacaatagatttttcattcagctattttgttgctgcttcatgagcacacctgacagtcttgtgggataatagaaataaacttctcataaacaacggtcaa

SEQ ID NO: 249484 - DNA, 296 bp, Homo sapiens
gtcctgcttttatactcgttttcctctcggaatggtagccggcaaaaggtgttcttagagatggggggtcctgtgtcttactaattcccataaagggaaggggagtggcagaagaagaaaaaaagtaggaaaagaaaatgttagttatgtgtggttgatagtggctcagtgggtttacatattatgatagttatcaatttcttagcgctagatgctgcaaatctaaatctatgtaagactcaagaagtggttgtgtgtcttgcatgtgaactgtatctcacagctaaaatttaaaa

SEQ ID NO: 249485 - DNA, 424 bp, Homo sapiens
cgaggggctcccgggggctcaggcttccttccgcagcagccacccttgctggggctgcttcctcccagaaggtcacggctctgcggtgtcttgttggtcatctgtcctgtgtccagcactgacactgctgcagctgtgagccttccccagggctcggccagttgaacccaggaggaggcagatccatccagctgctcagaggcccagggtggcctctttgggaaggagctgctctgtgcagagctgggcctctgaagatctgggatcctccaggcctggggtaatgaaagcccttcattgatggccaaaccttccctccaccagggcaatatgtcccacacatcactgtcccttccttgtcaccttcctccctggagctgacccagttatgggcttgaaaatattaatctacttctttgggtga

SEQ ID NO: 249486 - DNA, 424 bp, Homo sapiens
ctttaggatcctgcctcagaaaaaggcctggtgttatctgtcctgaaactcaatgaaaatgaattgatgagcagacaatagctagtgtgcccagctgattgatctatgcagccccgaacatccccaagctgtttggcagcaagtcgtttttcttctgtcctttccttattaattcaggctatgataaatggccttgctgacagcccactacaatgaaaataaaatccttgtcagggagtcttccgtcttcctagaagctaagaaaaacttgtccagtttttcttgcagtggaattttctcacacaatcatagtggtgatgtgtgagtgtgacagtgtatgtgtatatcctgctgaacgctatgaggtcacttcaaggcaaaaagcacaaaagttaattaaaaatagacctcttgcaaacagaag

SEQ ID NO: 249487 - DNA, 411 bp, Homo sapiens
ccatgttgcccacagcgccagtctcaaactcctgagctcaagctatctgcccacctcagcctcccaaggtgctgggattacaggtgtgaggcactgcgcctagccaaacacataaaatatctttccatttttactaccgaattcacattcaggcagcttctcctgatatcagcgatgctctttgaccccaagtcaaggacttccggaagccgaatttgctacctcagacttccaatgtactatgtgaagtataaaatgattacaacacggagatgacatcctgtttcacttgtaagaattggtagtttgggctcagagaaagctcaatcaatattgccacaactgcatgtatgaaaatatatcccaccaattcaattaagtgattaatcaataatgcacataagtttaaaa

SEQ ID NO: 249488 - DNA, 320 bp, Homo sapiens
gtatgtggtggctcacatctgtagtctcaccccttgggagaccaaggtgggaggactgcaccttggtcttccaagtgatgggattacaggcgtgagccactactgagctcaggaattcgagatcagcctgggcaacacagtgaaaccctgtgtctacaaaaaacaaaaaaattaaccgggtgtggtggcacatgccagtggtcccagctactcaggagctgaggtgaggggactgcttgagccagggaaggcaaggctgcagtgagacatgatcataccactgcactctagcctggacgacaaagtgagatcctgtctcg

SEQ ID NO: 249489 - DNA, 889 bp, Homo sapiens
gtggagctcaatagttttcaaagcctcaggtgattctactgtgctgctcagacctaggaccacctgcagaaattccatcctggtcctgcgacctcgcaccgattcctgacggagcacccactcctaggaggcggttatccagcatttgaggaagctgccttccataccatctcttcccactgcagaggagttttctcaggagttccctcccacggcaggttttgcagtgttcccaaaacccaggtcgatcctcctaacaaggtgcaggactttctttttaaaaaaccttagtgggaagcacaggctctccagcccccttcccaatgctgccatatctcagtaccagatctggaaaccaggcctggttcaagccctgtgtcatatctaaccgtactaccaaccagcgttgcagtgtacttcttttgttcattcattcagtcaatctacatgagcaaccctatgttagaacttgggaaactaaacgagaaagcctcttgccttcaaagacttttctttctgatcaaactgataaatcatcattattggacagtgtgagctagttacttaacctagttaataatgattaggcttgtttactgatatggtttggctgtgtccccacccaaatctcatcttgaattcccatgtgttgtgggagggacctggtgggaggtaattgaatcatgggggcaggtctttcctgtgctgttctcatggtagtggataagtctcaaaagatctgatggttttaaaaagaggagttcccctccacaagctctctctcactttctgcctgctaccatccatgtaagacatgacttgccccttcatgtcttctgccctagccatgtggaaatgtaggtccattaaacgtttttcctgtataatt

SEQ ID NO: 249490 - DNA, 251 bp, Homo sapiens
tgaggtgggagaatcacctgagccagggaagtcaaggctgcagtgagccgttattgcccctaccgcactctagcctggacaacagagggagaccctgctttagtccatcaatcagcaatcagccaatcatcagttttcacctccctttggttgtattagggtttctggctcatttttctctcatgaaactctgttgaattcctgtatagacctttctccatcctacttgcctatcaaagcacattttcata

SEQ ID NO: 249491 - DNA, 402 bp, Homo sapiens
aaactcccgttttccctagaggcaggaaagcagcgtagcttcagggactcgggtttttttgcgtgaaacgcacaagaaaagagaagaaacctggcgcggagactcacatccgcaatcccaacacttaggtgttggtggcaggatcttttgagcccaggagttcgagaccagactgggcaacatagttagactgtctctacaaaaacttttaaaaaatcagccaggcatagtggcgctcgtctgtagtcccagctactcaggaggctgaagtaggaggatggcttgagcccgggaggtcgaggctgcaacgagccatggtcaggccactgcactccagcctgggcgacagagtgagaccctggctctaaaaataaacgaagaagaaggagggagagggggagg

SEQ ID NO: 249492 - DNA, 696 bp, Homo sapiens
cggcttccacccttcacctacttcccctgcggggccggagtgggggagggtcgggggaggccatcgggaagccacgtggtggcccggggcctcgcggctcattctgcgttgcgccgtcccttccaggtcgagttgacggccttttcccccttggcgtacaagtattgagtcccgcgccctgggagggagacggcgctcagcaaatttagatgaatgcaacgcttcaacgtgggctctcgacctctggtcccccatcccctgccggctctattaggacaatgaagtccccaaactccactggagggttcttcacccactcttcttcccctccaaaggaaccatctcttgaacttcacgaaatccaggagcaatgctaagcgttttgtatacatcacctcattttcaatcctgtgaggtgggagctgggaacttcattttaacaggaataaaatgtggcctacagctggttggggtggagccaggacttgaagtccagttgtgcttattaacttcaagtgtctgcctttttataatgctcaagttcgtcctctcagctgcctcttggctagcccagcatccccctttgctgtccaaacacccacaccagccaggacacactgtctggaacatggtctgacaaggggattaaaaacttgaaatcaaggttgtccaaaaaatctggggcatacggtttat

SEQ ID NO: 249493 - DNA, 575 bp, Homo sapiens
taagacaacgcagctccaaaggcagttcaaatgtcctaggaagaacacccccacaaaaaacaagctttatcattatgccattatcaagttccccttgaccactaagtcagccatgaagaagacacaaccacatttgtgtttactatggatgtcaaggccaaccagatcaaacaggctgtgaagaagctctatgacactggcatggccaaggtaaacatactcatcaggtctgatggagagaagaaggtgtatgttcaactggctcgtaacttaacgatgttttgaatgctgccaacacaattgagatgatctaaaatgagtccagctggctaattataatttttttttaccatattaaaaaaaaatctacaaaactgcagttcttaaatgaggtaacaggtaagtaaaaggacttggcatatagaaggttccaaaaccaccaggtaagaagtccaactaccttgttaccaccatgcttagatgaagtcatccacatgggaggactacccagcaagaagtaccgaaaccaagtatcaggaagagggagagatccatgtaggggagagtatggtagc

SEQ ID NO: 249494 - DNA, 595 bp, Homo sapiens
agacttcactcgaaaaccgtgtatacattgcctcgagggaaagctctgggagttttaatcgcccagcaagaacctgtttctgcagcagccaccagctcccatcaccccttgaccctccagctcatgctggagaagagggaattttggctgtttaaagaacacagttgtgaatctcagaatgtgcctgaaaggaatactgacagataaggccggaaacaaaactgatggcttgaaaaacatttttatggaatgtatttactatcattttgttttactatagaggtagatgggactcttaacttttgggtacatggaaacatgctgaaaactgaacacaatcctgatcatcactcctgcctggctgtctcctgggaggctgccgggtgccacggagctgggacacagcagagcccgctaggtgttgcagggccctggaggccaaggccaccctgtgtggggtccctgttggcagccaggtccctacacaaacaagtaatcctgtttggcctcctaggttttgcatatgacctgcagcctaatttggggtgtaggggaagctctgctggcccctgctcctttgtatgttgggtgactt

SEQ ID NO: 249495 - DNA, 1149 bp, Homo sapiens
agcgggaggcgccattttgtagcgagggagggaggctggtccttgtgattacccgggagggagccggggtgacgagcgccattttccccacaggggcgaggaggcggctttggttctcccggtgggcttgccggagtgcgttctgcagaccagaagggctttgtctggcgattgctgaatgctcaatagcagcctgctgggagggaagtcgaagggagaaataggacagaaagagagacctgacctctccctggaggctctcagtgtcggccgaggcccttggtcttgctctagggctctgcattcccgagagctgctgtatgccggggattggcttccaagcctgcctgagcttctccagtctcccgggcatcgccatgcggtgggagggtgagccttcctctcctgctgaaattccggcggcttggcaaccggccggggggtcttggattcctcggggagacaccactgatgctttgtggtttcacgtaatttggatttaaaagttgaaggcgtcagaaatggttgtcgctacggtcttttgtatgttcttgtgttgcgaactaataaaggaaagtcaaaagggtgggagaagcattcagtctggttccctaaagttactaagaatggatacaaattagttgtggccgttgcggttaatgcttcttgtagctcttaacccagccctttctaaacctttggatatacttactagtcagttccgaaggtactcagtacaaatttgcgttggcgcaccaggccgactaaagatgaggtgggtgtattagactcaaaatttcttaagtcggccagggggtagaattgagctaccaagagaatgagagactaccctgttgtaacagatttggatcgcgcttagaaaaacagggagaaagctggatgatgttcaacttaatgtcttgcatttcagacgattatcgaatggacggggataaataaaaacgatgttacagatagccctctaagtgtggatagtaaatattttgatttacaattaagcctaccttgaggtgcaggccctaaccaacggatagttgagtaataggggcctagacgccaatggaaagaaaatgggactttaagctttgtttgaacatatattctgttaataaagaagtttaaatcagt

SEQ ID NO: 249496 - DNA, 1095 bp, Homo sapiens
agcgggaggcgccattttgtagcgagggagggaggctggtccttgtgattacccgggagggagccggggtgacgagcgccattttccccacaggggcgaggaggcggctttggttctcccggtgggcttgccggagtgcgttctgcagaccagaagggctttgtctggcgattgctgaatgctcaatagcagcctgctgggagggaagtcgaagggagaaataggacagaaagagagacctgacctctccctggaggctctcagtgtcggccgaggcccttggtcttgctctagggctctgcattcccgagagctgctgtatgccggggattggcttccaagcctgcctgagcttctccagtctcccgggcatcgccatgcggtgggagggtgagccttcctctcctgctgaaattccggcggcttggcaaccggccggggggtcttggattcctcggggagacaccactgatgctttgtggtttcacgtaatttggatttaaaagttgaaggcgtcagaaatggttgtcgctacggtcttttgtatgttcttgtgttgcgaactaataaaggaaagtcaaaattagttgtggccgttgcggttaatgcttcttgtagctcttaacccagccctttctaaacctttggatatacttactagtcagttccgaaggtactcagtacaaatttgcgttggcgcaccaggccgactaaagatgaggtgggtgtattagactcaaaatttcttaagtcggccagggggtagaattgagctaccaagagaatgagagactaccctgttgtaacagatttggatcgcgcttagaaaaacagggagaaagctggatgatgttcaacttaatgtcttgcatttcagacgattatcgaatggacggggataaataaaaacgatgttacagatagccctctaagtgtggatagtaaatattttgatttacaattaagcctaccttgaggtgcaggccctaaccaacggatagttgagtaataggggcctagacgccaatggaaagaaaatgggactttaagctttgtttgaacatatattctgttaataaagaagtttaaatcagt

SEQ ID NO: 249497 - DNA, 646 bp, Homo sapiens
agaagtgatttagtttccttcctaaggtgcactttgttacaaaactagccaaacttccttgcattttgaggtgcagaaaaatgttggaagttctagaattcttatgagggtcatgtgaataatgtgaatatatgaatacaaaggctaacaggatggactgattgcaaggcatgctaacactgagactaggagtagccacatggcccaggggccctgaaatgggaactatgtgcctgaaatagttgaccattgtcagaacccagaaattctctggcctgtgcctactttgtagcttgtcttccatgtcatttcaccttacaacacaaaaacttcagttctgaagttgatgaaagggaaatagaagtggaacgccaggaaaaagatctgtaaaaagtaaaaggtgggtgtaaagtcagaacggttaaaattctatgcagggcttcataacattaagaccaagatgagggctcacaatgtttattccacctagtcctgttgcttttcacttctgccagccttactttaaaaaaagttactaaaagttctgttattcaagtaatacatgaatattgtctctttcaatttattttttttttcttttttttccttttcttttttccattttttcttttttatttttaatatt

SEQ ID NO: 249498 - DNA, 428 bp, Homo sapiens
gcagcacggggctcatgtgcttgtctctctgtgcccactcgatgccatggagaaggtcagttgcagcaagggtgcgacccagctgggcaccttcctggccatggagcagctgctgcagcaggcagggtctgagtgcaccgtggatgtctttaacgtggccctgcagcagtctcaggcctgtgaccttatgaccccaacgctgaagcagtatatctacctctacaattgtctgaacagcgcactggcagacgggctgcccctgagtcggcactggtcactgtgcaggagaggtttgtgccctgtgggatggggacagcattcctgacacatccacgtgggcctgggctccccagaagggcggcctccactgggccctgtgctgcaaaggtaaagggtcttggaataaagacctgtggccaagcgtgaag

SEQ ID NO: 249499 - DNA, 666 bp, Homo sapiens
gcagcacggggctcatgtgcttgtctctctgtgcccactcgatgccatggagaaggtcagttgcagcaagggtgcgacccagctgggcaccttcctggccatggagcagctgctgcagcaggcagggtctgagtgcaccgtggatgtctttaacgtggccctgcagcagtctcaggcctgtgaccttatgaccccaacgctggtgagaggcgatggggctggggtgggggcgtgggggctcagctgtgggaaggggtgggaggtgagggagcttctgcccaggcctctaggcagcaccacccgggtagccaccaggtggcgctgtggacctctgtgcattctcccagatggagccctaggggttgggacacacaagggagcccttttctgttagattggggcaggcggggcgagcctcctaaccctatgtccatctccagaagcagtatatctacctctacaattgtctgaacagcgcactggcagacgggctgcccctgagtcggcactggtcactgtgcaggagaggtttgtgccctgtgggatggggacagcattcctgacacatccacgtgggcctgggctccccagaagggcggcctccactgggccctgtgctgcaaaggtaaagggtcttggaataaagacctgtggccaagcgtgaag

SEQ ID NO: 249500 - DNA, 643 bp, Homo sapiens
gttcggtgtcccttctcagtccctgcacccaggttggatttttgcagatccccggacacccccgccacatccccggacacccctgccacaccccctttaggtacctcatccaactctaggtcagttgcagcaagggtgcgacccagctgggcaccttcctggccatggagcagctgctgcagcaggcagggtctgagtgcaccgtggatgtctttaacgtggccctgcagcagtctcaggcctgtgaccttatgaccccaacgctggtgagaggcgatggggctggggtgggggcgtgggggctcagctgtgggaaggggtgggaggtgagggagcttctgcccaggcctctaggcagcaccacccgggtagccaccaggtggcgctgtggacctctgtgcattctcccagatggagccctaggggttgggacacacaagggagcccttttctgttagattggggcaggcggggcgagcctcctaaccctatgtccatctccagaagcagtatatctacctctacaattgtctgaacagcgcactggcagacgggctgcccctgagtcggcactggtcactgtgcaggagaggtttgtgccctgtgggatggggacagcattcctgacacatccacgtgggcc

SEQ ID NO: 249501 - DNA, 1181 bp, Homo sapiens
ctgggcaacacagggagaccctatctctacagaaaaatgtttaaaaattagccaggtgtggtggcacatgcctgcggtcccagctactcaggaggactgaagtaggagcattgcttgaccccaggaggtcgaggctgcagtgagccgcgctcatgccacagctctccagcctgggcgacagggcaagacctgtctcaacaacaacaacaaaagtatccgttaagaattttttctgcaatcataaaatcataaaataaccagtatcaaagattttaaactgtaatttctatgatattcataaatataaaataaatattgttcaataaatatttattctaaagcactatgaaaagaactgtgggaaaagtaaaagatgagtcaaacgtgtacctcattcttataaaggacttactgtctggtaggtaataaactatgtaagccatgtacagcacaagttaaggcatgctaaattgcagaagacaggtgtagataatgtacttagggaggcaaaaagagagaagttgtttttacataggaaatttgtgtttatccttatggaagaaggatcatttaagcttgaccttgaagaatgtataggatttggtaaatggatacaaaagaattaggggagaagtaatacacagaaatggaaaagtattgtaatgattcataaaaaggcagggcttcttgttgtctacactgcctcgggtataaagtgaagaagcaagataatgagggataaagctgaaaaggtaagtaggaaaccttatggagagctttgaatactattaaggattgatatgtgcccctcccaaaatttgtgttgaagtcttaacccccaccacctcaaaatgtgaccttatttggaaatgaggttgttgcaagtgtaattagttgagatcatatttcaatagggtgggctctaatacagtattactggtgttctgataaaaggggaaaatttgaacacagactcaaggagaatgccatgtgaagataaaggcagagtttaagattatgtttctatatgccaagaaatgacagagattgccagaaaactaccagaagttaggggagaggcattgaatacatttttcctcattcctcagaagaccaaccctgtcaataccttatctcagacttttgcctccagaactgtgagacaataaaattctattgtt

SEQ ID NO: 249502 - DNA, 268 bp, Homo sapiens
gatccacctgcctcgacctcaccatcctagactttaaaccttgaaattttctagagctgcctcccagtgactttaacttactgtgtggacctgccttgctgccctcacttcttcatcttctcaccccgtcctcaccacttccttgtcttcttttggactggcttgtgtttacaacattggattagcagttgtaaggtcagcaatgaattcccaaatagcattcagcacctattttcagcctttcgaatttttcttgatgaactactgc

SEQ ID NO: 249503 - DNA, 376 bp, Homo sapiens
gacaaaaacacaatctgcattttagtttaagtatgacactgatgacttaaaaaaaaactatatacaaacgttctatataaagtttgcctccaaagtatttctctttctctttcttttttgcaggggagatggggtctcattctgttgcccaggctggagtgcagaggcacaatcatattatactacaacctcaaactcctaggctcaggataaaacaagatttattttattctgacctggaaatgagaaaaaatatgccacctactattaatccatatgatataaatgaagaaacaaatggtgaaagggagaaagctcttctttacaggagtatgtgatctaataaataagaataaagtttttttaaaaatcacta

SEQ ID NO: 249504 - DNA, 544 bp, Homo sapiens
gggaaaagtggttggtggggatctgaattaactaaccgtgtttgagaaaataattgaggcaataaaacgatcaataggaaatcaggccactctccagtacctcacggtttctcaaaggaatatttttaaagaagagcattttattgacttgtctcgtttttaatgcactaagaaatgcagctaaggtgcctggtcactgtagaaaggggtacatgcaaagacctatgctaaccgtagagccagcaaatgactgataaaaaggaacttggccatatacctctctctactcaatatagccctgcaggtatatcaaaaaacaacagaaacattgttccagatcataaaaataattatgttgctttagaaaatttggaaaacctgagagaatacaaggaaaataaaaatcacgttaaaccaccatccagatagaccactgttaaaatattgctgtatgttttcagttttttgtgtgaaaataatatacatttatattttattgtatatacactactaaatacaatattttgatctttttgtaaaaaaa

SEQ ID NO: 249505 - DNA, 256 bp, Homo sapiens
ataggtatttaaattgtcttaacagcttagtggtcatttgaaaaaatcatatgtcaagttgaaagaagaaataatattttttgctaggagtggtagcacacacctgtggtcccagctcctcaggagactgaggtaggagaatctcctgaaaccacgagtttgaggctgcagttagctatggtcacacctgtgaatagagccactccactccagcctggacaacatagtgagaccatgtctctattaaaaaaaaaaa

SEQ ID NO: 249506 - DNA, 421 bp, Homo sapiens
cttacaggtgagactcatcttagacccagtcaacctgagctgagaaagacaaagaataggaatagcggaagaaatttacatggctaaagaggaccaacgatgaaattacttttaaaagaacagagaatgctgggagcagtggctcacacctgtaatcccagcactttgggaggccaaggcggacggatcacgagtcaagaggttcctaataatgctggacaacttccagtttggaaatgaccaactccccgggtgttgtctaatcacattgtccaaatgctacgacaacaacttcttgagaaacatccacaaactcaggtgatcttacgcctgagtgaagaatataattgttactctaaaatgtatttggcgtattgaaattatatggtactgcaaaataaagcattctcagaatgatatt

SEQ ID NO: 249507 - DNA, 643 bp, Homo sapiens
atggggagtgggcagtgagatgcttttagcagactgggatgcgcctgggtgtacatttgaggaagatcaccgcagctatgggcacagaatagttgtgggagatgcttctcccttcctcatccctcttacactcaagaaagagaagaaagtgggctggcttaggaaagttgccctggggaggggaccatgcgggcagattcaggaaccaattaggagggaatagactgagtgggagaagaggaaagttggtgacgactctcaggttacagggtcagcttgggggatagggaagacggagacttcgtggttcagatatcttgagtctcaggggctcaggggacagccagctggaggtttgtgctcattcattcacgcattgattcatcaagcgaacaatttgttaattcactttccattcattcagtaaatattaatgacctactaggtggggcttaaggcggggctggaaatgggcctgggagagcaattatggtccagctctactgaggccttgaatgtcagaacaaggaatttgggctttggcctcatgcaagagagggcggctgccatatatgggcctgggcagggacagatctgacagggatctagccctggccaccaggcatctaggagctcttgttct

SEQ ID NO: 249508 - DNA, 482 bp, Homo sapiens
atgtgcatgttagacagttgaggctataaaataaggacatgtcagaagtagcagttctatgtccttcccttagaatttcatgaggtgtagggtacccttccccaccccagggcgcatcactgaagtgtagtggtggcagccatggcctgagggcaggtcagcacagaaaaacaccaactccacagagagagtctggcgggagcaggtgcatgggcatctggtgacctgagttcctccaacagaacaagccatggggcctctttgtgcctctgtttattctttccccaagtggggtcacttcagacatttggagatatgaggcaacaaggagatgggaaagttcaccaacaatgtaaacactctacatgagagagttttgttgccaatgtgctagaagaggcatgcttcagggaagaggtgagaatccttccttcccaagtgtaaagccaaagccactctctaataaacgttttgcatgatga

SEQ ID NO: 249509 - DNA, 478 bp, Homo sapiens
gagaatttttagagtgtataaattttactattcaaattcttcattatttctgagaaaaaaatattgagacatggtattagatgtctttttactactttcttacattataattataggacaatcacacttgggtatggggagcacttgcatatctactttatatctcagtgcagttttatctaaaagttccgttatagctaaatggctacatctcctctgagggaaaataaaactaatgtgttatctaataagctaaaagccatggagtgcataaaataaattttgtacatactgtttttaaagaaactttttaaaaaagttaaatggtttgaattttggtttaagattttaagagtacctaccctctcaggcataaagtgatcatcctttttgtcttataaagcacaagtatattttagacacttcataaataatatcattaaatgtttttctcatggagaaaaatgaagacttaaac

SEQ ID NO: 249510 - DNA, 279 bp, Homo sapiens
gcactggagataaaatagaccacaatgacactgtccctggcttcaagaagttcatggtcaactgagactgacaaactagcattctaccgtaatgtaattcatggttgtaattgccacagagtactaggaaagcatatcaacaaagacactaaactcaactgggctgtggggaagtgccgagttcagaccaggcctttctgaagtattgaggctgttgtggtacttgagctgagtcataaggggccaggaagcattagcctggcagatgcagaagaaaaa

SEQ ID NO: 249511 - DNA, 349 bp, Homo sapiens
agcacttgggatttcctgtcgagaagggggactgagaagtagaactaactggatttcctaggtcgactaagaatccctaagcctagctgtgaaggtgaccgcatccacctttaaacacagggcttgcaacttagctcacacccaaccattcaagtagaaaagagagctcactaaaatgataattaggtaaaaacaggaggtaaagaaatagccaatcatctatcacctaagaacacagtgggagggacaatgatgggatatgcacccaggcattggagccagcaatggatcccctccttttgtatgggagctctgtattcacgctattataaagtcttacatctgcaca

SEQ ID NO: 249512 - DNA, 583 bp, Homo sapiens
ctttgttatagctatgtactgtttgagttttctgtagtttatgcttgctaaaatttggattacatttgaataaggataaagggcatcatacctattcattcctcttagatttctaagctgtatttcagtaaattgattctcaaagagtggtataactggatcataatatccttgtttgccactcaagaaagtgttccataacttaagataacagtggtgggaaaaatcatttaagaccttgtttcatatgctttaagatacaagaaatagagataacactgggaacatatgaaactttgtcagcatcagataatagtgttgtagcgacttgaaacattttttgtctgtgattgtgccagtcactatttgtgacttggattgaaccttgatatgactttaaattcaggttgatgttttaaaattatttctgaaatatattgagcttattgccctaaattaaaactatattctgtaattttacatgagttatgtaagttttctgaagaaataaggaggaatcctttaggcacagactgtcaatctacagattacataggagatggcacaaatggaaaaaaaaaaa

SEQ ID NO: 249513 - DNA, 416 bp, Homo sapiens
agttatttgtaagaaagaaaaattatgaaaaatgaagtgtgtgtaagtcatagctgaagacctcaaaattgtgctaagatcctcaacaggaaagagcattaagactcttattagactccttggctaggcttgatggctcatgcctataatcccagcactttgggaggctaaagcaggagtatcacttaaggacaggagttcgagaccagcctgggcaacatactgagaccctgtttctacaaaaaaatttttttaaattagtcaggcatggtggcgagtgcctgtagtcctagctactcaggaagctgaggtgggaggattgcttgtgcccaggagtttgaggtggcagtgagccttgatgaaggaactgtactccagcctgggcaaaagagcaagactccgtctcttaaaaaaaa

SEQ ID NO: 249514 - DNA, 757 bp, Homo sapiens
ctggaaataattgtggttgaggctgtagctggcaccctagctgagctcaaatcctgaagttaagagttgctgcattgggcccttgcttgatttttattagaaaagaataaatcattctgcaatttactgctacaaaaagagaaactctccttactgtagtggaacatattacatattataaaaaccaagtttagataccaattaagcaaataaatatttagtgagcatttatcctttaccaatgactctttttgtgaagacacaaagatgaacaagctctgatccctgactctgagaagttcagttctgagaagtctatttcccatgtccccacacctcatctgtacgtgaagataagccagatggtcttgaagggctcacctcatcccaaaaaccagtggttccacacccagatcacaggaggtgagctacctgcccaactagcgacatggaatcttcagcttactcaattattgaaataattgagtaacaataaatagcctttgtcttttgcaggtggaaatcaaagaatttcacagaaatcagtaattgtcagaaacatcgataattttacttttgtaccctttaattattttgcacacaaaatatgtgtaggttaaccaagcaattaaataaaacacacatactgatttgaatttttataccagaagcacttcatatgtaacaatgcgtatatctggtaataaggaaaggtaatttctatgaatacgggctcagtaaatgtttgcagaatgat

SEQ ID NO: 249515 - DNA, 750 bp, Homo sapiens
agctggacagtcaataggctggagtgatctgggactaggtgagatgagaatgcaaatgtgatcatttcatcctgcaatgtggaagtcactgaagaaaatcagcaagcgtagatatggaaatgtgaaggggatgggaagctggatcagagagcatcaactcagctctgggaaaaagatgaagaatcgagtcctgccttggagtggctcatcacagtctagatggggagaccaaatgagactctttttgtgaagacacaaagatgaacaagctctgatccctgactctgagaagttcagttctgagaagtctatttcccatgtccccacacctcatctgtacgtgaagataagccagatggtcttgaagggctcacctcatcccaaaaaccagtggttccacacccagatcacaggaggtgagctacctgcccaactagcgacatggaatcttcagcttactcaattattgaaataattgagtaacaataaatagcctttgtcttttgcaggtggaaatcaaagaatttcacagaaatcagtaattgtcagaaacatcgataattttacttttgtaccctttaattattttgcacacaaaatatgtgtaggttaaccaagcaattaaataaaacacacatactgatttgaatttttataccagaagcacttcatatgtaacaatgcgtatatctggtaataaggaaaggtaatttctatgaatacgggctcagtaaatgtttgcagaatgat

SEQ ID NO: 249516 - DNA, 689 bp, Homo sapiens
agctggttgtcactgtgctaagccaaggagggagagacaagtctggactcaggagagaggtccaagctgcaggactctttttgtgaagacacaaagatgaacaagctctgatccctgactctgagaagttcagttctgagaagtctatttcccatgtccccacacctcatctgtacgtgaagataagccagatggtcttgaagggctcacctcatcccaaaaaccagtggttccacacccagatcacaggagagactacatctctaggaatcatcacaccaggcaacagattacaggtgagtattttagatattttgttgatacttgtgtgctgttttaaaatcacatttggtctctggtaggacacagggcagagatgccctgtcattatgtcgcctgttttgaaataaggagagtaggtggctttcatcttcagaaaatttgcttaacaatcagaacctctaaaattgcatgccaagtttatttgtgcatatgtatttttttgttaagaaaataatccctagctttcataaaatacacaaagagattgtgattctctccaaattaaaattacttgtatagaaagcctatagcaattagatagtttacaaagtttttcactcatggctcaaggacttgtattcatttctttcttctttctttcatccactcacttagcaaatattgat

SEQ ID NO: 249517 - DNA, 401 bp, Homo sapiens
gataggggctagtcaccagaaggactgaggcaggactaggattgggactttcagccctgctccccaacctccggggagagtcaaggggctgaaggttaagttgattgacagtggccaatgatctaatcaatcatgcctatgtaatgaactttccataaaaactcaaatggactaggttctgagaacttgccaatagacaaatatgggtgacgggggtgcttccaggaaagtaaactagaacgcttccgtgtgccaagaaggtggcacaccccagctccacagggacagaagcttctgctctgggggccctttcagaccttgccctatgtgtctcttcatctgactgttgtgtttgtatcctttaaaatactctttgtaataaactagtaaaagtttggttt

SEQ ID NO: 249518 - DNA, 400 bp, Homo sapiens
ggggggagggatagcattaggagatagatatacctaatgttaaatgacgagttaataggggcagcataccaacatggcagatgtatacatatgtaacaaacctgcacgttgtgcacatgtaccctaaaacttatagttattaaaaaaaaaacgcttagcacagtgcctaggacataggagattcttaattaatgtcagccataataatactaaatattattgttattcaaggtgacatcccctgctcctccaactgacaacttattctttaaatgtctcctactctctttcccatcataatgctcttttatgctctgatggcagtttgtggctgccccagatatgtaagaacataattcatttcattatagttacttttgcttgccatcccccttaccag

SEQ ID NO: 249519 - DNA, 1177 bp, Homo sapiens
gtgtgtatgaataaaatttataaatggacataaccttatacacaagatttaaaataacccctgggcacatgtgggcccaacccagagatagcccttcctgaaatgactggagccaagagcctgtcacgctcgcggtattcagtgcaaggtctgatcgcgtcttctgtcactcaaggcctgagggcgcggagcctggagctctatccattaagggcgctggggtgggaactgtccaatcaggttcacagtcagagaggaaggggtggctcccggtacctggcggggcctttgtctcttgctccagcgagagctcgaggttagctcttcactgccctgtgtcttctttccaagggtctcggtgattcggccacagcctcagcctccatcacgcggtgaactgatggtgctggaagattcatagactccaggacattcctgaagccgagaaaaggttaagtagggtctggcctggaatactctcctagatgaagatagcccaaccatgagccaccttcgaagcagatgagatgaaattaaagctcttcaactcctaaaggcccagagactatcacaaaagaggtcagaaatcctgaaggtcactttctgacaaactcaggaaccccaggtttatcttggagcctcaagaggagataaattcacccaactcaggctggagtgcagtggaatgatcttggctcacttccgtctccgccttccagtttcaagtgattctcctgcctcagcctactgagtagttgggattacaggtgcctgccaccacacccagctaatttttgtatttatagtaaagatggggtttcaccatgttggccaggctggtctcaaactcctgacgtcatgatctgcccgcttcagtctcccaaagtgtgattacagagttttgctcttggtgcccaggctggagtgcattggcacgatctctggctcactgtgacctctgcctcccagattcaagtgattctcctgcctcagcctcctgagtagctgggattacgggcatgtgcccccatgcctggctaattttgaatttttagtagaaacagggtttctccatgttggtcaggctggtcttgaactgccaacctcaggtgatctgcccactttggcctcccaaagtgctgggattacaggcatgagccaccgagcctggcctgat

SEQ ID NO: 249520 - DNA, 949 bp, Homo sapiens
gtgtgtatgaataaaatttataaatggacataaccttatacacaagatttaaaataacccctgggcacatgtgggcccaacccagagatagcccttcctgaaatgactggagccaagagcctgtcacgctcgcggtattcagtgcaaggtctgatcgcgtcttctgtcactcaaggcctgagggcgcggagcctggagctctatccattaagggcgctggggtgggaactgtccaatcaggttcacagtcagagaggaaggggtggctcccggtacctggcggggcctttgtctcttgctccagcgagagctcgaggttagctcttcactgccctgtgtcttctttccaagggtctcggtgattcggccacagcctcagcctccatcacgcggtgaactgatggtgctggaagattcatagactccaggacattcctgaagccgagaaaaggttaagtagggtctggcctggaatactctcctagatgaagatagcccaaccatgagccaccttcgaagcagatgagatgaaattaaagctcttcaactcctaaaggcccagagactatcacaaaagaggtcagaaatcctgaaggtcactttctgacaaactcaggaaccccaggtttatcttggagcctcaagaggagataaattcacccaactcagagttttgctcttggtgcccaggctggagtgcattggcacgatctctggctcactgtgacctctgcctcccagattcaagtgattctcctgcctcagcctcctgagtagctgggattacgggcatgtgcccccatgcctggctaattttgaatttttagtagaaacagggtttctccatgttggtcaggctggtcttgaactgccaacctcaggtgatctgcccactttggcctcccaaagtgctgggattacaggcatgagccaccgagcctggcctgat

SEQ ID NO: 249521 - DNA, 782 bp, Homo sapiens
gtgtgtatgaataaaatttataaatggacataaccttatacacaagatttaaaataacccctgggcacatgtgggcccaacccagagatagcccttcctgaaatgactggagccaagagcctgtcacgctcgcggtattcagtgcaaggtctgatcgcgtcttctgtcactcaaggcctgagggcgcggagcctggagctctatccattaagggcgctggggtgggaactgtccaatcaggttcacagtcagagaggaaggggtggctcccggtacctggcggggcctttgtctcttgctccagcgagagctcgaggttagctcttcactgccctgtgtcttctttccaagggtctcggtgattcggccacagcctcagcctccatcacgcggtgaactgatggtgctggaagattcatagactccaggacattcctgaagccgagaaaaggtgagtgtgcggggcagggcgtttggagacgggggaggcctctttgggacgcgccagaaatggcggtggcgggacggtcttgtgagcctgagtgccccgcagctcagccctcactctcctccggtgcagggaccccggggcgtcctttaccgtttcagcacagcggctttagccccagcctgtagccctctttgcgcagctctgcgcccgcagcccgtcatcttccccaggttgtgaggtcatcagggaaagactccgactggttgtgcgggtctcctgcgtggaaggagctgcggtctgtggggtccccagttcctactttaccctgttc

SEQ ID NO: 249522 - DNA, 1447 bp, Homo sapiens
gtgtgtatgaataaaatttataaatggacataaccttatacacaagatttaaaataacccctgggcacatgtgggcccaacccagagatagcccttcctgaaatgactggagccaagagcctgtcacgctcgcggtattcagtgcaaggtctgatcgcgtcttctgtcactcaaggcctgagggcgcggagcctggagctctatccattaagggcgctggggtgggaactgtccaatcaggttcacagtcagagaggaaggggtggctcccggtacctggcggggcctttgtctcttgctccagcgagagctcgaggttagctcttcactgccctgtgtcttctttccaagggtctcggtgattcggccacagcctcagcctccatcacgcggtgaactgatggtgctggaagattcatagactccaggacattcctgaagccgagaaaaggttaagtagggtctggcctggaatactctcctagatgaagatagcccaaccatgagccaccttcgaagcagatgagatgaaattaaagctcttcaactcctaaaggcccagagactatcacaaaagaggtcagaaatcctgaaggtcactttctgacaaactcaggaaccccaggtttatcttggagcctcaagaggagataaattcacccaactcaggctggagtgcagtggaatgatcttggctcacttccgtctccgccttccagtttcaagtgattctcctgcctcagcctactgagtagttgggattacaggtgcctgccaccacacccagctaatttttgtatttatagtaaagatggggtttcaccatgttggccaggctggtctcaaactcctgacgtcatgatctgcccgcttcagtctcccaaagtgtgattacaggtgtgagccaccatgcctggcaaggcattcttttttattaggggggtgttgtttattacctcttctatagaaaagtaaagacattaaaatgtaagatgcataataaaaatctaagtggagaggctcttataacctataatattgagtgatgcatcaggtaggtgttcagagtaatctgcattatcatgagaagaaaacatgtttaattttatttaaaattaaatgagtagtatattattgtactaattgtactaattttttctgagacagagttttgctcttggtgcccaggctggagtgcattggcacgatctctggctcactgtgacctctgcctcccagattcaagtgattctcctgcctcagcctcctgagtagctgggattacgggcatgtgcccccatgcctggctaattttgaatttttagtagaaacagggtttctccatgttggtcaggctggtcttgaactgccaacctcaggtgatctgcccactttggcctcccaaagtgctgggattacaggcatgagccaccgagcctggcctgat

SEQ ID NO: 249523 - DNA, 846 bp, Homo sapiens
gctgtctgcaggccctttgccatcgtcagtcctctgaccttactcagttactatatatagggtggtcagcagccacttctcttgagctcaaagagaagcattttgtgaaagtccttgaagagcatttgagggctggcagaggtggagctctgagtcgcaagtgctcccatccatgcatgtttgagaagcatgctgtcatcttcattctgcatctcctctcctgacaccaagactatgaagggaacagaaaatgtcacggaggtcaccagacctgtctatgtatcataagatgtcaggcccttcctggattccagtcactgcttatattctgccccatttaactttttgggaacaagagtccctccatccagataaagtagggcaggttcttaactggccatgtcaagtacagccactgttgatgccaccaaggacgttctgatgttgccttgcttctgtgaggaggcagagctatgttgtcctcagtggctctgcctgccgtgtcagccacccggaaggtttggagttatgcaacgagtcttcagttttccgtgtttctcctatcttgtctcttgttttgtgtacttaagcctcttgagcttgtccttgtagaatagtgtgggaccactgactaaaggaacagaacgttctggatatctccttcctccagctttagccacagggctgtgcacagctctgttgatttccagccaggcgtgccagcggcactggacagtcatctgcagcccttcatatatcgtaccttggagttgttttccttggaccctcctaccttccaatatcagcttttcaataaatgaaaatggaatccttccaatctgttgt

SEQ ID NO: 249524 - DNA, 492 bp, Homo sapiens
tgtaaaatagtgacccaagatggaaaggatattctaagcaatgggaaggcaaagagtcgcttaagcttttcattcattgtgatagcaactgaacttcttaatgtatttattgttataaaaatgtgcttgaaaccaccaattattttttcctgtagatggttagaacttttaatattgtctgggaaacttctagaagcataatttgtcaagtcaacctgcatacagcatttgtaagtactctctatgagaacactcagaaaatgttacagtttctgactcattctctctagcccagttgtgtgttaaactgaaggacacacttgactattgcactaggaaaaatgggttaggttctttttatctctgtcagtttccctttatccacacatttaaaataatttctctcttttctttttaagtcacagctgtgttattcaagtgcacttttttttttcaataaagaaaatatactgcattggcaaaaagagtcat

SEQ ID NO: 249525 - DNA, 261 bp, Homo sapiens
ggtaaggactcaggtcagtttcaagattcagaatatttctggaaagaaaaaactagattggggaacatctgaaaggaggctttaactttctaatatttaataattctatagccaatatagcaaaatactaattgttaactagttgattttaactatccctattttttgtgagttggaaatattttatggtaaaaaagattagtaagaacgatatttctgatgtatatagaaactaaagtcctaaataaaatactggcaaat

SEQ ID NO: 249526 - DNA, 391 bp, Homo sapiens
atcaccctgcatgaatctgctgcagtggagggtctggccgttttcccaccagcccggaggcacagagagccagaatacagcattccctctccatcacaggcattcacaccagcagtgctggctacactgtgacaggacagcttggtggccacacccaaatccagcctgggcaacagagcgagaccctgtctctaaaaatataaaaaagaagaaaaacatgagtataacaataatgaatgggtaataatgagtccagcctggattatactggtcattatacagagtcgtaaaatatgatttttaatcttgttttaccaaggaagggacccatgaaggcaaaaatgccgagggcccacaaaagtcatgagatggctggaatccggggtaatgt

SEQ ID NO: 249527 - DNA, 461 bp, Homo sapiens
attcactccattatttttctagttaagctcagatagtgatcacagagatatgttagtaaactatctgtagtttgtagttctccctttaacagttcctttttggagtgactagggcacatttcctcctcattattcatacaccaagtctgactttcttcacttatccttatattcttcattctcctgctccctgtttgcctttttttcctcccactccttccccctttttatttaaaaaattttaagtgaaacagacatccactgatgagaaataacttagaatcacaaactatcacggctgaaagatacgtatcatgtagtacagtggttggcaaactttctgttaagggccaaagaatagatacttcaggctttacctgacatttggtctctgtttacattgctcacctctgctattataagtttgaaaaccaccacagacagaatacagacaatctgta

SEQ ID NO: 249528 - DNA, 1097 bp, Homo sapiens
tgagaatttgcatttccaacaagttcccaagagattctgatcctgctggtcgagagtaacaatttaagaatcatcattctaggttatatacctgggagtggaattactgtgatatatagggtatgtatatctcaatttctaatgtaacagggtttcagagatcctcttcacattcttgccaaaactttggagtattattttgccagcctaatcagcttgaaaagttatctcattgttttaatttgcatgtttctgatttccagtgaggttatgcatgtattcttaacatttattggcctttcaggaactttctgtgagttacctgttacattcctttgctgaatatttaatcgtttgttttttcatatttatttatagggattattttaaaattctgcatatgaatcctttctgttgtttagcaaatatctttgcccagtggatgacttaccttttaactttgttcctgatgtcttttgttgagcaaaagtctttcattttaatgttatcagattatcggtattttattcaatggtttgtgctttttgaatcattttaaggagatccttccctacaaatcaataagaaaaatacaaacaacacaataaaaataaaagtgtttataaaaacagacataacaggcagttcacagaggcaaaaacaccagtggcctatagacttaagaaatctcattagtaatcaataaaatgcaaaataaatctatactatgatatatacatttagtacttagaatgctggcatatatttaaaggcctgacaatgccaagtattggtgaacatacgaaacaataagaactctatgtaacctcagcactttgggaggccgaggccagcagatcacctgaggtcaggagttcgagaccagcctggccaatgtggcaaaaccccgtctctactaaaaatactaaaaattagccgagtttgatggcacacacttgtaatcgcagctgctcaggaggctgaggcatgagaatctcttgaacccaggaggtggaggttgcagtgacccaagatcatgccactgcactccaacactccagcctgggtgacagagcgagactctgtctcaaaaaaaa

SEQ ID NO: 249529 - DNA, 596 bp, Homo sapiens
accactattaatagttggtatgatgtagcattttctatgaatataaaaagatatgtgtgtgtgtatgtacgtatatatgtgtatgcatatatatatacctatagatctatttaaatattaataaatctgtatacccactatttggcaacttgcttttgccttaatatattatagctgtcttttcctattagtacatataaatttattttagtcctgttaatgactatgtgatatatatggtggatgtatcataatttaactgtttctctgtgatggaagtttgggttggttgcagtcttttgcaattacaaacaatactccagtaaatatccttctgcataaatttccgcatgcttgtataattgtatctgttaattcctaaaaaattgctacaagaggaagttttaaaatttgatggataccaccaaatttctatccgaagcagttataccaatttatcttatcaaaacttacagtaaataattctctacacccaagggtgtccaatcttttggcttccctgggccacattggaagaattatcttggatcacacataagatacactgacactaacaacagctgatgaactaaaaa

SEQ ID NO: 249530 - DNA, 866 bp, Homo sapiens
cacttcgtctcactcatctttttctctcttattacccactctattctccctacctttctcgggaaatgacagttgaaattagaacaggagctaagaggagccagcagaaggggacggcaggaactaggaaatttaaggcggggagaaacaactgagagaagtggacagaaaaaagaaagcttagcataaataagaaggcccgggactcccgtgcgtccagtagacctgctctgctatggatcaaaacaaatgatttgtcattctgaaatgactctgaaagggggaatggaatgtgccccaacgatcaatattaaattttatgcctgctgcacctttcaaaaggctcaagaagacattgattcaagacccgtgttttctgtatgagtccacaagatcgaagactttatggacagaagtcatgtatcttcaacacagaaaatcctataacctcctttgatgttgaccgaggttgacttgcctccagaaataagagattctgctccatgctggcggtgtcctactttgccagaaatgtgcaggtgtcaggtggactacctggagaagatgctacaggagaaagtgaaccctgactcgcaggcttcttgagtttgtgagtctatgccttcaccttgatctggcctttttcttcttttcttttttatctgttctcatgtttgcacttccaacaccattgtattagcttctcctgtgagtgacataccagtgtgtcccaagattacttaatgtatttagtgcacgggcctgtggtcaatgaagttataattaccattccctcttgtccttaatacaataacaacctcaagacgggcccgttcccaatcacccatattaatctattcttctgc

SEQ ID NO: 249531 - DNA, 561 bp, Homo sapiens
ctatctgcaggcctatgagatgagaactgcagtcttcaaaatgatgatcatggggtatcaaagagagcgagttatgatgagttatcctctactccctaccacaggaaatggacctatctcatttaaactttacttcattaagatctaacaatgcaggacttttcttcttaattctcagttcgctagaacaaacccttctctcagcatttctgttattaaagttcactggaatgcttaaataaaagaggacccctaccttttatatattgtaattaagcaacaaagctgacatctttctaaaatacatatgtggtaaagcagaatcaacattgcactaggagactggaaaaaaacatgaaggtttttgatatatactacttatataaacttgagccatctttttatttctttcaacttccatatcctcaactgtaatatggggcttagcctctatagccaaaaactgtttggggctacaaggaattaattaatatgagagtccttggatatttctaaaatacaataaaagtgcaaaagattattatggttaaactgataatt

SEQ ID NO: 249532 - DNA, 434 bp, Homo sapiens
agtctggatagccaaaacaatagctgaaaagaaaaaagctggaggcctcacaattccagatttcaaaattacaaatctgcaaaaatgaaaagtgcagtactggtgtaaaaataaaccaaaagtaattagaaatgggaaaaaatggcccagaaataaacccacaaatatatgttcaaacgatttttgaaaagggtaccaaaaccattcaatggggaaaggacattttcaacaaatggttctgggagaaattagatatacatatgcaaaagaatgaagttagaccctcacttaacaccaaatacaaaaattaagtcaaaatagattaagaccaaaatgtaagagctaaaagtaaaaaaatctgagaagaaatcagagagaaaacgctctgaaacactggatttggcaatgacttcttagatacaataccaaaggca

SEQ ID NO: 249533 - DNA, 722 bp, Homo sapiens
ttgttcagttcccacctatgagtgagaacatgcggtatttggttttctgtccttgcaatagtttgctcataatggaaagccaccatcatctcttgctggataactgcagcggctttgtaactgttctctgtgctttagcccttgcccctgtagcctattttggttttagagtaaaatgaaagcaagtttattaagtaagtaaaggaataaaaaagttgctactccataggcagagcagccccttgcctatacagtctattatgaacacaggaaacaggctgttaaactgtgagtcagattaggacatccctaaaaaattcttcaatggcttcccatcattgaaaaactggtctttacaatggctttcaagagctcacacaatctgtcttcattctcccctataactataatcgtatcttctaatcccatttttgctactgtaccccttgtttacttccctccagaagactggcatcttgttcctgggacatgctaattatacttctgccttaagatactcgcactttttgatcttttaacttggaatgcttttcccctaggtatctgtctgtattacttggtttctttcttttggtcttgattcaaatattactttctcataaggtcttccctggccaccttattttaaattgcctccccctcagcatttcctgttcactcttctctctttgttttttcaaagcatgcatcaccatctctat

SEQ ID NO: 249534 - DNA, 1120 bp, Homo sapiens
ctttcctgaagtggctgtaatatctgcggtggacagagcgtctggaaccctggctgggagcgggcagggccaggtttgggggcagccttggcagcagtcgggggcaggggccgcctacactgagaagtctgacaggcctaggtgccacttgctgtgtgaccttggacaggcccctgatctctctgggtctcagtttcctcctctgtaaaatggaggcaaatgaggatggaaggagatgcagtgtggagcatcgagggcagaggagagctgagccgaccccaccctctgccccagccgcactgagagaggcgatccacgcagctgtttgtctgacctctgtctcccaacactccccaacactccccccgccatcaggcccaggctcatgggtggccctgagccgtaccctccactgagcaccaggagaaggcaccgtggggccaggggtggccgagacgtttggaggtcacagggctgcgagtattggcgttgcccatcaccccaggttcccagcacgtgccccagcctggccagctcagtggcagggcctctgcctgtggaggaagggaggccaaggcacctttcctgagcaggaagtgagaggaacagctctgcatacactgggtcccacatggcacaatctgaaggcagacagtggctcctctgtacctggggaaactgaggcccagagagccagggacttcccgagaccagccagcagcagctgccccttcctggggtgccatctcccctgtccctcctgccctgcgcctgcccagccctcctgctctggtgactgaggaccgccaggcaggggctggtgctgggcggggggcggcgggccctcccgcagtgcaaggccgggcctggcggggtgaggtagtaggttgtgtggtttcagggcagtgatgttgcccctcggaagataactatacaacctactgccttccctgaggagcccagtgacacgaccccatgggagggccgccccctacctcagtgacacgaccccacgggagggctgccccccacctcagtgacctgcagggggcctgagccgaagctgggtgggcatctgggagctagattcaataaagctgttctgaccatgaacttggaa

SEQ ID NO: 249535 - DNA, 292 bp, Homo sapiens
atattaaccttgaacataaaaggcctaaatattccatttaaaaaataaacactagcaaattggataaaagaagcaggacttaaccatctgctgcctaccagagacccacctaatggcaaaagacaactacagactcaaagtaaagggactagcagaagaagagaaataacaaagagcagaaccaaatgagattgagaccaaaaaaaaatgatgaaaaggatcaacataatgaagagtttgttctttgaatggataaacaaaattggtagaccactaactagtttaatgaaga

SEQ ID NO: 249536 - DNA, 337 bp, Homo sapiens
tccttgaacaaaccatccgaccttactggccctcgggcagctaatgatatggtatacaagaagcgcttgatcgagccaccctacagaaatgcaaccttactattactgatattacatattacattgggcagcctcttgtctagaaataggaaccaggacttctgtttattcctccatcacgggttcttcaagagtcgtattctaaaatgaaacagccagcccccttctctgctaactccctctgatcagttaacaccaaatagatatgagaaatcagagagatggctgagaggaaaaattagacttgtgttgggaagacaaggaagaaggaaagcca

SEQ ID NO: 249537 - DNA, 868 bp, Homo sapiens
  misc_feature (3)..(3): n is a, c, g, or t
  misc_feature (5)..(7): n is a, c, g, or t
ggnannngggggtgttcctctctccccacacccggagtttcccgggcctgccattgtggacccgccccctatgctttacacctagtctctttgcccacagacctcctcattccctcccaaaacatcctctcaagagaagggaggagaagtttcaagaaatcaggaggggtgggtttggaccctgggcagggtggaggcagtgaccttgcccttggtccctctagccttcttccctgtgcaaaaaaaaatgaccctggagaggcattcttgtaggagaagaatctagcggccggggagaattggggccgggccggcggtgggcagagtccgctgctatacacacagggaggaattctcacgcccaagccccgcctctctacgccttggaggactcctgtgacttcactgctctgcctctggagaacactgggagagtcctaccgacgttcaaacaacaggttaggccaggtaacagccctgcaccaggccgctgcccacgcctctgccctggcacccccaggggattccttgcccatcccatctctctgcagacggatgtgtgtggccccctcctaggtgccccacaaccaggaccaagatggggctcccaaaggaggtaaggagaacctttggcaggtgcttaggacactgactacctagaaagtagacgcagcagagttgctcccaagtcgaggctcctcagagcaggtgggtcctgacagcagtggattctcccagcaggatgaggaaggagggtgtgttaaccaaccaagggagtgggccccccacccaggtgtctccgcaagaccacaaaaagcccaaagatctatgtgtcactgatcattgtaaataaagtggacctgctttt

SEQ ID NO: 249538 - DNA, 814 bp, Homo sapiens
  misc_feature (3)..(3): n is a, c, g, or t
  misc_feature (5)..(7): n is a, c, g, or t
ggnannngggggtgttcctctctccccacacccggagtttcccgggcctgccattgtggacccgccccctatgctttacacctagtctctttgcccacagacctcctcattccctcccaaaacatcctctcaagagaagggaggagaagtttcaagaaatcaggaggggtgggtttggaccctgggcagggtggaggcagtgaccttgcccttggtccctctagccttcttccctgtgcaaaaaattggggccgggccggcggtgggcagagtccgctgctatacacacagggaggaattctcacgcccaagccccgcctctctacgccttggaggactcctgtgacttcactgctctgcctctggagaacactgggagagtcctaccgacgttcaaacaacaggttaggccaggtaacagccctgcaccaggccgctgcccacgcctctgccctggcacccccaggggattccttgcccatcccatctctctgcagacggatgtgtgtggccccctcctaggtgccccacaaccaggaccaagatggggctcccaaaggaggtaaggagaacctttggcaggtgcttaggacactgactacctagaaagtagacgcagcagagttgctcccaagtcgaggctcctcagagcaggtgggtcctgacagcagtggattctcccagcaggatgaggaaggagggtgtgttaaccaaccaagggagtgggccccccacccaggtgtctccgcaagaccacaaaaagcccaaagatctatgtgtcactgatcattgtaaataaagtggacctgctttt

SEQ ID NO: 249539 - DNA, 381 bp, Homo sapiens
gaaaatgagttaagtgagatatttataatatagtaatgctatgtgcatgagatatacacacacattatacatctataatgttaaaatgactgagcgaagtggagaagcatgtctagtccatatatctgcagctcctaatacacatactcaatcataagttcatatcattgcaaatatgataaaaaattaaatcagcaagctacaccttcactgtgttgaatttgtgaatagtattagactagccagggacagagagttactttgacactccagacttaattagttcttctaagaacatttaaataacttgaatcaagggtttcattcagtctgtggccaagttaagttcttgctttttaataaattgtcctaattcacgcc

SEQ ID NO: 249540 - DNA, 515 bp, Homo sapiens
acttgtaagaactggaaatggggataatgctctctatggttatgcagcctactcttttactaacctttctggactagatctttgaagtgcgtcttagctttcctcctttcctgaagagagcagagatagtgctgctttaactgtggtcatacatgtatgaggaataactttagtgtgagctgttggttttaaagagtcatatattattctatgcacttttgtaagttcattttataatgagcagattggtcaactgacatttttgattatttgtaatacatgtgttgcttggaataatactgttaatttccagaaatataagtgaaccttagcttttctgttggtggcttttaaactttttatgatgggaaaatgtgtgaattttctcctgggaaagtatagactggagacttagataccagtagatgaattgaggaatttctgtgtagcagtttaatatagaaaagagttagctgtccatgaggaagggctttaagaacaacaataactaccaa

SEQ ID NO: 249541 - DNA, 401 bp, Homo sapiens
accaaatataatttaaatggacttccaaaaacttagttataattctcagcctctgtagaacattgacagccaactgtcctactgtctcctcaggacctcttagattttttgggccagggttcacgcagatattgcagagaagagttgatcacaatcccagggtggaagagtcttgggcttccttcggttcccctacaggtagtctgtaatgcatgcttccagaccatcatgaaaattattgacaaaataagaaatgtgagactaagcatgaggagactattggtgtaatcaaaggatcctatctttgtaccaagagccatggtatttgagtttacccttttcttgctaccataactgacttgatgttctgtgaatcaggaactacctttagctccctccta

SEQ ID NO: 249542 - DNA, 312 bp, Homo sapiens
tagactaaaagtttcagacaccctgttcaaatatcccattagttgctagagacttaaaatgaacagaacgcacattgtcaggatgactattaccaaaaaatcaaaagacagcaagtattggtgaggatgtagagaaactggaacttttgtgcactgtttatgagaatgtaaaatggagcagctgctgtggaaaagagtatgcaggttcctcaaagagtaaaaccaagatgtggaaacaactaaatgcccatcagtggatgaaggggtagacaatatgtggtatatacataccatggagtactattcagcctc

SEQ ID NO: 249543 - DNA, 432 bp, Homo sapiens
gcgttagtcctaaaaagctctattccctcttccctctttgatactattatttttatacatattacatctatatatgttataaacactataataaatatacttattactttagataattttgtcttttaaagaaactgagagaacaaaagaaaagtatatgtagtatttgctatattaaccttatttgccatttttggttctttttatttgttgccatggattcaagatacaatctggtgtcattgtcttactccagtacagctttgctttcaacttacctcctttgtgctgttatgtcaaatatatatgtatctataatgtaagttcaacaatataattatatacggattattttatacagttattttaaaaatcagtttagagaagaaatatgtatttatcttttataattaaatagttacttttaccaat

SEQ ID NO: 249544 - DNA, 476 bp, Homo sapiens
gcagcagagacttataacacatttgtatgccacactaaggagtatggcatacaaattatcctgaaggtaatgaaagggaaccactgaaaagaatcagagaatattacagtaatttgatttacggaagaccagtcttggtgcagtgtagagaaaggactggacatgttggcattacagacatcagtatgtccttctgagtaaaacagaccagaacctgaaagagcttctccacctgttagctgtaagtccttaacaagtttctcaacctctctgagccccaatttccttaaatggaaagtggagacagtaatgtttacatgtcagggttactctgagaattaagagataatgggccctgccccgcgtctgcctcagaggggcccgagccacccggggcgtgcgccgcgtccccgccggggccgacagagccgagccgggccaccatggaccacaagactctgctgcaggagcggccg

SEQ ID NO: 249545 - DNA, 445 bp, Homo sapiens
tttaatttaacaagggcccagtggttaaagtttcttaaaaacaaatggacatatgaacaattaattataacacaatgtgatcagtaaaatgaatacagatgttgaattcagacatctgggtttaaattttgacactgtgtcaaaatttaagtgtgtaattttaggcatgttaccaacatctctggaaattattaaaaagattatatataaatatgtaaagcatctagcagggtagactgcacatagaaaatgaatggtagctaattataatcctcatacacacatggtacaatgaaataataataatgggttaaaccaggtgccacactttttctgtaaagagcaagataccaaatattttaggctttgcaagccatacagtctgtattgcaaccactcaaatctgctgctgcagtgtgaaagcagccatagacaatacaaaaaa

SEQ ID NO: 249546 - DNA, 424 bp, Homo sapiens
agaatgtgatatgggataaaagtggtatcacagagtagtgtaaaaaatcaggttattaacaaatagtattgaagcaattagctaagtatttgggaaaatataaagttaggccctactctaaaaataaggtagattgtacttagttctgaattatgagctgccttttcaatgagattacaattccatgcctcattgacatcaggcttagccatgtgacttaatttggccaatgaaatgtgaacagaagtgacaaataccccagtatagtagaagttctatatgccattgcacgctcccactgttgctctttgtctctcttccaggagctcagagtagaggcttcctcttcggtctaggtcacagaatgaggcacaactggaatagcaccaaaggtaacctacagctaacatgtaaagtgagtgag

SEQ ID NO: 249547 - DNA, 619 bp, Homo sapiens
taaataatacaaagataaagtattagcatataatctttctacattttcttagagtttctcctgtttttttttccaggaaccctgaaattatctgcaggagttgcttcatgtgattgctctttttaattatctccatgtgaagaaaacattgccaataatgttagcttgctttttctcagcagtagtcagttttgacattacttgcctatgggctagccctctacattttacagggcataatttcttaataaacttttccccccatattggaaactttatgacttaaaaatatctgggaaataatcattactcatagaactgacacagaagttgtagaatccacacacgtaagcataaagacttttattttactagggagaagtcctcacgtgatttttttgtactcttattttaggctctttaaaaaaaattttggcaaattaagagttgcagattagtatggaagataaaaagttgtcagatagttttaagaggagacagctgaaagcaagacgaaaggcggacaacctgctaaaagcaaacataattcccaaaaagcgtgttaggtgttttagctgcgtaagctattggttataaggacattgttgtgtaacagcag

SEQ ID NO: 249548 - DNA, 446 bp, Homo sapiens
tagcatagtgattaagagcatgggttccggtataaaacagctggagttcaaatcctggttctgtcatttagtagttgtaaaattatgttagtcacttaactactctaccttagttctgtccttcataacatgggaaagaaatgtgccaatcttacagagttgagaagattgagatgataagaaaaatggctagagtagtgaccagcataaagacaatacttgggtaacttaagattttctcattgttcttaacatgttgcagtcttatttagctgtggatttaattctgtttgttccgcgtgggctttatcatatattctaatgtaatattgtttttcagcaacttggggaaattcccattctattcattatgttttcaaatattgtttcctttctctttctgaatatcatttatatagcatactattaaaaaaaatattgcccat

SEQ ID NO: 249549 - DNA, 780 bp, Homo sapiens
cattcctgtctttctgcatgtgtgtgtgtgtgtgggctgggtagggactgtttttgagatcactgggctgaaatgtattctaggggtgaaggatctaggatgtacctgctcgtcatttcctgacttcaccttttaccaattcttttcttaacaaatttaaaattggtcagagcaggagctgctagctggctttttaacagtgtttctcataatggcagtactcagcaaatagtttttctcttgtctcctaaaattaagttgcaagactaatgtaacaaacagtaaaatttaagctaaagaactcagtataggctgggtgtggtggtttacgtctataattccaacactttgggaggctgaggtggaaggattgcttgagcccaggagtttgagaccagcctgggcaacgtagggagaccctgtctctacaaaatttaaaaacggcaacaacaacaaaaaaccctactagctgtgcagcggagtggtgcgcacctgtggtccctaactacaagctactcagaaggcaaggtaggagcatcactggggcccaggaggtcaaggctgcactgttcataccattgcactccagcctgggtgacagagcgagaccttgtctcaaaagaaaaaaaaaaaacaatctcagtaataatgaccactgtggctgggtgtggtggctcacacctgtagtcccagcactttgggaggctgaggtgggcagatcacctgaggtcgggagttcgagaccagcctgaccaacatgtaaaaaccccgtctctacta

SEQ ID NO: 249550 - DNA, 2378 bp, Homo sapiens
ctgagccttgggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggttttt

SEQ ID NO: 249551 - DNA, 440 bp, Homo sapiens
  misc_feature (242)..(242): n is a, c, g, or t
tgagactgtctcaaaaacaaaaacaaaacccccgtaaatagtatgtgttcttggatttgataaataacctgtcatttactactgaacaaacttgacattataaatcagttcatgctttgtgggaactgcttttcagatttcatctgctgcttgcggctatggattcacactgctgtcctctaagactgcggatgttacgaaagtctgggggatgggactcaacaaagattctcagcttgganacaggcgtgagccactgtgcctgactgaaagaggattgattttaaaatcaaaccatctttggtctatatccaacctcactggaagccccggttttctcatcgggtcagtgaagggaggattgatgagagtgtagttaaaacacccaacaaagactggggtgtcactgtgtaaattcacagagctgtagtacagggcca

SEQ ID NO: 249552 - DNA, 2317 bp, Homo sapiens
caggctgtacggtccggaggtttctttagatgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggttttt

SEQ ID NO: 249553 - DNA, 2612 bp, Homo sapiens
ctgagccttgggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaaggtgcaggccgcggcttcctccctctctccttctctctcttccgcgctcccggcctccctcgacctgttcggctctcttcaagaagttggctcctctgggtggacagacttccggcaggacgaccctcgagctggctgcaagcccaggaggggaaggcgttaggggtggccatcaacatttattgggtggcagtgccagatgttgtgccgggtcgtgtcattcgcttagcacccaatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggttttt

SEQ ID NO: 249554 - DNA, 832 bp, Homo sapiens
ctgagccttgggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagatccagaaattgtgaacaatgtttgatttagtagcgtgacttgcctttccctttaaaaacatcttttacaaatctgtcttggaataaagtctattttctgccttttggttttt

SEQ ID NO: 249555 - DNA, 2248 bp, Homo sapiens
ctgagccttgggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagcgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggttttt

SEQ ID NO: 249556 - DNA, 857 bp, Homo sapiens
ctgagccttgggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggaggcagcctttggtgggccgctgtggcccgcacgtctctgttctctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggttttt

SEQ ID NO: 249557 - DNA, 785 bp, Homo sapiens
ctgagccttgggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggttttt

SEQ ID NO: 249558 - DNA, 343 bp, Homo sapiens
gcaattacttccttactagctggggctttacatacacacagatacacacatactctcaatttgctaagactgaaaccatcttggcaactttttttgcatctcagttttctctctgtgtacgaagaaagttattacatgattgctaattttcctatagctgtacaatcctgtaagtcatttaacatttattaagcatttgctatgtgtaaatgagaaagattttgctaagagaagaaatatatacagcatgagtaaaacccatctggccttaacgagtacaatttattggcaggacgccaaatgcaaacaactacctttataggacctttatatacctgtataa

SEQ ID NO: 249559 - DNA, 384 bp, Homo sapiens
atgcagaaggttgttcttgaagctctgttttgaaaggatagtggccagaacgcgctgcctgtgtccagcgtccctgatttgtcacaatgagcaagatctctgagcatcgtcaatctctttctctgccccaagaaactcaagcttggttaaaataagaaacatcttcaaaaacatctctagctatctcttttgtaattcactttctttagtatcataattaagttaagatttatatgtatgtgttgggagcgcctctggctctggaaattatgcccattgttcattactatcagcaagctgtggtgtgtttgcttgcatgaaaaacatcaccattgctactacttagaaaggagtctagtgcaaaataaagggaagtctgcgttt

SEQ ID NO: 249560 - DNA, 618 bp, Homo sapiens
atatgatattgtgaagagccgggtccagagtaagtgagtgcaccattttaactcccttccctcaccttgagcttctattgcaattattgtccgaaaatctatttggcaatcatgaccatctcttctatgctatccaggattgttaattatcttagattcaccattgttatcagaagttatctgtgtccattcatttattcaacaaacatttactagtgtggtttttagcttgggcgaatgggggtgtggtggtgctgatgaccacagcaggggagataaggggctgcaggtgctggtgggaggtgtgagagtttgcagtccatcacgttgagcttccttgacacacaaatagggcgttccagacaatggttgctacgtgagacggctgacaaggagactcagaaatctctggtctgcaatagttgacataagaatggggcccacttagttcaggggctcctctctaaaaggcacataaaaagatctggaatttgggccgggcaaagtaggttacgcctgtaatcctgacactttgtgaggccaaggtggcaggattgcttgagaccaggagtttaagaccagcctgggcaacataacgagaccttgcctttccccttc

SEQ ID NO: 249561 - DNA, 313 bp, Homo sapiens
cattagcgaccattatcctgaccatctccccccggagttacatcagaataaccctttgtgttttatacagatcaattatttcattcatagttcctcttttcccagtgtcagagaatcatagactgctttttagattgtatgccatacttaatgacatgtatagactatcagctgtctcattcattcattctttttcatttactcagcattcactagttaccgtcttcttaggccaaggggtaggagcaagttgaatatagaattcagccctgctctagagaatggcgtgaacccgggaggcggagcttgcagt

SEQ ID NO: 249562 - DNA, 304 bp, Homo sapiens
aggaaactgtggaacagagacatcctcctgtgttcagagtcacacagcctagatagtggcagtggtaggactacaatcatggcagatcagtgctagaaaggctttagagtgtctgtatgtcattcagggttcccagccttgagaagaggacctgctatgcagttactgcggactgcaaattcacatgtacaccaactgttgtttgtagactaaataaataacatctaacatctgtataccgttactttaaaaacgaatgttgactctgctgtgattaataaattggaagtttattttcaactgt

SEQ ID NO: 249563 - DNA, 1027 bp, Homo sapiens
gcgcgcagcagaggctccgattcggggcaggtgagaggctgactttctctcggtgcgtccagtggagctctgagtttcgaatcggcggcggcggattccccgcgcgcccggcgtcggggcttccaggaggatgcggagccccagcgcggcgtggctgctgggggccgccatcctgctagcagcctctctctcctgcagtggcaccatccaaggaaaccattagatcctctaagggcaagaagccttatgggatagaggtagatggcaatcatacgcagtcgagctggaggagggagtgacggtggagacagccctgacgctggggattgagttgttcttgtgcttctgtgttccttcatgggaaaactgtgaccactggctctctcctttcacaatggtcatacaacagatggctgtgggtggggggttggccaagtaacggcatggccctgtgggtctttcttttccgaactaagaagaagcaccctgctgtgatttacatggccaatctggccttggctgacctcctctctgtcatctggttccccttgaagatgggctatcacatacatggcaacaactggatctatggggaagctctttgtaatgtgcttattggctttttctatgggaagcatgtattgttccattctcttcatgacctggctcagtgtgcagaggtatcgggtcatcgtgaaccccatggggcactcaggaagaaggaaaattgccattggatctccctggaaatatggctgctgattctggctggtcaacaatccttgggatgtcgggaagcagaccatctcaatctgggccgtggaaaatcaagaacgtggtcatgaacgtttgcctgtaaaagcacatgtggggcgagcaacgcgttcaaaaacatcactcatcggggcaagggggcctacatggtacacaacgaatcctacaaagcctgccaatggtggcgaaaacacaaaagcggacatgtgccggggaaaaaccgacgaaagagtagggcggacacatgatacgg

SEQ ID NO: 249564 - DNA, 403 bp, Homo sapiens
acagagtgtcgctcttgttgcccaggctggagtgcagtggcatgatcttgactcactgcaacctccgactcctgggttgaagcgattttcctgcctcagccttccgagtcactgggattacaggtgcccgccaccatgcctggctaatttttgttatttttagtagagatggggtttcaccatgttagccaggctggtctcgaactcctgacctcgggtgatccacccacctcggcctcccaaggtgctgggattacaggtgtgagccaccttgcccggcctcaaattttttttttaagagttctatttcacagcccactaatgggccccacctgcgatctggaaaaattgctctaatcagatggctgcagactggcccagcgcctgcccttctgctctactc

SEQ ID NO: 249565 - DNA, 518 bp, Homo sapiens
accctcctctgtaagctaccaggaagtagatactgattttgtagtaagtggtcaactagctagctacttgtcgctcttttcagggatggtgtagaatagaacttgctgagaatagatgatttttaaagatttttccaactcttgaggtatgtatgagtagactccagaacagatcaccccactgatcaccctttttggttttacagatgcagcactcaaacagggcctcctgtttctagcaagactcaagacagattcctgggcccacattgacttcagacatttgactacccataagtggctgaacttaattgggaagagaatcccaactctcaatgctgtctatttttacactgacaattttgcttttttttttttttttttgagacaaggtcttgctctgtcactcaggcactcaggctggagtgctgtggtgcaaacatagctccctgaagccttgacctcccaagctcaagtgatcctcccttctcagcctcccaagtagctgggaccacagg

SEQ ID NO: 249566 - DNA, 491 bp, Homo sapiens
tagtggttcaaccactaaaacattcccgctttggattcaagagcaaacttgaattacagaaactcaagtctgaggaatggtggaccttgtatgccatagaaatatccagctgccatgctgtgagctgctttattaagatgcccaagtggcaaggcactgatgtctgtagccaaaagccagcaacccaaggcctgccaaaagccacgtgcatgaacttggaagtggatcttttctcaattgggccctgagatgatgacagcaccagctaacaccttgatgacagccttatgagataccctgagccaaaggtacccagctaagtcatgtttggattactaatcaacagaaacgttgggaaaataaatgtttttgttttaagctgttaaattttgggctagatagataactaatatgttgtataactacaatacaggattatttttatctattatataaatttaatatatatatatttgtaactatatatagta

SEQ ID NO: 249567 - DNA, 364 bp, Homo sapiens
gaagacaacacagtaaatgtgtcaattttccccaagttgatacacaagtttgactgaaaactaatgtcagccatacttctcacaaattaaaaatagaacagttgaccccggcgcagtgcctcacgcctgtaatcccagcactttgggaggccaaggtgggtggatcacgaggtcaggagttcaagaccagcctgaccaatacggtgaaaccccgtctctactataaaaatacaaaaaattggccaggcatggtggcgcacgcctgtaatcccagctactcgggaggctgaggcaagagaatcgcttgaacccgggaggcggagggtggcagcctgggtaacagagaaagactccatctcaaaaa

SEQ ID NO: 249568 - DNA, 401 bp, Homo sapiens
tagaacttgccattgtccctgctctttagagttgcttcaaattaagagtctgggctgggcgcatctagttggcataaagtaatctggggctagagtaactttgtgattcctacagtgtgtgtacaaactattgtgtgttttgaaaatcgctacaggttgagtatccctcaactagtgttaaagtctgttgacaaaaatgcagagtagcaggaaatacagtgaaactcaaaatccatgttttaaatactcttcagattatcaaatcactgaagaggcagagaactgtctgtccctaaaattgtgctctctcccccaccagtctaagctgtcatctgcttttactttaagcttcatcctgtttgactttttttttttttttctgtgactgagttttgctctgt

SEQ ID NO: 249569 - DNA, 273 bp, Homo sapiens
cacatatgtttatgcacatatgtgtataggagaaagaaagtgaatgtggcaaaatactaacaattgctgaatgaagttaaaagctacatgggtctactttgtattctttttaaaaacagctttataaagataatttaaaatacgaaatttaccctttgaaagtatacaattcagtagttttttagtgtatttgcagagttgcacacccatcaccacgatctaattctagaacattttcaccccaaaaagaaaccctgaacccattagctgtca

SEQ ID NO: 249570 - DNA, 456 bp, Homo sapiens
agggtgaatgaagtagatttgaatagccgggagaaagctgagattccatttcacagaattattaatacgttattatctacatcgacaaatttgtaatttcagtagaaattatgtctcttcaaagttgtttctctgaatttctactgaagtcaatgataagaaatggcagtcttagctgggcacagtggctcacgcctgtaatcccagcactttgggaggctgaggcgggtgaatcacgaggtcaggagattgagaccatcctggctaacacggtgaaaccccgtctctactaaaaatacaaaaaaattagccgggcgtggtggcaggcgcctgtagtcccagctactcgggaggctgaggcaggagaacggcgtgaacccaggaggcggagcttgcaatgagccgagatagcaccactggactccagcctgggcgacagagtgagactcagtctca

SEQ ID NO: 249571 - DNA, 564 bp, Homo sapiens
taaaagaaggagcccaccattttggttaggcatcaatagcttattcagagtagaaaacccggtattttgtaggaatggcctgtacgatattggtaaaatgcaacacattgcagggaaatatttgaaaatctggcccgtggcagtataactgagaatgtaaattagtggctgaaagtgtaacttagcagtcaagatttcaggccatgccgggcgtggtggtgcatgccggtaatctttgctactggggaggctgaggcaggagaatcacttgaacctgggaggtggaggtttcagtgacctgagatcgcaccactgcactccatcctgggcaacagagcaagattccgtcttaaaaaacaccaccaccaccacaaaagagatttcaggccagtcagcatgtagaagagctgagcaggttctcagtaaagcccttgtgaagagcccctgaggaaagataatgcagagcattgatatgactagtgcacatcccctgcaaccagctgtcttgcttgttggaaacttcctactgctgctttatcctcctttctttcctttaaaaaaaaa

SEQ ID NO: 249572 - DNA, 443 bp, Homo sapiens
gattcactcccgcaccagggccacatggtctcagtctccttgctcactcctcctcctcagcctggcctctgaaattgcaccctaccctcccctgcccctgctcagctgctcagttgctcagctcctgcccttctcttgccacctgacctccctagacctgaggttctcaatcttagctttgcacgagaatcatcagggagttctgcgaaatgctgatgcccaggctgatcgcgtccaggggagggccagggtcactggcatttttccaacactctcaggtgatgtaagtgctctgtgggggctgagaagcccaacccagggtggtgcctccactctcaaggcaccagcatcgtgtcctacacaggtgccttccagcctgacccctcctctgagcaccacctgccagtgtgacagctccatctggcatgggaagcaaaaaaaaa

SEQ ID NO: 249573 - DNA, 337 bp, Homo sapiens
ccatagtaacacccacatgtagcttctgatagaaacccacaaaataagatgaaaatagtttctcagtcaaatggttggaatatttagtaatacttggcagtattttttattttgttaataacaggtgtcatttaatacaatgacttttaaattatatattaaaagaaatttttaaaagttttatggcaagctgtgaaatactcagatggataatgtgaattaaggcgtgttctttggccactcaaagtgctccccacccaacactggcatggactgctcactaggtggccaaaagagatttcgtttatggatgtgttttgaatgttttaacattaaa

SEQ ID NO: 249574 - DNA, 404 bp, Homo sapiens
gggaaattgatctactttggtagagattgtgggctgtccaccaatatctagctaccttactttattaaaaatagaatccttaatttttagctaggcaaatgcctcctacccctagttggaataaagacatttttcagttttcttgcatcagaatgggtttgcatgagtacacctgggcagtgatttgtcagactttgggaaaatatgatttttttgttggcaagaaagcagcctggatggagctccagtgaccatcttaaaccactagacaaaaactcatgttgaagataatggagctataagatagtgactgatgatgactgtagagttgccatacttgtcccaggctgccaacatctggatttcattgacatgggagagaaataaatgtacattttatttat

SEQ ID NO: 249575 - DNA, 402 bp, Homo sapiens
caggaccaccggtcatttacacagcttgtccattggcaagtgctgctgagcctaggcaaatcatccatggattgagggtatctgggatttcctctgcttgcactcactccgtcgtcttgccttgtgaagaaggttcctgcttcttctttgccttccatgactctgcaaggtcacaagacagataagcataagctgcaaaccgagttctcacagagatgtaagacatgtagcagaagtgtcacagcagccttttgttctcgcttctgtaagcctgcttcatgtagttcccacctcaaaatgcttaaaaaggactcattttgtttgttctgggctcagcctgtaggacacatgtctgctgggccagggtacaccttaaaataaacacccttctgcactgtctct

SEQ ID NO: 249576 - DNA, 782 bp, Homo sapiens
tacaatggcaaggaagatacaaataactctgatggtggtttgcacaatacttgatgctttgacgacaggctggcagaatgcttcacacttcttaaggaagccaggaaaccaattatcaatccattagcagccactttcaaaagaagcttcaaaacagccttcaccagagatatgccaagaatgcatgaatgcacactttcctttgccattttgtaaaccaccttaagaagatgtgaatcctaattgctcagttcttaatgtgtatagtatatgtgtgaaatgtgaaggcaggaacttcttggatgtatacgatttaagttacaaatcagcaatctaatcttgagaggtcaagggagggaaaattggatccttgggtgctcagggaaaatgtcccagaagatacaagacttgagctgggcttttggagagttggaagggaaagagatgctgtgggaaatggcccacagagatgctgtgggaaatggccctactggccctctgctagtatcttcctgtcctttactctgacttcctccttacttatcccaccttctgttctggtgacacacacacacacacacacacacacacacacacacacatccccccacatttccgataaatgggaatggatctgagaaattgacattcaaggccattcttcaagaataattttaaattacactattgattttgccttaaaatcctttttgtggggcgaattgggattatagactataacacatattttcattaccactatcccgcccacaccatgtact

SEQ ID NO: 249577 - DNA, 419 bp, Homo sapiens
  misc_feature (412)..(412): n is a, c, g, or t
aaggcgtttttgccctttgtttcatttagaaataaatataatattggaaaaaagaagtcagtggaatattgctacataaaggcaagaatgttaagtaaaccatctctagatatctggggtaatataactacacaaggactatttattttatagtcattttctgaggtacactctagcatgtggtgagcacatcatacaaacaaatgattaatgaccgtgataaatcactgaacttgaaatggtgggtgtcgctgccggcaagccatcactgttttaggtagaaatgtaaaaaattattcttctgaattataaagttatctgaggtgagaaattaattgcttactaaaggatgtgtgtaaattataagtaattgcaaggtttcattttgttggagttgaatatattagaattntaagaga

SEQ ID NO: 249578 - DNA, 449 bp, Homo sapiens
aacagaagtaatttagaaatcaattaagaattatatatctagaacatctcccaatatatttaggaattaaacacaacattcaaaataacatgagggtcaaataagaaatcataagaaagtatttcaacctgaataataatgaaaaaatatcaaaatttgtgaaatgcaggtgaaacaagtatgtagttaacagttctaactaaagggaaatgtattactataaatattatactagaaaataacaaaaagctttaagtcaatgatttaagtttccactttagaaaaatagaaaatgaaaagcaaaccttcaaaaagaggtaagaggagagaaataattaagatcagaaatcagtaaaaaaggaaagagataaacaagaaaataaaatcaaaagtaagttgtttgaaaacataaataaatttgataagcccatgggaagaatgatcaagga

SEQ ID NO: 249579 - DNA, 398 bp, Homo sapiens
atcattagacattcactcattgtaacaataacacatatgcatgtatacagagagagacagagaaatttagactttgccttaatctgaacttagtgcatcccttgtgcctttagttaacaaaacatccatcctgtggggcagcaagactgctaaatagacatctgcacaatgttggaatccaggctttactcaggatggctgctctgggcactactttcatctaagcaaatgcaataactttagggaataacagtgaattttttccctaaacagttatcacaatgccactgaacatattttaccaccaataactgatctagaaaacccatgtgttcaatcttgtttgtgtattcttcccattcttccatgagctttttcatatctctatgtttgtttta

SEQ ID NO: 249580 - DNA, 410 bp, Homo sapiens
agcctcctctcccacccccatcagcccatcacccccaccctccacacacactcagggtaagattagcgtccaggaagcagactattcgagcaaggagcaaggagctggtaaagcccggagcctgggtttttggaattccacctcccacttccagtctggagacctccagactgtgctgagggcactaagggcaccctagtaacctcaagatgttaattaggtgctccctgaaaaaagacttccttgaccaataggattgggaatatggcacatttatcttccagtttacaatattatggtaaaataaatacagactcacagtaaaaaagaataagaagtataaagtataaaaatacagatttatagtatcatcaacacattaaagaaaacccagtttgctttgacttgtc

SEQ ID NO: 249581 - DNA, 1185 bp, Homo sapiens
tcccaggttaagtgattctcctgcctcagcctctgagtagctgggactgcaggcacgtgccaccatgtccagctaatttttgtatttttagtagagatggggtttcaccatgttggcccagctggtcttaaaactcctgacctcaggtgattcacccgcctcagcctcccaaagtgctgggattataggcatgagtcactgcacccggcctagattctgtttttaatgacactggaaaacaacgaatttttgttttggcatatatatagctttacttttaaaagcaagaacacacacaaaaaaagggggaaaaaagcaagaacacaataaatgcaacatttagatcaacgagtacctgtgcacgagaagcacagggatggtttcagtaggatttcatagtttgatggtgacttttgccaagctgctgctacttggattgtgtggtgtgtttgtgagtgtttatatcattaaaaaacaaaacagccactgcactgggttgttttattttttaatgatataaacactgatgagacaaggcaagaaaacagcaaggcaaaaaagaaaaaaaaaaaagccaggcatggtggtatgcacctgtagttctagctatttgggagacaaaggcgagaggaccactttgaaatccaggagttcgagattacagcgagccatgatcatgacattgtagtctacccttggcaacacagcaagaccctgtctcaaacagcaaaacaaaacaaaaaaccccagaatcacaggatttttttcatgcataatttttctaatattgtcatgttattgcatatggctatagctcattccttttcactgccatatatgacttgtgtgattaaacatattctataaatggattgtttccagtttcttgcttctgtgagcattgttttatgaataatcatgtcttttagcacacatagatattgattatcttcatcaaaagtttctcttgggtataaacctaggacagtagtcttgctgctaataagatatgcagtattagtctttatgagacaatgataaattgttttcctaagtagttccttctcaccagcaatatgtaagaattcctactgagccacattttctccaacatgtggtattatcaggtctttgccattttttttctttttttttttagagaccaaggatgctgctaaagatgct

SEQ ID NO: 249582 - DNA, 604 bp, Homo sapiens
tagtaaatcaagcaaggccctataaggaaaaaaaataaaagccagggcatggtggtttgaaatccaggagttcgagattacagcgagccatgatcatgacattgtagtctacccttggcaacacagcaagaccctgtctcaaacagcaaaacaaaacaaaaaaccccagaatcacaggatttttttcatgcataatttttctaatattgtcatgttattgcatatggctatagctcattccttttcactgccatatatgacttgtgtgattaaacatattctataaatggattgtttccagtttcttgcttctgtgagcattgttttatgaataatcatgtcttttagcacacatagatattgattatcttcatcaaaagtttctcttgggtataaacctaggacagtagtcttgctgctaataagatatgcagtattagtctttatgagacaatgataaattgttttcctaagtagttccttctcaccagcaatatgtaagaattcctactgagccacattttctccaacatgtggtattatcaggtctttgccattttttttctttttttttttagagaccaaggatgctgctaaagatgct

SEQ ID NO: 249583 - DNA, 470 bp, Homo sapiens
cttttctgagtgtttctgtctttccatttgttataacggttgcctttacttcttagagaatggttgtaatagctactattaaaatctttgtgtgataattttaacctttatgtcatcttagagttgttgtctattgattgatttccttgtgagttgagatttccttggtctttcataggccaagtaactttggtttatattctggatattttgttattatcttatgaatctttatatcctgtttatattttaagaagaacgtagttattgttttgtttaacaaacaatttacctagttagattcaggcgataagtttcaatgcacattttatagactttattcccaatgtcagttaacttttcacaggttttgttgttctattaggacctgtccttcatatgcgccactgagtgttctgagaactggagagtagcctatcctatacttttcacagcctttggcatgctat

SEQ ID NO: 249584 - DNA, 529 bp, Homo sapiens
cagtatcactggttattaatatcatttgaattgcaaattaaactgctgaaatccagaacaggacagaaacaaatctccagtccatgaggtccacttgtctaaatatgtcacttgaagtgcaaggtaccaattgctcagtggctcaaaatgattttctggttctgttgtcatttcaagagcttctcttgagggttgagagagtctgttttcctaagaatctggttctctccatcagtctctgtttccaccttatcttcctgggaaggtgtgctttctttgaggtgagatgtgaagcctgcccacgtgcagttttatgtcgaattccaagtcagatcttaacttggtactcccggagcctgttggaagtcttaggaattggggggagtactttggtaaggaagtagccatgacgtaatggtgagaaggtgttgtggtcctagtgcttgctgcaagcttgacatgtggttattcttgtcatccttgcaatgtcattgtgtgcgaaagaacattctccactggaacctgtgca

SEQ ID NO: 249585 - DNA, 439 bp, Homo sapiens
tgtttaaatgcttttcagaatgttatggggaaaagggctgtgggttacttgaagcgtgagaggtctttgacaaaagtggtagatgagaagcacacacagacgcacacacatgtgaagggatttttaatatttatcaaggcaactaaatacataaagatcaattggagaagctggagaatttctctaccttaagagaaaacaggttaaaattaggaattagctgccaagaaaatccctgaaagaacatttaaggggaatcacaactctgatacacagagatttcatttaaaaacccctccccattttttgccaagccacagagaaacagaaaaccagcttccttctcattgaaggagacagagaagccttgggcattaacatcgcaagagtatctctgccttgctcagagtgtgtagtaataaaaagaatcacagttaaa

SEQ ID NO: 249586 - DNA, 254 bp, Homo sapiens
aatcttaaaaaaaaatcttcttttacaagatgaagtgaggtttcattagttttataagatatgtatattaaaagccagtttcattaaatgtcaaacagttcataatgtttagatttctaactttaaacatatgaatgagatttgagtctaaaacttaacagtatttttcagtgtcaagagattggtattgtcttgagaatctcttctaaattgtcacaatggcaataagaatagaaaatagagctgaccgaact

SEQ ID NO: 249587 - DNA, 373 bp, Homo sapiens
ggacttttcttcacctactgcttttccatgttcagacaacacatgaagaacattgaacaaccaaaaattcactttaatagtcttttaatgcttgtcttccagtaatgccttgcttctctaagtagaggatccactttcctgttggaaagagtacttccctagaagtcctaaaacctgtattttaggttcacccttggcactcttattaaacattcatttagcctctctcggtcttgatttctttacttgtggtagactaatagatatagaaagaggttcttttatcctgttttcctgataagttcctaaattccataaatctacactttttgctcacacaaacttttatatatccttattcttatacaatatc

SEQ ID NO: 249588 - DNA, 270 bp, Homo sapiens
agtaaggatagcagcaggacctaccttacagggttgctgaaggtactaatgagttaacccatcagaagcttagcagcacctggctctgtctgctgctctcatcactgctctgttcctaagcctggccgtgtccaggctgtggctaccacctcggtcagctaccacagccctgctttgtggcagacacctggaccctgaaggagaaactagctccggaagcactttctcatgactctgcttaataaaggaataaatagtattcagagtgtt

SEQ ID NO: 249589 - DNA, 358 bp, Homo sapiens
aaaagagagagtactccatttctattctattgccatcttacagcgggcacttgggtttttaatttagcattgtagggctggttgttttgttcgggtgtgtgtccatgtgtgcacatgcacatgtgtagtgtgagatttttaattgcccaaatcatccaaatgcaagtgtttcctcgtattcgaatctcacattgactagtgtgtgttggtaagtgcgcaagggcctgggctggcagattgttatgtggtgagaatccggttagtcaaagtgtatgtggtcacaaaggaatccaacctttattttatcaatttaatttaatttttagatttcaattatgaaatatttcaagaatacaaa

SEQ ID NO: 249590 - DNA, 499 bp, Homo sapiens
gccaccaagctggtcttttgttttgtttttgttttttttagacagggtctcactcttcacccaggctagagggcagtgccacgatctcagctcactacaggctccgcctccggagttcaagtgattctcccacctcagcctcccaaatagctgggactacaggcggcgtgccaccgtgcctggctaatttttgtatttttaatagagacgaggtttcgccatgttgcccaagctggtctcaaactcttggcctcaagtgatccacatgtctcagcctcctaagtgatgggactacaggcgtgagccacggcgcccaggcacgtacttctttatagcggtgagagaaagggctaacacaaggcaaaaaaaaccaggctacatatacacagaaacgcaagtagaaaagggagtagttttttttttttttttttgagatggagtctccctctgttgatcaggctggagtgcagtggtgcgatctctgctccactccgcctgc

SEQ ID NO: 249591 - DNA, 237 bp, Homo sapiens
ggtcaatgttctggttaggtttaggtcagggtcagcttcatggtcagggaaatgtttaaggtaaagatcaagtttatggttaagttaggggttatggttgaagtcagggtcatgaccaggtcatatttaggatctagtttatggtcagcgttagcattaaggtttatttttttatttttatttttttattttttgagatggagtcttgctctgtcacccaggctggagtgcagtggc

SEQ ID NO: 249592 - DNA, 333 bp, Homo sapiens
agtaattaatagtgatttcattttctagcaattttagaactaaagtagaatctactaatgtataatatatccagaaagcagaaagtcatgatatattcaaattattaaactgattaagatacattttactcatgtatcaaaattattgaatatatttgtagtattcttcaatataaataatttctctttttattctggctaccaggccattgtcatattcacaaaataggttcttttatttctgtaaggaaatacattctctctttttttctattccatatctttgaaaacagagaatgcttcatagtctttatatcatagagttcaatttaa

SEQ ID NO: 249593 - DNA, 399 bp, Homo sapiens
cagggtttcaccatgttgtccagaccggtctcgaactcctgacctcaagtgatctgtccgcctcagcctcccaaaatgctgggattacaggcatgagccaccacgcctggcctgttaagataaaacttctaaattgagttttcttccttctggcttgagttaaccagtccagattcacgtatcatgactgaaacttcttatccagccaaatgcatccctttcccaccttgcatactttctaaacacacgatttttccctgctaaacagacacttctatgctgttttttacccttctcaagggtgttctttttttttatttttcttccagacctagcctcttcccctttctggctgcatatctgaatctgtcctcatctttcagacctcagtttaaattc

SEQ ID NO: 249594 - DNA, 453 bp, Homo sapiens
tagcaaatcaaaaaagaaatagagaccagaggctagatagcatctctaggctgcttgttttcaactctgtaatcctgtctgcaccctctcctgctcccctttttagtggatcattttgcattatgtaagaacatacttttggaagtacatggggatatttcttaaaccttaaccctgcctatcactttagtcatttgtaaatctcaccaaacttctgcatgttggattattgcctgatacaactttgtccaaactaacttttgtatgaaaccattcaaagcactgtctgtgcctcttcccccaccaactctgccaactaatgcttccctattaaacatgattcacagttgttgtttacttataactatttcaactgggagggattctttatattatggtttgcagttactaaaataaaaagaagtacttttttttgtaattacttctgtagtc

SEQ ID NO: 249595 - DNA, 342 bp, Homo sapiens
gttattgggtctggataaaataggactaaagatgggaagctgcactgaggagaggaatctgtgtaggacatagtggaaaacttgtatgtctaaatagtaagacacaggcttttgacttcatcaggtttaattaatgatcggctctgtggcatactggctcttagacttccggcttagtaataggctgccttcttatttttgctttattttttcagaagagttatatattccctataaacggtcgatattggaataatacagtgtaaattcttaagtaatttatgaggtcttgctgtgtcacccaagctggagtacagtggcacgataatggctcactgcagc

SEQ ID NO: 249596 - DNA, 664 bp, Homo sapiens
tcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatctgaaaatatt

SEQ ID NO: 249597 - DNA, 887 bp, Homo sapiens
ttttagtagagacagggtttcaccatgttggcgaggctggtttcaaactcctgacctcatgtgatctgcccgcctcggcctcccaaagtgctggattacaggcatgagccactgtacccggccaaatgtgtagtatttttaataggataaagcctacataattctgtccacagttcctttacttagaaattgctcatttgttcatgttaatcctatgtttattacaaataacagcatacaggtttccaccccccccccaccccatcatgtacagctgaatcacgtagaatttgaagatcaagatgatgaagccagagttcagtatgagggttttcgacctgggatgtatgtccgcgttgagattgaaaatgttccctgtgaatttgtgcagaactttgacccccattaccccattatcctgggtggcttgggcaacagtgagggaaatgttggacacgtgcagatgcgtctgaagaaacatcgctggtataagaaaatcctcaagtcccaagatccaatcatattttctgtagggtggaggaggtttcagaccatcctgctctattatatcgaagaccacaatggaagacaaaggcttctaaagtatacgccacagcacatccattgtggagcagccttttggggtaaaatatgattacaataacttgcctattgccgagattaaactttacaggctgtgttattttagctttgtgcttttcctttcataaaattccactcctaagatgtttctcttttctgggagcggggaggtggtttggagtatatatgtacatctatatccaaatctaagtgtccatatccagtatgttaaactagaatctaaaatttctggtttgctatatttctttttttccttttccttt

SEQ ID NO: 249598 - DNA, 531 bp, Homo sapiens
ttttagtagagacagggtttcaccatgttggcgaggctggtttcaaactcctgacctcatgtgatctgcccgcctcggcctcccaaagtgctggattacaggcatgagccactgtacccggccaaatgtgtagtatttttaataggataaagcctacataattctgtccacagttcctttacttagaaattgctcatttgttcatgttaatcctatgtttattacaaataacagcatacaggtttccaccccccccccaccccatcatgtacagctgaatcacgtagaatttgaagatcaagatgatgaagccagagttcagtatgagggttttcgacctgggatgtatgtccgcgttgagattgaaaatgttccctgtgaatttgtgcagaactttgacccccattaccccattatcctgggtggcttgggcaacagtgagggaaatgttggacacgtgcaggtgggtccctttgctgcgtatttggtgcctgaggctctgtggatttcccctccatcaatcatcttacc

SEQ ID NO: 249599 - DNA, 537 bp, Homo sapiens
ggccacattctctgggcattcagaagccaggatttcataggccatgaaatctgctgtcttttagaagtgggctccggtctgctttctctacacaagttcaaattttccaccatttccaggagcctgcagctaacacaagtgaatgagtgatttcctcgtcattgaccccataaactcagatacttgtaaaagagaagttaacttacagagcatataaaaatcagaaaaaaacgggaagagcctacggacagtccggtacagctgtgtatggatcacccattggaacaagcatttctttaggcttccaaggctgttggaggaccctaagagggaagaaaatggtttagctggagatggtttgggtgcagactttccagaaggcagtaccagtgaccagaaggtggacagacttcaattccagccccaagagcacaggcagggagaaatgctctctaagaaggagggtctgcccttgagattctttgtctgcaacagctttgcatcttccaccagtaaaaactttgttcccattttaga

SEQ ID NO: 249600 - DNA, 446 bp, Homo sapiens
  misc_feature (446)..(446): n is a, c, g, or t
tgaggatacagcagtgaataaaaattcttgtcttcttggatcttgcttactataccagatggtgataagtgctttaaaaaattaataaagactcagagggtgatgagagttcagtgggattgcaatttttaacaagactgtcagagaagttttcaccgaaatggtaacatttgagcaaacacctgaaagaagagtgagccatgaaaattcatgagggaaggtggtctcagacagagtttgatagtaatgctgtccttgctgtagtcactaaaggattcaggctgaggaatgttccgtcttgacacatgctttgattacagagctgagacaaaaaagagtactgaatcttctgacactcttaaaacttcttcctgaaaatggtatgactgattttccctattttgtgcttctcagaagttggtggtgtgggcctttgctctggctgn

SEQ ID NO: 249601 - DNA, 581 bp, Homo sapiens
gagcattcaggatgtttgttagggagcactttctgggccaatatctgtaaaaggaatacctccctctccctgggcagagggagaagttgagttgcaatgcaggtccaacagcctgagcagactacagggaaagcactggaggggaacagcccatcagaatcgtcctgcctccatccattgaaaacttaacagtctagaaaaataacagaatacttatgtccattatctgtaatctaaaatcatgaattcttagatttcaaagcaaccctagaaattaaacccaggatactttttatacaagtagaaattgaaactcagaattaatttcccaaggaaattaattgcccaaggtctctgagcagccagatagtatgactagatctcaaatctggaattctagattctcgatccaggtttctttgcacagtaccacgctatttttgattaatagttttgagtcttgcttgtattacatattacataaaatttacaataaggcactgggctcttttgctttgactacttgtatctgtcctttctggaataaaatgcagattttagacctagttacatctagaaat

SEQ ID NO: 249602 - DNA, 237 bp, Homo sapiens
tattgcattatcaagacacctgcatgctatgaatgttttaagcagcttttaccaagaaagtcacgttagattttatgagtagtctccttttcgtgtgctgtcatgagtatattgtttgtacaaatgttaacttttgactgtattatttcttttgaacacagaaagctgttcaggggaaattgcctatgtttactttcttgcatattcatatttggtagctctttaccatactgttac

SEQ ID NO: 249603 - DNA, 208 bp, Homo sapiens
agcaccatcccacattgctcttctaatggagcctttcaccccagatgttctttctcgtctgatgggaaggatccaagttctcattctgtcacccaggctggaatgcagtagcttcatcttggctcactgcagtcctgacctccagggctcaagggatcctcccgcttcatcccccaagcagctgggactacaggtgtgcaccaccatg

SEQ ID NO: 249604 - DNA, 410 bp, Homo sapiens
aattttttttctttcttagaagaaaaatatttaaaaaaaaatagatctggcctctggcttgctacccagccttggaggagtctgggaagtctagacaatgtcctaggagccagagccagctctgcagtcatttgtgaatgaattatgtatcatatgcagccttttgaattcatactttgagcaaataccactttaaagggtcataaattacatcagattattatcctctaaattcatttaacagcacagaaatgaatatttgtcaagtctcttttatttctcattatttttcttattattggatgccttttctccctccccacccataatctctgtatctgttttgtatcaatctaccacacattaacatgaatgtgtttttttattaaagctacatgactaatgaaata

SEQ ID NO: 249605 - DNA, 419 bp, Homo sapiens
tcaagatgagttttattatgactcattataactaattccaacagttgatagaaatcatttaaagaattgtaatactgtttggtaatatgttatgtggaaacatagttaggaaatctttccacttcctcagtctggatttcaggaaatgaaagcccccccaatctccccccaaataattcaagctctgctgtgtaagttataggaaataccctcccctgccagctcatttcctcttattgttcaccttgaatggggccctcagctaccttttcatgcctccctctccctacagatgtatcaagcctggtaaaagccaagggcttccacaggaaaagagctaggtcagagatacccaaggccaccatgaagtccccttctgtaagagaatgtgaaggggagtttgagaaaagccagaattt

SEQ ID NO: 249606 - DNA, 448 bp, Homo sapiens
ccttgttccatatttttgtatgcagtataacttacagatggtaaacaatatacagcttgatgtattctgacatgtaatgcagtatgtaaccaccacctggatcaagatatggagcatttctggcacttcagaaggttccttcatatctttttccaatcaatattgcctcaaaagggaaaccatatttggatttctatcaccataaataacctttgcctgccttgagcctcgtataaatggagcatatagcatgtatgcctttatgtctagttttttctgtgcaacatatttttaatattcactggtcttgttgcatgtgtcagacatttatttctttttattgctgtgtaatattctagtatttgcttatccatccatatgttgagggacatttgtttccagtttttggatatcataaataaagctgctgtgcacattgttatacatg

SEQ ID NO: 249607 - DNA, 150 bp, Homo sapiens
ctgtagaattcaagaagagttctacatatctgtgttgcatatttgctttgtcttttgacatagctgccacagcatcttcatgagttgcgaactcgacatctgcttcaccagttactctgccatcaggaccaatttcaatgtgtactctca

SEQ ID NO: 249608 - DNA, 421 bp, Homo sapiens
cgagaaactttgtaaatgttataaacaataaaatttcattttaatattagtgagaaacaactgcagaaaggaaatcggtaaacaatgtctcggcacactggtttccctaagagtttaactccgcctcatgtaaaagggggttgagctgaatgtagcatgtattaaatgaggatcaataaagtccacgtaatgagagtcagatgcctgaacactttccatgtttggaagttaatgctttccttttgagttaaatgtgtaatgacttcgaagaaacatgtacacaggttttggaaacctaattgttaattactatttttcatagtttgtgccacagaagacaaaagtaaatgaataaatgtcataattcaaatgtcatctaataagcagcattattcataattgccaaaaagtggaaacaacg

SEQ ID NO: 249609 - DNA, 505 bp, Homo sapiens
atggagtcttctttggtttccctcctggaggagatagagttaatctttggcgagccagtgatcttcaaggggcggccctacctggacaagatgaagagtgacaaagtggagatgctctattggctgcaacagcagcggcgggttcgccacctggtctcggccctgaaggatccccaccagtcaaccctgttcaggagctcagcagccagcctttagtagctcctgggaatacccctattactccttgaccaggcccagtgccctcaaatgcctccctcacccctaaatggccagcagctcatctagacctctttactgctttggaagaagaaatatttgtctatatctgggagtggagggttcaggaacattatgcttccaactatgaagggattgagactaaaactattgttttcttagtgaaattctcatgaaagaatccccaagcctagtagtcccattatgtcaagccttgcacaatacaagccaaatctcctatatcaaa

SEQ ID NO: 249610 - DNA, 450 bp, Homo sapiens
ggtgaaagctgaatctgagaggcttctgtttccagcaataaggccaataataccccaagctcctgactgaaaccaaacactctggagggacactctcacatgcaggccagaaggaatttgaatagaaggaaacaggctaaagaagagagctcatggcaaaaattacaaaccatacaaggaaggcattcaccacagtgagagtgcaatgtggatgaaatgctcaaatgccaccagccaacatggaccataaattaaatttggaatggaagccacacatgacatgggaacaagatggaaaactttaggttatcattgggatttcctggcttttccaatcaacctatggcctctaacaagctcacaaaacagcaggctgaagctatgttcatctaaaagcaaaacatttggtcaattaaaccaatttaataaaaaaactgaatttattggaaa

SEQ ID NO: 249611 - DNA, 416 bp, Homo sapiens
ggtgaaagctgaatctgagaggcttctgtttccagcaataaggccaataataccccaagctcctgactgaaaccaaacactctggagggacactctcacatgcaggccagaaggaatttgaatagaaggaaacaggctaaagaagagagctcatggcaaaaattacaaaccatacaaggaaggcattcaccacagtgagaccaacatggaccataaattaaatttggaatggaagccacacatgacatgggaacaagatggaaaactttaggttatcattgggatttcctggcttttccaatcaacctatggcctctaacaagctcacaaaacagcaggctgaagctatgttcatctaaaagcaaaacatttggtcaattaaaccaatttaataaaaaaactgaatttattggaaa

SEQ ID NO: 249612 - DNA, 501 bp, Homo sapiens
agttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacagagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctgga

SEQ ID NO: 249613 - DNA, 633 bp, Homo sapiens
agttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacagagaacagcagaaaggtgtccaacccttaacatttgggtaatgtggtccaccctccctcccaggcaacaaactgcttgaggctggcagctcctgtttctgaagaccaatgaggagatggctgcagatgtcaaggtgagacatggtggggcctgagctaaggcctgtcaagcaaggaagggagcacaggtgagaggccagacagctgaataagcaaaattgagccatgcgggggtgggaagaaggtggggttgagcatgaggttgaaaaatataaaccaaaacaggtttagcttgggcatctaggtggacagtggagctattcatattgatttggagcctgtggtgtggggatggggacaagaactctgaactgttgggtgattttttaagttttataaataaatagcatttttatttgtttt

SEQ ID NO: 249614 - DNA, 923 bp, Homo sapiens
cccatctggacctcctctcccactccttactcccagctcctgagccaccctaggttcctccccaagagaacaggtgctttcacactacatgtctttgcacatgctgtttccactgcttcaaatgccctttcttgtctcctaccagacaaattcctattcatctttaaatggcccacattcaaatctcatctcctgtgggaaactcttcttgagtccctctctcaaacactattagttgcttcttaatctgcaaggaatctcataattccacaaacacacataataatacttttaatattttattgcaggggtgtgagtgtgtgtgtctgtgtctaatctctctcactaaaccatgagcacctttaggacaggaactgtgtctcattcatctttttctccccagggtctagaacttcgcctgatacgtggtaggtcctctatacctgttggctcactgaaggcatgagccttagttcacccatctgtagtagggggattggaccatatgctgttaaagtaatgctatggaattctatgtttttacagagagctcgaacaagaggcccagccaggtgatgctttgtgtgtgcaatgcagaggggaagtgtgttgatggattgaaatttggctgcatcaccatttcaaaacagtgggcaaaagaggcacattggctcttttgaactttaagtagctgtcctaatatcttgtttcaccaccttaaagaatatttactatatatgtgaatgaatccataaacaatataaagtcaagtttaatagttgttttgttttttagcttatgtgactgttttagagatacatttgtgttaataacataagaagttagtttgtgtattcttgtataggtggacattacttggcatatgataatgagccttagtgccctgttggaccaaaaaaaaa

SEQ ID NO: 249615 - DNA, 703 bp, Homo sapiens
ctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggcgcctcagcagccggctgcaggccagagagggcctcgggaagagatgcgaggatgacaaggttcacactacagaaacaacatatcgtatcagatcgcagacatacatcatctcacggagcaaactgctcgagcttccgccggcattcctcgccaccaagaccacctttcacgcctatcggacgaacacactacacttgtgagagtcgtacactctgcacgcttcggggacacacatccggatggccagccagtgaccactctctccactctcgcaccgctccacaccaccccagcccagcccctgcccgcctgcccccccca

SEQ ID NO: 249616 - DNA, 654 bp, Homo sapiens
ctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggcgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatatt

SEQ ID NO: 249617 - DNA, 908 bp, Homo sapiens
ggagttttcttcatgactctttacagtacaagttttttgtttttgtttttttaatggtcagatggatagaacaacacaggttttgtttgttttgttttaacttttaaaaaaattataatagataaagggtctcactacgttgtccaggctgaggtgggaggattgcttgagcccaagagttcaagaccagcctaggtaacacagtaagaccccatctctacaaaaagtagaaaaattagcctgtcgccagggtggagtgcagtggcgcgatcagctcactgcaacctccgcttcctgggttcaagccattctcctgcctcagcctcccaagtagcgcggattacaggcatgtgccaccacctccggctatttttttttctatttagtagagatggggtttcaccatgttagtcttgaggtcaggaatttgagaccaggctgggcagcatggtgaaaccccgtctctacaaaaaatacaaaaattagccgggtgtggtgtcacgcacctgtattcccaagctactcaggaagctaaggcaggagaatcacttgaacccagaggtggaggtttgcagtgagttgagattgtgccattgcactccagcctgggcgacagagtgagactctggtgccaaaaaaaaagaaacacacaggacacaacacaaaactttttcgcggcacgctataagcccttcgaagaaaagtcttcaaacaccatccattagcgcagccgggcccccagagacggacgtgaaaacttggtgcacaaatcaagcccacagaagtagaccgcgagaaacaagcaacaggccgaggatcccccacaataaaagaccccggggacaccgcagtctctccgacactcccagggtgtccaagcgactacgcggggctctcaaccacgagag

SEQ ID NO: 249618 - DNA, 446 bp, Homo sapiens
catctctaaatttcctacatccatatggccaccatgaggccccaggctggccgatggttgctgttagcttattgggaaatcactgtttggaaggtgctggttgttttttgttgtttgttgtttttgtttttgtttttgttttgagacggagttagcctgtcgccagggtggagtgcagtggcgcgatcagctcactgcaacctccgcttcctgggttcaagccattctcctgcctcagcctcccaagtagcgcggattacaggcatgtgccaccacctccggctatttttttttctatttagtagagatggggtttcaccatgttagtcaggctggtcatgaactcttgacctcaggtgatccacccgcctcggcctcccaaagtgctgggattacaggcgtgcactgctgcacccagcctttttttgtttttttgagacagggtc

SEQ ID NO: 249619 - DNA, 590 bp, Homo sapiens
agggacccccttcacccatgcatcctctgcgacccctctacctctctcttcagacatttctgggttgcatggacctttaatcacaagttcatttggggatggaaacaatgcatattgtgcagtattaagacaggctgcatttactaacaagatatttatgttgtttgtagaggatttcctatccccaggacctggcccaggctgagagaagctgtgtggagtggaagatggacattgaggaagaagggcaggtgtggtctcacccagaatggttcctgctgcttccgcggtgcccaggcttttctcacggcctctgctgggttctcccctgggtgctgtggatgcatcctgcctgctggaaattctgtgctctctgtttccatccctttgtcgtggtaatgaccgtatacctctcccctgtaccctcctctgcctgctctccgtgcaggcccctctccctctggttgtcccatcagcatttccccacagctcgttgttcctccttcctcttttctggtgacctttctactgattgcattgtacctctttccctgatattaaagatgtttttaaaaacaacagacccatta

SEQ ID NO: 249620 - DNA, 1008 bp, Homo sapiens
tcagtgtattggctgggttctgaggagaaatttatcactcatgtcagtgtatgtgtatattgcagttcagagtgttgcttgcttaccttaataaaacaatgaggcataggtataaatgaaggaacatgcaggtcagctgtcagtgcatgagtggactgaatgctatgaaattgcatacttttctgttggatgtttcatgggagagactttgcttagaagttagctgagtaatcatgtgatcttggtatgagtgttaagcattcagcatggctttgagtctgaacaaaagagcaaacaagccctggtgagatgaagaagggagcaggagcctggagatgcctgaagatgttggtgagaatcacaacctggagtgcatgggggtggtctcctcaccaacccttggcacagtgggtttcatcttcaccttgaaggagagcaggccagacaagatctcagcacagcttcgcaactgcgtccaccctctcttctcttctaagagttcacttggaaggcttggcaaaactcagctctcaggtcacttctggcttccaacattctataaatgctctcagaaaacaaaagtccaagaggatttcctatccccaggacctggcccaggctgagagaagctgtgtggagtggaagatggacattgaggaagaagggcaggtgtggtctcacccagaatggttcctgctgcttccgcggtgcccaggcttttctcacggcctctgctgggttctcccctgggtgctgtggatgcatcctgcctgctggaaattctgtgctctctgtttccatccctttgtcgtggtaatgaccgtatacctctcccctgtaccctcctctgcctgctctccgtgcaggcccctctccctctggttgtcccatcagcatttccccacagctcgttgttcctccttcctcttttctggtgacctttctactgattgcattgtacctctttccctgatattaaagatgtttttaaaaacaacagacccatta

SEQ ID NO: 249621 - DNA, 1064 bp, Homo sapiens
tcagtgtattggctgggttctgaggagaaatttatcactcatgtcagtgtatgtgtatattgcagttcagagtgttgcttgcttaccttaataaaacaatgaggcataggtataaatgaaggaacatgcaggtcagctgtcagtgcatgagtggactgaatgctatgaaattgcatacttttctgttggatgtttcatgggagagactttgcttagaagttagctgagtaatcatgtgatcttggtatgagtgttaagcattcagcatggctttgagtctgaacaaaagagcaaacaagccctggtgagatgaagaagggagcaggagcctggagatgcctgaagatgttggtgagaatcacaacctggagtgcatgggggtggtctcctcaccaacccttggcacagtgggtttcatcttcaccttgaaggagagcaggccagacaagatctcagcacagcttcgcaactgcgtccaccctctcttctcttctaagagttcacttggaaggcttggcaaaactcagctctcaggtcacttctggcttccaacattctataaatgctctcagaaaacaaaagtccaagaggatttcctatccccaggacctggcccaggctgagagaagctgtgtggagtggaagatggacattgaggaagaagggcaggtgtggtctcacccagaatggttcctgctgcttccgcggtgcccaggcttttctcacggcctctgctgggttctcccctgggtgctgtggatgcatcctgcctgctggaaattctgtgctctctgtttccatccctttgtcgtggtaatgaccgtatacctctcccctgtaccctcctctgcctgctctccgtgcaggcccctctccctctggttgtcccatcagcatttccccacagctcgttgttcctccttcctcttttctggtgacctttctactgattgcattgtacctctttccctgatgggagcaagacgcgcgcatcttctcccatcagcattactaataagtggctcctttaacctctccacccttatcacaacacaagaacacct

SEQ ID NO: 249622 - DNA, 569 bp, Homo sapiens
ccaaatggaaccaaggtaaggttgtgatcagcttaagacaaaagacatggtggctgcaaagtcaaaatgtttaatattgtcatatgacagtgaccataccctaggggaaataatgattgctcattgttgtagctgttgtagagacaatgttgacagcaccattcagtgttctctttagacagatccagagggagaaaaatcccctctattcttagtaccgagaatagtataactaatttcatgagcaattggatttttttttttttctgatgaacgctgcgtctgtttaactgatatggtctccctttttgtgttatctgctggaagaaggcttagagtgaaatgtataccttctctttaagtttacatgccttctctcattggttctgtaggagattttaccctattcctggctctgttttgtccctgcctctgtttttttgttatttctcccacttaaaaatgctaaactggggccatttcctctcagaagacccctctctctcactagagagagaactattttcctttctctttctcttgcctattaaacctccactcctaaacgc

SEQ ID NO: 249623 - DNA, 560 bp, Homo sapiens
gtgatcctggtatcatattttctgtattgaatttatttctccatgtgccagtttcactacactttccaaagtgctactaaatgcttagtttataaggttttaaaaaactcactgcataattactttaaaataatttcctcaaccctgccttcattcaaaatgtctggagacagactggcccacttccaattttctttcacgttatcattactgtgaagtcattctatagataggagagcattctggcatacagaaaaacagcatctgtgaaactatatggcacagtttggttggggttgttgctccttcagaaccgcattatgtaattttagtgtttacttaagctcctttgggctgcctccgtggtagctatgagctcacagagaagtaagtacagtttagatctgatagcaaagtctatcagtttatcctgaatgctgcatcctttttttgttgttgttgttaaatcattactgtatgagaaactttaaaaacaaaggtatagtttcttcattttattttttaaaaaagctacttcaaacatcattaagtaatacacc

SEQ ID NO: 249624 - DNA, 986 bp, Homo sapiens
gtatgttcctggcagaaaagttgcataacttgggggttaaagacaggaatatggcacaatgcccattgtgggcagtgtccagacagaagaagagactcatatcacctaaatgacaaacccagaatatgtcacaatgtatcctgttgaaaggaccagaaacgaggatgaattgccacatcatctggttctgagttctgagatattcacaagtccccttagaaaacaactcaggcaagagagttacatcacctaggagcccgttccacccttatgtcacagtgcttcatgtgtacaggactaagaagaaagtcacatcacctagatgatagacccagagacacgtcacaaagccttcctgaaagcatggccctggcaaaatagtacaatcacctttgtacctggtctagcaatatgtcattattcaagtgtgcaggtaccaaggagaggagccatactacctatgttatatgccctgtgctatgtcaaaatgccttcttttcagcatggccctggaagaatgtatcatctcacatgtgactggcctaggaagatgtcactatcctgccatgtgtgcagggcccattttagagattagagttatgtcttcttctaagtcatggacccagtgatatatcactatgatgtctgtgagaatgggcaggcaggaatgtaatgtcacttgcattctagatccagtgatgtcacaattcttactgagggcagagcccagtcagaagagtcatatcttttacaggttggcccaagtagatgtcaaaaacccctatggattagatttacaataccacacatctcttgttttcatgtaggagagttgcctgcattcatctgtgatgatgaaagtccttactgtcagccaagtgtgcatatgagactcacaatttcctctgtttgctaaccactattatgacactctctattcaacccaacggttttataaaacatttgtcattgttataaactttggt

SEQ ID NO: 249625 - DNA, 703 bp, Homo sapiens
catttcccacaccttctcacagttacatcaacaaaaaccccaggaggacgctgctggcgcgaacacgcacacacgcgcgcgcacacacgtacacgcacacacgaactctctctctcacacacacacacacacctctttcacctttgccccagcccctcaggcacctcgggccactcggcttcagcctcgcccctctgcgccaacagctagggatgcttccctcaagctgcgtcgctcccggtccgctgagttcctcattttagtgtttttcctttagaagacgccaactatgagaaaccctcaccctccaaagaggccgagtgcgtgttgagtgactctacgcatttgccgccacgcctcgggttccccccacggcctggagcatggggccggggcgctggtgtcaaccttcggtggaagtttgggaggctggctggatccttcttccacccgagaagcttctgggaaccgctgaggcgaaaccaccatcgcccggccagaccgctgcggcagggaacgagatgcggcgcccctgggccccgtagcggctgcagcccccgggacccccgctgcccgcctcgccccaacttcttcgcccggcgcccggcgcgcccagcctcggccgcagctcccagccccgggcgcccggccgagcgctgggacccggctcccgccgccggcacgtcccccggcagccactcgc

SEQ ID NO: 249626 - DNA, 405 bp, Homo sapiens
taacaatcttcaggcgggaaaagtttccaagaagttgtcttaaccaactaaaacctcatcttcctggtcttcatctgttcagcagttgcctatccaaagcctctgatttatctgactgttctactgatcaagggagcttaagaggcccatatgaataccatgttttagcagtttttttctcattaagtcatctggggagattcagctggtcacctcccaccacgagaaactttctaccatagcgcctcactcatctgtttctaacaagtgatgctcttgcgaacagtctctgagttttctaggcttagagggattgcgctggaaactaaattgggaactctcccaataacgctctctggataccacgacttagcttcagagggaggttctaggaaaagcaaaaaa

SEQ ID NO: 249627 - DNA, 932 bp, Homo sapiens
ggtgggttttttttccctccatttagatgtaggtgcctattctgcttatgtgcccagatgggttttcaaagcagtgatatccagacttcttttcatctgaaaaacaccgaaggccagatgtctacatggccttgcaggaagaagctgagcttcttctggaaagctgtagaaacaaaaaaaggcggtggagactgcaacacctgtgccatcctcctgggtccctgatagcccttaatgttttgtcattgggggggttgggatggcttttattttttggtgttccccaaaagttaatcctcagtctgttctctttttaatttacaatctttccctgggattccatcttctactgtcaccagttagagaaagcgaaggagtgagggggaatctaactctgcctctcttgcttcggaaactgaatgtatttattcatccaataaatatttatggagcattccttctgttctaggttttgttctgtatgccgaggaggtagagataactaagacattgaagtccttgttgtcatggagcttgacgtgtagtgagtggggaagcatttcagtaaacaagtaaacaaatcaatagatgagatcaagatagtgctgtgagctcggaaggatataatggtgatgtaaaagagagagtaacagggacctgagaggttagagaaggcctctgagaatgacgtttgaactgtgagctcaaggatgagaagaagccgttaatgtgcagatttggggaaagttcctttctggaaaagggaacagctgtcaaagctcctgaggtaggaaagagcttgacatgcagaaaggacacctaggaagtcatcattgttagaatgtagggagcaagggggtgtcggggtggaggatggtggcacaacttgggataaggtatggaaatttgagagggagagagaggaacattga

SEQ ID NO: 249628 - DNA, 337 bp, Homo sapiens
gtttttcttagcaaaggaaaccagcatagtgagagtaaaattatagttttcaacaggaaagggaaaagctctaatgttgcctgctgctcagtcatcacttctggaggaaggcctttcttgatcacctgtgtggtataggactatcattctgtatcctattaccctgcttgattgactgcgcgaggcttagtatttaaagatgtattattattttgtttattcatttattgtttgcctttctaactagaatgtaagctccatgagggtaagatcttttctgtatggtttactgctgtttggcacatggcaaaggctcaataaatattgattgattgaa

SEQ ID NO: 249629 - DNA, 652 bp, Homo sapiens
cagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaggacctagcaacacttatgaagatcctcgaatgaactgtggtttccagtccaattatcaccagcaaagaccttgctaccccttttgggatgagggcaactcaggaagttcctactggtcttgaacactgtgtctcagaattacaaggccagcttagcctgaagtcattgcttaaataacctgctaactggaatgtattgacatgaactgtcaacacggctgctcccttcaaccaattccaagctctttctcctcctaatgagaggcttcttgtgtgtcttgatttgtctgttatgcctcttaacattgctcacagtctcaattggatcagaaaacagctttttctagaccacagaatgtatgctattctctgaaatcctaagctcttaagatctctacagtctgtttacccaatgtattgaattcttgtacccaatatctcatgataatgttcatttatgatacatatttcttctcttcttactatttgaataaattatattgactat

SEQ ID NO: 249630 - DNA, 654 bp, Homo sapiens
cagactttgagggaagctcactcaggatctgctctccggcaaagtagtaagtgaggtgctgagagcagaatgagctactttgtggattctgctgggagcagccccgtcccttactcagcgcctcgtcctgcagtggtgtgaaatacggacagataagtttattttatttatttttttctttttcttttttttttttctgtcactcaggctggagtgcagtggcacaatcttggctcactccaacctctatcttctgggttcaagcaattctcctgccttagcctcccaagtagctgggattacagacctgcaccaccacgcctggctaatttttgtatttttagtagagaaggggtttcaccatgttggccaggctggtctcgaactcatgacctcaagtgatctttctttgagatggtctcgctctgttgcccaggctggagtgcagtggtttgatctctgctcactgcaacctgtgcctcccgtgttcaagcgattctcctgcctcagcctcccgagtggctgggattacaggtgcccaccaccacgcccaaatgatgaaacccagtctctgctaaaaatacaaaaaaaattagccaggtgtggtggcacatgccttgtaatcccagctactcaggaggctgtggcatgaga

SEQ ID NO: 249631 - DNA, 348 bp, Homo sapiens
gtagaatcaactggacttggtgaataattataggaggtaaaaactgtgatttccagggttcttatttgtagaacactaaaaacagaagagggaatacataagaataattttaaaaagggaagggtgattagttcattattggttatgctgagtttgtggtatttgctgtatatttaaatggagcaacataggcacatagtgctcaggaaaatgatctgtgcttgacatataaaattaggaacattactattttggtaaccattgaaaccacagaacacataactaaaggaaaaaggtttagaatataagtcccagagtccccaacacttaaaggtacaaaataaataa

SEQ ID NO: 249632 - DNA, 466 bp, Homo sapiens
tctggtggccttaagtgaggcagggaaggcttacccgaatccctgaggtgagcactccatctcgccctgatgtctgcctggtctgtgatggcgtcctggccttcccgcaagccttggtcgggggctgacctttcaccagatgaaatggaccccttcagtggttgaggaagagagagacttacccctgccttctgtagcctgtcattagggggcagtcagcagcctagggacatgcaaaggtttctagccctttaactcttgattctcaactccttccttccccggctctcccccaggtatcttatgagcaggggaggcttctagtgtgaagctagctcctccacagctttaagataaagtttcatcactggttggcactctccttccagttgtttgttaccatattctcatctgtaagagatatattttaaagccccagcaaggaaagaattgttgggccttgctc

SEQ ID NO: 249633 - DNA, 348 bp, Homo sapiens
gaggtcaggagctctagaccagcctggcccacatggtgaaatcccatctctactaaaagtacaaaaaattagctgggcatggtggcaggtgcctataatcccagctacttgggaggctgaggcaggagaatcacttgaacccgggaggcagaggttgcagtgagcggagatcacaccactgcactccagcctgggcaacaagagcaaaactccgtctcaaaaaaaacaaaaaaacaaaaaaattttgggttattttaggggacagaaggacaggaagggggttcattccttaaaaatctatttgtgtctccaacagaaatatggtgcaaggcatgtagatagccttac

SEQ ID NO: 249634 - DNA, 357 bp, Homo sapiens
cagagaacaagacagagatcttggagaacaagaatatgaccatcaatagaaggatgggaagataacggccaaacggtagacgaacacaacatgggattccattcttgtcctgagaaactccctaggcattggaatatagaagatgagctagcctatcctgactgaaacagcatctcttggaattcagggactttcttcatccctgactacatgcatcagacttaattagatgcacaaaatctggatgactttcacaacactaaagtaattttactttctaattcataatatttgctgattcatattattacttttgttataatagaaataaattgaatactgcatcctgtaaaataa

SEQ ID NO: 249635 - DNA, 473 bp, Homo sapiens
cggggggaggggggttgaggtcggcatattttagcaatcagaccaaagcagctcggcagatgtttcaaatttgtcgacattttcaggctcatgtggaaagccagccagagtggtcaagaggtcctttctccttccttcaacctgagaacttggcagtgatcaaaaggaggtgattagtagctacagagaaaaaacaccagcaggcaaggagttaacagagactgagccgttcacctccaggattgggatttggcggggagggggggcggtcacaaaggcaagaggaatcctggctaaacaggcgcaagtcgtggaagccaactctgaagaacaaagtggagggtccgttaaaagttaattcagtaaataaacttcattggtgataaaacaaataagaaagatggaaactccaacttaaaatagccaaaagataagaaaaataaatcgcttttatgtggcctgaacatgtgcat

SEQ ID NO: 249636 - DNA, 322 bp, Homo sapiens
gaattaagtggcaattcaatttcagggctgggtgtacttcagaggctgcttcacactattaggattcataacctgagcgcctcctgctcagcatctccagccagagtgcaggaatgtcccttagccgagggggaggcctgcatgagacaggctggacatggacttggttattgttgcagctgggtaatgagcacatgaggacttatcctattctgtttacttttgtgtgtgttagaaattttccatggcgaaaagataaaatatacaaatatcccaggtcagttccatttttactttgggctgagcactaagggaggattta

SEQ ID NO: 249637 - DNA, 89 bp, Homo sapiens
aaaccaggctaagaagccctaggagcccttgtggctctgcagtcatgctctggtttttaagtaaatgtcttttggaaacttaggagcca

SEQ ID NO: 249638 - DNA, 460 bp, Homo sapiens
cagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggccctggagaaatgcagagatgcaggtttaaccaggtccatcagggtgtccagtttcaatcactaactgctggaactgatcctcagacaagccaggactcaagtacaagcccacctacaaccagatgagcccttagggccactggggccatttctgactttgtgctcttcacatacttccttacattagaataatgtaattgttcagtatgttgtgctttaattttttaagaaaatgtcaaaggctagccatgacacggttatgtgtatttcttttaacttttccataaatattaaataatgtaattgttcaga

SEQ ID NO: 249639 - DNA, 468 bp, Homo sapiens
atatatatatatatatatatatatatatattttatgaatctgtgttgtatgatttacattgtctttttttggggagcaggggcaagagctagttagaaaactgagctcgccctgtctctaatgtctggtgagctgctctcctctctctacaatatatcacgggtagtttcatgtcaacaaacattcttaaaaacatgattgaggccaggtgcggtggctcacatctataatcctagcactttgggaggccgaggtatgaggatcacttgaggccaggagttcaagacccccattgctacaaaaaaataagaaattagccaggcatggtggtgtgtgcctgtagtcccagctacttaggaggtcaaggctggaggattgcttgagccagcaagttcaaggctgcagtgagctatgatcacaccactgcactccagcctgggtgacagagcaagaacctatcttgaaaaa

SEQ ID NO: 249640 - DNA, 362 bp, Homo sapiens
agcaagaggaaaaagtcatatgagtgattattgcaccttgatgacaagcccagacttctgttgtttgatcagaaattaggctgtccgtttgcagcaacatggatgcagctggaagccataatcctaagcaaattaatgcaggaatagaaaaccaacttctgcatcttttcacttataagtgggagctaaacattgagcacccatggacataaacatgagaaaaatagacactggagactactagaagggggagggtgaaaaaactacctattggatactatgctcgctacctgggtgatgggatcctgtattagtccattttcatactgctgtgaagaaatacccgagactgggtactttat

SEQ ID NO: 249641 - DNA, 568 bp, Homo sapiens
tgcggtgaactgtaaaatacgatcgtgacaagctccaaaacgaacatgggttgaactgtaaaatatgatatatgtgtatacttatacactttttttttttttttgagatgggagtctcgccctgtcgcccaggatggaggtgtgatctcagctcactgcaacctccgcctcctgggttcaagtgattctcctgcctcagcctcctgagtagctgagattacaggtgcctgccaccacacccggctaatttttgtattttcggtagagacgggttttcaccaggttggccaggctggtctcgaacacccaacctgaggtgatccgcccgcctctgcctcccaaagtgttgtgattacaggcgtgagccactgcacctggccccaagtaagtttgatgattcaaattctgtctttaaagcaggagaaaaggtgtatttgaggggtctttaccccatctcagaccgaattcttaactcctgtctccttgttgtacttgagcttttcttgttcctagtcacaagggaacggtcgcgacagacagccctctcctacttccgtgataaccgtag

SEQ ID NO: 249642 - DNA, 477 bp, Homo sapiens
catggctgatgagtgtgggtcgcaataactgatgcgtggccaaaggtgtttcccacaacagttggctttgattcaccgtgtatcttctgcactggctaccgtgtagttatgccttgcccttcatgggtcctgggattacttgactgctgccgaggctaacagcctcttttttattctgattgtgacccattatattagtctgttggccactgactcactagtacttggaagcaacccacagctatgttgtcacatccacgtattcccctcaacacgcagcaaattggggtgagaccaaggaaaggcccatgcacaaaggaacctgacagctgtcagcagtagcacctgaggccaattgtaaggcggtaatagcacacactcagaaaaccatacgccagcagtgtgtgtgcatcacaatgccgggagtgcacatattgtgggctcctcatcaacagggaactcatcctgcattgcttt

SEQ ID NO: 249643 - DNA, 136 bp, Homo sapiens
atgggagacagacaacatcacattctaatgcaaagtttgtaccagttaaatagtaagctaacatttgatcctctaatactcatgcggagggagaccaatacacaccaaacacttggtgcacctacatttttggaga

SEQ ID NO: 249644 - DNA, 412 bp, Homo sapiens
ctgcatgcatgcccagaaaagagctaagaaggcctgaatcactcacttctgactgaccttaaggatctgcacaaccaggaattgaaagctaagacagagctataaactgccaaaatagtaaaggcatgcccaacacttatagagccactcaacaaaggatggaaaacttactggttcagggcacttaaggaaatctctaatcatcagctgactgctaagctaactaagcagagacttcagtggccacacacaacaaagaatacaaattttacaaaatttttccagagaagtcattaaacaaagaataacaaacagcaacagaaaacccaggttggacgggtggtacaagaatataactttcaaagttactacattataattatttaaagtgtttaattttcagcaaaaaaaa

SEQ ID NO: 249645 - DNA, 683 bp, Homo sapiens
aatatcttcacacaggacatatcttccttggatggttcacccttgttaattgtggcaacttatttttgaaataacactctaccctcaaaaagaaagcagaatacccccatcataccccagaatgatctaagtgtacactacatgaatttctctgagtctgtttttaaaaattcactttaaaaaaagactggattagcccctgaatatggtgctttctaaagacagtacgggaacaaaaaatagcaagaccccagatagtaaaacaaacagctcaagattaaaattcctagagcaaacagttaagccaggatgccattatacacactgagcctggatgatgtctcctccaccgtggggccaagaggctgtcatttttcccccagcaagatcagatttccttccctcccgaccgcctctctgagcatcatggccaacatctctagtgtgctattaatatcaatgaagagacgattcgatttccacagaagaaaacctttcctattccggcacagaccttcggggaggaccctggcccgggtatagacaatacagcggcagagtttctgttttcttacagttcagtcttagacactgtttgaaggcttttagcaaacaatggcagcattatctgcaggatagttacaaaacaggatttgttaggacaaagaataataaagctgctc

SEQ ID NO: 249646 - DNA, 666 bp, Homo sapiens
atgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccctcgaagatgacagtggatgtcagcattaaagactttgacaggtctttctgtgaaa

SEQ ID NO: 249647 - DNA, 588 bp, Homo sapiens
gttgcctcaaaattaacagtaattagcctgaggtattgtaaatgtggcactacagtctgaaatttaatggcatcttttgtcaaaaatagtcttatctctactttaatctcatgactacaatactatgtgctatccctgtagtatttactactatgcagtcatacagaaaaaaattgttggaccttgtgaaatagtgcatccatctacttctataaaaataggagccacattggccaggcgcagtggctcacgcctgtaatcccagcactttgggaggctgaggcaggcagattacgaggtcgagagatcaagaccatcctggccaatatggtgaaaccccatctctactaaaaatacaaaaattagctgggcgtggtggcacgtgcctgtaatcccagctacttaggaggctgaggcaggagaatcgcttgaacccaggtggtggaggttgcagtgagctgagatcgcaccactgcactccagcctgggcaacagagagagactctatctccaaaaaaaaaatatttaatatatatataaaaaataataatatatataataatatatatagaagccacacaaagatca

SEQ ID NO: 249648 - DNA, 1817 bp, Homo sapiens
  misc_feature (726)..(726): n is a, c, g, or t
gtctctgattctctgacaccacctaggtgtcccctaatttggttcagttctgacactagcttttcagggttcgtgccggcctcacaagttttgagggctaagtcccacaagaccatccccatttccgtcaccagttgcatgtcctaagccacctgtacttctgatcaactggctgtaaattggggttcccatgacctcacttcaggttccataatttgccaggacaactcacagaactcagaaaggcactttgcttattgttagtggttcctataaagctaggttgtccaacccgcggtccaggatggctttgaatacggcccaacacaaatacttaaactttcttaaaacatgatgagttttttttgaaattttctttttctcatcagctgcagttaatgttagtgtattttatgtatggcccaagatgattcttacagtgtgtgtggcccagggaagccaaaagattggacacccctgttttaaaggatgcaacttaggaacagcccaaaggaagtgacacacgggacgaggggtgggagtccccatgccccctgggggagacacctcctagtgcaccatcccaatgagttcatgacgtggaggctccccacatcccatttttcaagagtttttgcagcccagtctcctggccccccacccctcccagaggttggggtgtagggggtgcagaaagttcccactctctaatcacacgttttgtcnttctggcaatgaccagctcccctccaggctatctaggggcaccccccaaccccactggtcacctcattagcataagctcaggtgtggtgcactggggctctctatgaatcactaagggcactcttgttgctcagtaaataccaagggctttaggagctctatgccagaaaccagggaccaagaccagagatcttttttattatccacctgggcagccctgtcagcctgctgccccgccccacccctcccctccccatccccagctggctgcgccctatttaaagccctcctctcagtaaaacagctgatgcgtgcctattttacattcttttctaccctgggtctgacgaatcatgactctcactgtgctggtaactcccccgttcttgcttctcaggaagcaaatgtaggaaaaatatagtaacatttctaaggaagcttagagatacaaaatgtttaaatgtagcacaaaaattgtgactctacttataataacgtacagaagaataactccacagtagaagttaggcatccatggctgcaggttttctaagaaatgggacgtgtgggtgacctactgcactgcccactgccctctggagggaaccatggggtaattagagtcattggccaagaagggccaggggtccacgcagcttccgccctgaggagttgcactgtgcagtacagccaggcggccacaggagccactgtggcagggaatgcatgtgtcagtgtgtcaggcgtggtcagtaaaaggagttgtagaaggtaaaccggagaaaaactcagattttaatccctcggagtaatctttggcctctcctccttccgtgtgtgatgtttctttgtttttaattttttgaccttctgctttttgattcgggattttggagccagaatgccttggccccgccatgaggtctgacttgtgctggctactttacccttggtgcctccatttccttcactggaaaatgggtgattgtgcagagtacagtgagtcaaaccattgagagtggtgcctggcacacagcattatttaagtatttttgcacttaatttcatgtaacataaagcactaataagta

SEQ ID NO: 249649 - DNA, 438 bp, Homo sapiens
ctcaacaaactagatatcaaaagaatatacctcagtaagagccacctatgacaaatccacccaccaccaacatcttactgaataggcaaaaactgggagcattccccttgagaagagaactggaataagacaaggatgcccactcgcattacacctattcaacatagtactggaatactttgccagagcaatcaggcaagaaaaagaaataaaaggcatctaaataggaaaagaaaaagtcaaattatctctcttcactgatgatacaattctacacctagaaaactctaaagactaaaccaaaaggctcctggaactaataaaagacttcagtaaagtttcaggatacaaaatcaatgtacaaaaatcagtaggattcaataacattcaagttgagagccaaatcaagaatgcaattccatttacaatggccacaaa

SEQ ID NO: 249650 - DNA, 1531 bp, Homo sapiens
gggaacccccggccggcctgcgcgcccctcctccgggggtctccccgccttcttcccgccaccatccaatcaaatcgggcgaggggcgcgaagcccgggagacgcgtaggccgcggccccaggcccggtgtttgacgtcggcggctgcccgcgttccgcgccgagtaacggtcttcggaattcagagccttcgccttagggaaggtgggacggtcgccagtttctccagcactttcttcgtccagggacgtcaacctcccttgcatgctgtcctcagggactgacagcggggcctgctcagaagttctcgtcgggactctctacaggcctttgtgattaagtgctaggggtgaggagagacgtggcttatttatgtgtttttcagtttgttatgattttttttttttaattttacttctccctgccctagaattgagctccttgagagtaaaaacccgcctgggtcgccatcaccctaggcttggtgcagggcctgccaggcgctcgaatttgttgaagaggtgggtgttcagtatcgaaagagccgcggattgtacattagaaagcctggctttgcgccgcgtccttgccacttgctgaccaggcccctccacgtggtccccgccggggcagcagctctcctcacccgtccaaaggcacggggaggcgcgtggcggccccgccagagctgagccccctgggatgtgaggccgtctcgctctgagcttcagagcagggttgcaggagacacctcagaaggtcgttttgaggacgggaggagatgaactgctcaaagcctgcttaactagataaatggtatcgattaacttttctttgactccctttccacacctataaaatgaagatgacgggaaacttgtcatactttttttgtggtgggtgggaaaggtctttatgaactgtgaagtcctatgcaaacgtgagatgtttcctttcgcaatctgattagcgaagcaaaaacacgcgagtcaaaaacatacacagaaagcaaaaaaaaaaaattcacaaaatggtttatcaactgcagaatattcaggatggtggaactgaatggtaactactgacaacatagctcagaaaggacgtgctaaaacatgctggatgaagctaactttgatccaggtcttaaatggaatggactatagtttatagcttcaacctaatcattaacttatgaaatcagagaattaaggccacttaagccactgtgctcagactgtcaagatatttagtttctcaaagcagaaagaggaaattaaatactcttgtcaattcaacatatgggttggatgattagcaggatccgtggattgttgtttatccagtatgtgaagaaacggatatcctctgttttctcgttattacacaaacttctatccttaatatgtgacctttcaaggttgaactctaggtaaaattatgaagtgcacaattacgtcttgtttcttcttccctttgcacgtcgttttacaagagaatctaattattattaaagtacaaatgactgaca

SEQ ID NO: 249651 - DNA, 431 bp, Homo sapiens
atacttttgttccatgttttggcttttacgacggtccccaaattaagcaaaggcatttttcttagctgagctaacaatgattctctagatacttgcttatctaacttgtaaatcccctgccactcatttgttatttgtcagcaatcccctatcagatgaaatttcatcccactcgtgctgttgagcacattgatgtgcccagttgggaatcaagcccagtcgcggaactgtaggtgcttttttggttggcccatttatctctttcctcgttgtccaccagccacttaattcactgtccttgttccagcacaccatatggaatgaccttgcccatccccatttgccacaccaccatgaaataaactggaggaaaaagcagtaatcttctcatctttcgagaggaagctttctatctgggaacatttgaggct

SEQ ID NO: 249652 - DNA, 682 bp, Homo sapiens
aagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaactgtctttctctgtctttctttaacccttgccttgccttcaaaatctaacaatagctctacctctccattttaccaaggaggatatgagactcaaggagagcaagagacttacccagaattacagagccagtgagtcacagaacttgaacttgagctcagttcagctgaatccagaactcatgtcttcctgagagtccagggaaggaaaggtggaactgcagccagtgggtgcccacaggcttgtcctaggagaccacatgcagcctcctgggaattgtgtcctcttgggcacaaaagaagaactgttcacctgtgctgcatcagctaagtgtccccattgtcccaaattgttgtattttttcaaagtttcattttagtaactagatttctcacagctcagtgttgaaaacaaagcacagaggcatatagaaa

SEQ ID NO: 249653 - DNA, 550 bp, Homo sapiens
ggtggggcgatctcacattttaagcaagacgcccgctgccttaccaaaatagccctctccgccaaaggaggggcagcctttcacgctcagcttctttcatgtcagcccgagcctttgcagcaagacgtgcctttcctacatgttacattttaatgatctgagaaaaccgttatcagcgttaacatctctaattttactctaaacagacaaaagcaaaatatctcattaggcatcatctccgccaaggttcccactaggcaggaaaggatttttatctaaagtaattaccctttttagttaaatacactcaacagatgaaatttacagagagtgagagactgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccg

SEQ ID NO: 249654 - DNA, 439 bp, Homo sapiens
tgtggctctgaccctcttctgcttatccattcctggtagtatctgcgaggttgcctcgtttgttccacttgtttcctggaagcttgttgtgtaattttatttcccaggatctttgggattctattctcactagaccagtcactgtccactggccctgtacttatcttgcgggagcccccatgttcatcctttccagtggagctaggaagaattctagttacttctaaatcttctaattctgatgctgttgggccatttattaagctgggaattttgtctttgggctcatggacattattccaaaggttgtcttgtctttgggctcatgaacattattccaaaggttgcagtgagccgagatcacaccattgcactccagcctggggtacaagagcgagacttcatctcaaaaaaaataaataaataaataaataaaaaa

SEQ ID NO: 249655 - DNA, 339 bp, Homo sapiens
atgcatgacaattaagccagagctttaagggatgggaagtggccagtggctttcttctgtgctgattaatggaaatcaaatagacctagtgggctgagagcctgactgtaaagttagatgcttattttcaagtactgttcattgtctctttgaagccgtttgagtttagggcgagtttagggcaagaaatgatttcaagcccctgaggatagttgtctcccttacctagccggtccatactggctcatctgtagggccaaaacagggtacaaaaatatctatggaatttgccagtttaagtcccaaagtatcagcacactaagatctgaaacaacgtca

SEQ ID NO: 249656 - DNA, 954 bp, Homo sapiens
agtatacagattataagtattcagcttgatgaattgtcacaaagtgaacacatccatgtagtcaccatctgccacaataaatagatattatcagcagctccctctgatggttcacagggaatacatatgttcaactgtggtagatactgcctgtattagcttcctaggactcttgaaacaaagcaccagaaacactgtgggttacaacagaaacttattctccccggttctggaggttagaagtctgaaatcaaggtgttggcagggctaaaattcctccgaaggctctaggggagaatctcttctttttctcttccagcttctggtgactgttggcattccttgtggctgcacaactcctatctctgactctgtcttcacatggccttctcctctgtatccaccttctcctcttctgtgtcttctaaggacttgtcctacaagtgtgggtgagatttaaggcccacccacataatctaagatgatttcatctcaagatccttacagcaaagaccctcttgataaataagattgcattcacaagttctggggttagggcatagacatacctttctcagagtcactattcagcccaatgacactgccaaacagtttaaacattggaagagttggcactcccaccaacagtgtgtatgtgttctatttgatccataccttagacagcgtagatcagcttttaaatttcagacattcaggtgggtgtatagtagcatatcattgtggtgtgaatttgtttttccctaattaaaatcagattgagtactttgccatgggaaatatttttgaagtgcttatttaattctatgtcagttttctgttgatctgccctttttattattaatatagaggaattctttataaatcagtgatgcacgtccgttgttaagttcactgttttcaaataacttctgctgctccatgactttttcacta

SEQ ID NO: 249657 - DNA, 1069 bp, Homo sapiens
gctcatcctagtaaatagaaaagccaggattcaactccaggggctgggtgcagaactgctattcttcactgcttcaccaatcagcagctacccaaggcagaaaactttttcatccttggctccttcattctccctgtcaccccagatcccctctacatctagtcagagaataggtcctgtcaattccaacttctctatatggctcctctcaggcatgtgcccttaattggcctaattctctaatacaccttccctctacatgctcactccctcagatcattgctttatcacgtgttacctgggttgctattacataaagagcaatctttctaaaatgaggatcttatcacttcacttccacactaaaatgtttttcctggggaaccacactccttagcaatctgacccatcagaccttccaggctgtctcctgcctgctccctaaggctccagccacacagaattatcatgggcccacacacccaccaaatcctcccatgcctttgcccatgttgtctgggatgcccttctctcccttctgtctacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgcaaaaaaaaa

SEQ ID NO: 249658 - DNA, 335 bp, Homo sapiens
agagaaaaagagttacaattcagcttgtggtgtgtgatctgacatcaatgccaagcaatgctatttggttcctcctaaagattaggctgtggccaggcaaagaggctcatgcctgtaatctcaacactttgggaggccaaggtgcaaggatatttgaggccagaagttcaagaccagaatgtgcattttaatgtcattttgtatagaatgctactaacaatctatcattttgtatagattgtaccaatgatgtacatttttatactctgtctctaagataatggttcctttttaaaaaataaataaataaataatggttcttatcaagttattac

SEQ ID NO: 249659 - DNA, 345 bp, Homo sapiens
gtctacaaatatatgcaagccatttatgtagatatttataaaactaaaaaaattatgtgaatggagagatacagtatgttgatggataggatggcaatataataatgatcttagttgtcctgatattgctctgtagattaaatgtagttctagtcagaatcccaaaaggtggatcttggttttgcttttggtagaatataaaaggcaccaacgtggctgaatctcagaaatacaatgttgagcaaaataaatcacgaaaattgtgaaagaatgtgtacattgtgatttcatttttgtaacattctaaaatggtaaaactaagcaattggtaaaaaatatgaagaa

SEQ ID NO: 249660 - DNA, 369 bp, Homo sapiens
attatactttggctaccatttatggtttttcagcatttgggttgttatatttgaaaaatacttttagttgtttaatccttataaaaaccttttctaaataagaggctgggccgggcgcagtggctcatgccaggcgggtagatcacctgagatcaggagttcgagaccagcctggtcaacatgatgaaaccccatctctactaaaaatacaaaaaattagctgggtgtggtggcgggtgcctgtgattccagctactggggaggctgaggcaggagaagcgcttgaacctgggagttggaggttgcagtgagccaggatcgtgccactgcactccagtctgggcaacaattgcaaaactcttgtctcaa

SEQ ID NO: 249661 - DNA, 405 bp, Homo sapiens
gattctccagaatcatctggagaaatgttaagagctctacactggatggagagaaaaagtgcttggagagtgggagataagttgggggaaatgctgagatctttgtgtagtcatgatgaagcccacagacatgaaggtgtcagggagttctaatgaaggctgttggagccaaggatattaagaaatagtgagctctgattcttttgcttatccacatgattcagggactcctggataacgacagagttgttggtgaatgaggggacttaggtctttagatagccatgtttatgttttatctcttaagtgcttgaaaagtttaaaatgtaggtttaatagccaataaatatttcatacacagttagaattacactttaaccctgaagttcatttactttaagaaac

SEQ ID NO: 249662 - DNA, 503 bp, Homo sapiens
tcaaaaaaaaaagaaaaaaaaaaaaaagccttactggccgggcgcagtgactcaagcctgtaatccaagcagtttgggaggccgaggcaagcctcaggccagacctgaggtcaggagtttgagaccagcctggccaacatggtgaaaccccatctctactaaaaatacaaaattagctgggcatcgtggcctgtgcctgtaatcccagctacctgggaggctgaggcaaggcaggaggtggaagttgcagtcagcgagatcatgaacactgcactccatcctgggcaaaaagagcgaaattccatctcaataaataaataaataaataaataagtcttttccttttagacatccacactgaaatatttacaggtaaaatgacatgatatctggactttttagtaatgtggagatgagtgagtggcagtaatcttttttcatgactataaggtgatgttaatttttgaagcattctcctcaaaagcaagattaaaaaaaaaatt

SEQ ID NO: 249663 - DNA, 610 bp, Homo sapiens
tcttgctgctcagcagaccatgacctgtagttcacctataaaacagggaaattgaatgaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcagaagagttgtaaaaaaaaagcagaggaggggagatgggcacccccagtctttccatcctcctcattcgtctaggggcacccgaatcccctattccttatttcccctatcactcaggcactggcagggtcctttgcccactcctgttggccgctgcggctccaaagcgagctgggcagatgtgcctgagacaggtttgaccaggcaactgaaaagacatccctaagagaagacaaagcaaaggtatgaaaggaacacacgtccctgactgactaggaggaacagagctgcctgctatctggaacaacttcctcccagactaagtgagaaataaacttctgttttctatatg

SEQ ID NO: 249664 - DNA, 721 bp, Homo sapiens
gaactcctgaaccttaggtgatccgcccaccttggcctcccaaaatgctgggattacaggcgtgagccactgcacctggccttggaacaatttttgaggcccatgaatgcttctggtgaattgcagagcctgagagcagtcttacagaccactgatacacttaaaaaactatgtatacacttactttttaatttagcaatcccactttgggaatttatcccgaagacacacttccaacagtaagaaaatacatgtgtacaaggttattcacactgcagcattgattgtatcacaaaatattgggaaaaaacctaaatatccatatacataggaggctggttgaataaacagtgttatagccactcagtgcaatactagaactggtgcagtgcctcacacctgtaatcccagcactttgggaagctgaggcaggaggattgcttgagcccaggaattcaacaacagcctggccaacaaaataagacccatctctacaaaatataaaataattaaccaggtgtagtgatgcatgctgttagtcccagctacttgggaggctaaagcaagagagtcacttgagcccaggagattgaagctgccatgagctatgaatgctccactgccctccagcctaggcgatagggtgagactatctcaaaaataaaaagtgacattatgcagctgtaaaaaagaatgaggaaaatgtctattcattgatatg

SEQ ID NO: 249665 - DNA, 273 bp, Homo sapiens
gcgggctacaaatattgtctcccaatttgtggcttgtcttcactttgggatgccatttgtcataaagaagttgccaatttatttttaaattttatttgtatacctttaagggatacaactgttttgttaggtgcatacaatgcatagtggtaaattctgggcttttagtataaccatcatccaaataatgtacattgtactcattaagtaatttctcatccttttccccacaaccgaccttaccacccttctgagtcttctatgtctattaat

SEQ ID NO: 249666 - DNA, 400 bp, Homo sapiens
ctagctggtgtggtggtgtctggtcctatgaccagcacttgaggtgccagtggatgcttcagttgctgcagggctggccggccctccctgcgtcactcagctgccacctgtgggcattcaccctgtgccaggtggagctgcgctgtcacgatctgaggaagttcatgttcccccatttcacagagggagagtccgagactgaggactgccgaaataacaaaggtggtagaagcagatgcaaaccaggccgtccaactccagcgtgctttccatcaggttactaatccaaagcacacactaagaggaaaaaacggtagatccccccaaccccacccttagactgcagctgtactcagggctgagagacccacattaaaggttaaatgctgtcactccaaac

SEQ ID NO: 249667 - DNA, 405 bp, Homo sapiens
gatgaagccagctttttctgcatgtgcagaggttatttctgcttttagaatctgagcactagattataaaataattcagatcttgtttgttttctaaataatctagtgtgaaaatcctgagaatttgtgtcttcctgtgaggcttaggtggaagtctgacttagtatctggaacatgaggtatttaagggctaatataaatgtaaaatattgaattgatgatctttacttagtataaccaaccatgtgtgaaacaccaaactggaaaaattttacctttctcctccaaaataaaacttttttttagagtaacaaatcaaagattttaaaggctgatagatgataaaatacctgaattcacgggtgactgtctcaaaccagtctggaaaatattacttgttataat

SEQ ID NO: 249668 - DNA, 382 bp, Homo sapiens
caccaccaccacaatcaaaatatacaaccattccatcatcccctaaaattccctcatggcattttgtagcaatccattctcaccaaccccagactttggcaaatgctgacctattttctgtccctatagttttgctttttctagaatgttgtataaatggaataacagagtatgtagcctttcaaatgtggcttctttcatttagcataatgcttttgagcttcctccatgttgctgagtagatcaacagttcattcccttttgttgctgagtatgctgtggatataccacaatttgttttccatctactagttgaaggatatttgggttatttaccaatattcgaattttgaacaaagctgccataaacatttgcatagag

SEQ ID NO: 249669 - DNA, 470 bp, Homo sapiens
ctcaagccatacctgggaagataaaaaaagcactccttgtagatggcatttgagcaaagtagtcagaaagcacaggctgcagagttggagcagggttggaatcctagttgtgcaacttactagctgtgatataccctcagcctcactgtgtacatctgtgaaatgggagtactatatccttcaaagaattataaggcatacatgaataatgtctaaaactgcatctagcataatatctagcaaataataaatgcagaataaaagttagttattctttgtatttgatgccttagtgttaaaatgacattaaagattatgggcttgagatctgaaacaatgagtttcaattttaggaagataattattaaaacatggtaagcaaacttgtataaaaactaggctctgctaaaaatgtttctttctttcttatttaaaaaaaaatgtttttaatagaattgatgaagcagtca

SEQ ID NO: 249670 - DNA, 295 bp, Homo sapiens
aaaggacagggtttagaacacaaatataaaaaaatgctaggatgtcattgaacattaagaacaacagctgtatgtttgagcccaggagttcaaggctgcagcgagctattattgcaccactgttcttctgcctgggtgacagagcaagactccatctctaaaaaaaaagaaagaacagattagatatcaaatatcctgttttatttttaaaaggaattattacaagaactgcttcaatgaaatctttattattcacaaagagcagaattccttcccttccctcaaactaaaaaaa

SEQ ID NO: 249671 - DNA, 316 bp, Homo sapiens
aatctggccaacctgcccaggctcacagcatacagagctgtgcggtaataagtgagtattgcattaagacactatgtttgtagtaattagttactcagcaatagacaacacattatgcctgtgggaaaacgttgagttcttattcagaggcagcctctaaaccaccatgtatccaagacctagaaaattctatcctatcagtgagttctcaggctagaggaattcacaaagcatgcaccagacactcacttcagttcccaaactccaaaggcaaactatttgtaaagtacagtacaataaactagaaaagaccaag

SEQ ID NO: 249672 - DNA, 1198 bp, Homo sapiens
gtgaggaaaatgtcactttattgaaagagaaggaaacatttttctgcaaagctttgtataccagacagattttgctgagttttacttacgcttaattccactgaaggtatttaattgttttggattttccctctgaaaataccctggcgtagaaattaaacatgtaaaaatagagtccacatgagtcataagttgtgatggggacagttgttaggcttaattaattaaggggttaatcaggttggttaatcaagggaaagatatttgataattttatgtttgtaatattttaactcacacactgaaaagggaagaatgcatatagtgaaatatattttgaaaagtctcaccctagttttaaaaatgctgtggtgagtgctagtctccccaaaagttagaaatcttaaaatgagtttatctaaaatttataaacatatttctatctaaaagtaactgatgttatttccttgctcttttgagctctgattaatagtgctgatgaaattagaagtgggaaaaggattccgagacagctttggccaattttattttctaatcacgaatcccatctggattgtagaatagcatagggcgggggctcggcctgccccattcggtcttgcatatgtaacactccttccattcaacagataacagagagttagtcaccttgtgaatcctttaaaaataacaacacccataattgtaaataagccgtggggatgggaaaccggcacctctaccaacaaaaaaaacaaaacaactcctgcgtgagtgaattcaaacagggctctgaatttagccaagggaatctattaaacgctactgagatactgagattcaatgaatccgtttctttttctttatttgtggcttccagtcttgctagcgtaaatgaaatctgctttcagacgggtacagtcaaaataaatggaaacttgaaaggtactagtattggaaactaatttcaccacccggggctggaaggagttaggctgcgcacgcgcgcacgcacacaccagcgacctccaagcaggtgtagcccagcccgggccgtggatcgcagccgccttctgcgtgattttctcagaacctgtgcacccgcatgcatggggacatcgggtcgagatatttgtcttcgcctgggaagagcaaagcgccatcacagtgcgcccccgacgccggccttggcgcacgc

SEQ ID NO: 249673 - DNA, 487 bp, Homo sapiens
ccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcac

SEQ ID NO: 249674 - DNA, 624 bp, Homo sapiens
ctacttgtggtgaaaagccttagactagagcaatagctacccctcaaaaaggaactcattttttttaattgtttgctgattgattgattgactgagacagggtctcattatgttggccaggctggtcttgaactcctgacctcaagtgattctcctgcctcaggtcccctaccagagtagctagaattaatagcacaagcctctacacccaggaactcactattgaatacataaatggaatttattcagccttaaaaagtttggaaggaaattctgacatatgctaaaacatggatgaaccttgaagactttatgataagtaaaagaagccagtcataaaaggaaaaatattgcatgattccacttatatgaggtacctagagtagtcaatttcatagaaacacaaaatagaatggtgtttgccagggcttttgaggaaaagggaatgacaagttaggggacagagtttcagttttgaaagatgaaaaagttctagagatgaatggtgatgacagttcattaagtgaattacttaatgccacagaactgtatgcttaaaaacggttaaaatagtaaatatatgttatatatatttaccacaataaaaatttattgactatatat

SEQ ID NO: 249675 - DNA, 499 bp, Homo sapiens
cattccatctgccccctgcaagttccggtaattggtcactatttataattatataaataatagaaaaacaagcttaagctgccctccccaaaaacccagtctcctcctatttttaggcagccagcctgccctcctgtagggcagcgtccctctgaggtctgggccactcagctccagccatgggctgaagcaatgatgctggtgacagcagtgattctgccacccaggaaggggccaggggtgattttctaactcaaggttgagtttaaagctctcagagaatgaagagaaggaactattctaaagcccccttgctgcgatcattctcccaagaccaaatctgattctgtaagaactgggagctggacagagattcgagtctgaatttcattgatgtgtctcactgggagtcacgggaccgggagagacgagaggctagaagagacaggagagtcaggctggctataaagtccttgatgtccaactaccacccccctgc

SEQ ID NO: 249676 - DNA, 315 bp, Homo sapiens
acacaatgagcacctatttctacaaaaaataacaaaaaataaaaataattaatgtgagagacgtgacttttccttttgcttgagcatttagatgccattgtggggttattgatcagtccacttcccatataattgtgtctcagggattagagaggcccaaggagagagggagagagactggaaatggccagttggtggagcagtcagagcatagtccataagttcactgtcttacataggcatggttcatggcattgcaaaacaattccaatagtaacatcaaagatcactgatcacagatcaccataacagata

SEQ ID NO: 249677 - DNA, 529 bp, Homo sapiens
ccttccccgccaaaggtgaggagggctttcaggatgcaggagactgttttccccacaccttaatgagaaaaattgacctgtttattcaccagctgtcttctttgtttctaatccaagcaattgctgcaaaatctttttcacttcttccatgttgaaattgagcagaaagcccctcgagtggcttatctttggcagacaacaaggaatcaggttggaggagtcacacagactcgctgggagacacatggaatgggagaccagcaaatatttacacactgtgttcaagatccattcttagaagtgtgagcataatttatgtgacatttcgagcactgtgccagtgagcgccttctctatgtacaaaatgtgctactttcgttgtggctgtatcacttttggtggagtgcagcctttgtgagtttcaatggtatggcggccttttctctggggcttgagtaaacaccaccacggaaagctattgttttactgtgtgagctagtgttttctctataaaactcgtaaaagtgtg

SEQ ID NO: 249678 - DNA, 911 bp, Homo sapiens
ttatgctacttggggattcagcagaacttatctgactgatggaagtgaccaatttgaaccactgaccccagaatatcccagcaggggcaataatcagcagagaccctgctacttttgtggctgtcttggcatcctcacagaggcctggttcaaccctgagctgtacacaggctggtttaaatgtttccccgcagattttggaagcaacgtgctgggtcactcgtaatataaccacatgcttcagtgtagccctcctacattgcttgcctacatctgaaaacacgaatcaagaaagagaatatagctcctttccacttgactaaagaacagtcaatcctgccagtagactaaaggctggggcatggaacaatttcccaacacactgacttgattttgtgtaaactgctgaaagagaagctttagaagctgtggctgggctcagaatcagtgcctccaaaggagcaccgaatgacagattgatggagctcatcagagaggcacagagaccacaggccattggaatggggccttatttggatggactcatggcccaaaaaggaaagggacactgccaacagcttcccctttagcctgtgggttccattaggaagccggaacatgtcactgggagaaagtgctatgaccacccaatatgtgcacaggtgcctctaggtggaagaaagggaaagggcgtgtttacaagaagaagagcacaagtcaacaatgagctatggatgcatgatgtcatcctctaggactaagcatccttagtacttttaaagcacttaaaaaaaaaaaaaactctagttgctatagcaacttgatgcagctcttaaaaggggattttttttgagggggtcattttatatcttctatcaccataacaacatgatatagctttttaaagggta

SEQ ID NO: 249679 - DNA, 452 bp, Homo sapiens
gaccctgaaaacgggctcggacccccgctgcagcgtggactccggtgtggccgcggggcgtgcaacccggaccctggccagctccgtgtcctccagacctttactcatggccccgcatcgccaggccgagctgcaccttcggtccccgcccgcggcagccgaggagaggagagcaaggcccagaccggggaggaacccacacagcctctgtgctccagcctgcttgaaagacaaggtctacctacaacgcagagatgcacacattaaggacaatgaaacacccaagtgttaggaaccagaataatcagccctaatagaggggaggctgatcagggagggcctcctggaggaggaggcacaacatcagggtgcactgtgatttctggagacccaaggagttctggtaaatgacaggtgagaaaaagaaaatgtaataaaatataattgaaaac

SEQ ID NO: 249680 - DNA, 413 bp, Homo sapiens
gagaatagctctctctcctgcagagagagaggggtgcccgagtgggtcttccggccagcggcggaatgcactggatttgtatagccaggcttgaggaggcggtgtctgatttacataaggcccacagattgtttggaccaggtgtgaggtctacacagcacgcatggaagctggctgccctatcctaatctttattatgcaaatggagtctttgcctggcgggggccatgttcactgcttcttactgtacgcatggctgacaaagagaagagaggatggagccgccattttgaacatgcttagtcccagctagcttttcccgattcacactgccggcactcaccggtgtaagcttccagcttgcttgtctgtgtgtgcagcttgattttacaggctgctttttgttacaaaaa

SEQ ID NO: 249681 - DNA, 202 bp, Homo sapiens
ggattacaggggtaagccactgcgcccggccccatttcttcttataattctggcttaacaatatgtgtatacacagtactttttaagagcacaaaaagacaatttctacaggttcttctctgccttacataagtcttatagttcactaaatgttagattaactaatttcatttacccaaggtatatcaatgaaatccttaag

SEQ ID NO: 249682 - DNA, 440 bp, Homo sapiens
ggtcgtgcctttttcttgataccccacgattccttgcacagcgtttctaccaggcgccgacatgccctccttggatgaatgagtaacatgggttctaggaagcccgcatgaatgcagatgtgacgtcctcagcctttcatagactatgtttcatgtgagaggtgggaagaacagctgaacagaaggctgagcactgtccaggtccagagtcaccaggagctcgttgtcaggttttcacttgctattagtagagatttttttttaaggtactatttttagtgttaaaagtgaattcaggccgggtgcagtggctcacccctgtaatcccagcacttcgggaggctgaggtgggcagatcacgaggtcaaggagatcgagaccatcctgaccaacatggtgaaaccccatctctactaaaaatacaaaaattagctgggtgt

SEQ ID NO: 249683 - DNA, 497 bp, Homo sapiens
tatattcacaattatttaacattgtatcttattttctacctcaaatgatttaatcttttccatattggtatggtcctggccgataactctttgtgtggcagcctgagagaatatggaagacactgtcagtgttggaagatggtggttttatcacttttcattgcactgtctttaaaacatgggcaaattgactaaaagaagactacagaagaaataatggtgattgtgaatttggtatgaagcatggatgttaattaatcacacatgttctctgaggtccattgtaaaaggagacctagtcttcagggagagagccactaatggggagatcttattcctagaattttgtggttatattattattcatgaaccaatgaataataaatgaatgatataaaggaagaaaaacgtgcttggaccaatgatgagtaccatggggtatctgaaacaggatttttgattaaacccatatgcaattctgaggtccattaaaaaga

SEQ ID NO: 249684 - DNA, 703 bp, Homo sapiens
ctgcctcaggctccccagtagctgggactacaagcgcccaccagagttgtaaattttgcaactctgtgaaaagtcagtgaaattatcactagttttgattttcacttcacaaaaccatactagttttctttagggagaaaaacatatgtattagaaagttttgtattgctctgatgcaaataaacagattagagcacagtttagaaaaccttcactttgacaaaataaagattctgaagtatttcaaagattatatttatattccttataaaccattatctatgtttgcatttgagatactgggggaaggaaaacagaaactcaactctcttttagagtttgacaaatgaagtatagaaaaatataagtaaggatttatataagacaaacccttatcaataaagaactttacaaagacagtacttccattacactcccagaacaaaaaccaagtatatacatcattttaaagaaaacaacaataaatcctaccaagtagaaattgtacagatcatagtctctgttgtaattcaataaaagtagaaattcaaccattcaaagatagccataaataacctgaccatatggacatcttaaaacacttttctaaattaaagataaattacatagtatttaaagatgagcaaaaatgagaaaagtttatctacaaatatgtagttagcattttattattaattaaaat

SEQ ID NO: 249685 - DNA, 664 bp, Homo sapiens
ctggccagatgtgttgactgaacacttaagatgcagtaagtgtgaccaagaaactgggtttgtcattttatttcattttagttaatttaaatttaagtttaattagctacatgaggctatcagctgtggtataggacagcagagctccggaagcttttggcctggtgagaagaatcaggacaagcgcctccctggcctctcgcccactctgcacagccgctaaccattgctctcatgacattctttcccagccccagaacttttagccatgtgacatcatctattgattagagtccaaacttcttgtgctaactctctatgggttgccacaattagccattgtatgtcgttaacctaaatttcattcatctgctatgtcctgaccttaggggcttagaatatagttagaaaacagtatttcagaataaaaaaccattcttgtattacctctcgcactattccccctgttctccatgcttcgcattctctgttctatccccagctatagcactgtccccataaagcctactgtggttctcggctcatggtgtccttcctcccatctgcctcccgacgtcatgcctgtcttccagtgtttatgccttctccaggaagctttctcttgtggccctcgctgtgagctatagctcctccctttcaacat

SEQ ID NO: 249686 - DNA, 403 bp, Homo sapiens
acacaaacgcacctggattcaacagaggacaagtagacacatctatgtcccaggctgcactaatgaggaaagtccaccaggtgggaagtaggtaccactgagagtttataaggctaaaaaccccagtcttgggatgcggagaaggagggaaggaagtgagaatgaacaggaatggcatattctgttcacttcactgacagctttgcactgtgcattcccagctgggcatgtcccagacatgatctcttgcatgggctgtactaacgaacatcaaatattcaggctggcaagcgcgagtgggcagtgaagcgtggtgtgcaggggaggtcgcatctatctaattcagcgcactcatagatctcagcggcacgggcctgggcataactacgtgccctctgcgcta

SEQ ID NO: 249687 - DNA, 437 bp, Homo sapiens
agtgggtgcagcgcaccagcatggcacatgtatacatatgtaactaacctgcacaatgtgcacatgtaccctataacttaaagtataataataataaattttttaaaaaagcatttaatctggaacaaaaaaaaaatctatggactacttcatccaacttttgcagaaaacattttcttctccagttcacatggaacatttagcaagatagaccacattctgggccataaaacacaccttagcaaatttaaaacaacatctgctctcaaaccacaatagaattaaactaaaaatttaataacggaaacacaaccggacaattccaaaatacatggagattaaacaacacacttcaaaataacacatgggtcacaagagaaatctcagagaaatttaaaattatttttaactaaatgaaaataaaagcatgacttttc

SEQ ID NO: 249688 - DNA, 409 bp, Homo sapiens
catcagctatcatctgggaacttgttagaaatgtagattcttggggtccaccttgaatcagaaatcctgggggtgaggcccagcaaccttttcagcaaggcctctgggtgattgctgtgcgcactgaagtttccgaacctcggagctagagggatggatcgactgcatgtcaagctagagaagaccagtctatccttaaggaactgcaagcctggccaggcaaagctgctttttaagtggaggaaagggggaggataatatgcccggcagttccgggaagaggcacttcacgcctccacgggaagctcactagtaagtgcaggcatacctcaggaacgtcgcaggttcagttccagaccaccacagtaaagcgaactttgcaataaaatgagtcatacacgttttagtg

SEQ ID NO: 249689 - DNA, 492 bp, Homo sapiens
attattatactttaagttttagggtacatgtgcacaatgtgcaggttagttacatatgtatacgtgtgccatgctggtgtgctgcacccattaactcgtcatttagcgttaggtatatctcctaacgctatccctcccccatccccccaccccacaacagtccccagaatgtgatgttccccttcctgtgtccatgtgttccagagaacattttcacaaacaacagaggtgttgccagctcagtactggcatttctgtgtcctctgagctttctagtttggtttggtttgaggttgtatctgttcattttgctaaactgtctcaactcttagaaatatttctgagctcattctccaggatttttaggtaagtactgatgataaactgtttacaaacagtaatagttttgtttctccttcctgatggttgaatattttcattttagccagaaattttagagcaatattaaatattattaaatatcagttatga

SEQ ID NO: 249690 - DNA, 129 bp, Homo sapiens
aataacagtctccaaatcctaactcacgaaagtccagaaaacatttgaccaacattctctccttatttttgctactacatatgccacatttaatagggaaagattaactgcacaaatgcattcaccaga

SEQ ID NO: 249691 - DNA, 717 bp, Homo sapiens
atagatcaagagaacagaatagaaagcccagaaattaatctacatatctatagctatattagtacattctcacattgatacaaataaatacccaatacttggtaattcataagaaaaaaggtttaattggctcacagttctgcaggctgtacaggaagcatagtagcatctgtttctggggaggcctaagggagcttttactcatgaagccaacacttcacatggtgaaagcaggagtatgagaccaagaggggaggtgccacacacttttaaacaaccagattgtgaggacagcaccaagaggtgctaaaccattcatgataaatctgcccccatgatctaatcacttcccagcaggccccacctccaacattggggattacagtttgacatgagatttggtggggacataaacccaaaccataacacagtgaactgatttttgacaaaaatgctgagaaccttcattgggaggacagtcttttcaataaatggtgctgaaaaaactgaaaatccacatgcagaagaatgaaagtagacccttatctttcacccaacacaaaaatccactcaaaatgatcaaagacctaaatgtaagaccccaaatgttaaaactattagaagaaaacaaaggaaaaacacttcaggacattggtctgggaaatgattttataaataagacctcaaaagaacaggcaaaagaagcaaaaaaaaaaa

SEQ ID NO: 249692 - DNA, 384 bp, Homo sapiens
gagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaa

SEQ ID NO: 249693 - DNA, 449 bp, Homo sapiens
aacaaataatttttaaaatacaacgatgtctcatgcaatatttgggacatacttatactaaaatttactttgtcatatcattggaattaaatttaactaggtggcctacatttttatttgctaaatctagcaaatttatgaaatgctcatgccaaagagtgctcacgccaggctcttgctaagccatggagaatgcacaaccttaacgctttaggtattgtcaaatgttctttttttaatttaggttttttgcttgtttggtggtaaatgctttcacagtaagttgtttgctcattaatttacttacttttaattatttttaaaaaattagacttagtgggtacacatgcaggttattacaggagtaaattgtgtgatgctgggatctgggcttcaattaaacccatcactcaaatagtgaacagagtacccaaggaggtttttaactc

SEQ ID NO: 249694 - DNA, 612 bp, Homo sapiens
ccagagagactaaacagtggactcatgggtttggactctattgcaattcaagtgaggtcagaggaattccacagaaaacttaaaaggcatgaagtagctattatagtaaaattaatattttaggggaaaaatcattaatgagagaaaagagcattctggaaaactgtgttccatttaaggcacctcattaccagattctttaaggaaaactggagggagttctgagacacaaagaatgattaagaggctgtagggattaacttagaaacaacgattttaaaagactaaatatgtatagcttagctgaacagtaactaaacagagatgtaactattgtcaaatttctgaaatcaagagaagtaatgggcttctctgattaaaatcttaaacaacttatatgcaatatttagactgtgcgctgcagtgtaaactatcagagttgaattcaaatcccaactcctttattttccacctggggaatttcaggcaactccttccaccttttaaactttgtcatatgtagagtgggaattacaccacctacctttagggttactatgaagattaaatgagatgacataagtaaacagtctagttccatgcctagcacag

SEQ ID NO: 249695 - DNA, 331 bp, Homo sapiens
aaaaaacaccgccataccttataaaataatttttataccttctaatatgcaatcagtgttcagatttcctgactgactcagaattagttttgttagaattcaggatcttgaaaatatattgatatattcctttcattttttctttgcgtaagtatagatgtatatgtttaataaaaggagcaaataattactagagttttatatgtactggggcaatagtataagaattttacatagccgggcatggtggtgtgtgcctatagtcccagctacttgggaggctgaggtgggacgatcacttgaacctgggaggtggaggttacagtaagcc

SEQ ID NO: 249696 - DNA, 438 bp, Homo sapiens
gtacgaatacatgctgaggatttcatcccttggcacctagtacaaaatgccttggttttgcttgtcaccaacccaaatccccatgttttctcgctgttttctttgtgcctgcatgggtcttcctcgggttctagagctccacatcatgctgggtgtggagtggtgaatgagcccactgctcacacaagcacagaggggttttgaaacgcccctttccattccatcttttctcttggccctaccttctccaccctcacaaccggctccttgtacacacactcagacattctcctaggactcattgtcttctcggttttatttctttctctttctgccagtatccaccctgttttggtaaccacggcaactggtgaaatacaatcccaatatttgctagctgcctctgtcacccagcccagcacgcgcattgctgggtct

SEQ ID NO: 249697 - DNA, 641 bp, Homo sapiens
tgtgacacaacttaaacatcctttttgggtgtgtgggagcaagaaaaattgaggaatgttgatatcagggtagggggttgaaagtggatggagggaaatggaacattttgagatacattcttgaggcgggacagatcctttacttgttgaatttgttgtggagtgtgagggaaagagaaatcatggagagagagcatctagattttggcttaaatgtctggagagatggtgatgactgtgctgggaaaggatttagtgggagggaatcaggaactgtgttcggctgcctcctgggaatctcagacttgatatgacacgtctacagggagatggcaggtagagttgataccactctggagctcggaggccagggctgcagacccaggtgtgggtgtgtgcagcccatagagagctgtgttgcacgtgcctttgtatttgttttcttttgtagatgcagttctcttcattcttattattcagcactagtttctttttgccagttttttcaaaaatcaaactttaagatattcgtagattttgtccttattggtcttttcacatagcatcagattatcagaatgaaagatgtgggaatgagggagaacagtgtcctttttgacgatgacttatataaaaaaaaa

SEQ ID NO: 249698 - DNA, 453 bp, Homo sapiens
cctcataggcctcctgtctccatatcagttctgcctcctcatcatccctgtgtagttgttgcataactttggatagatctgtagtcagtgtttatattgttgtcactaaaaaattgttacttatgactgagctatgtaggattcgtcctggtatttcccttatccagagattctctgttactaccctttttggagagtaaaccttaaagtcttctcctggggtagagaaaaggcacttggccaactgtgaaaagtaagagagggcatctgagtgtctgtctgctttttctatagacattataccagtcttcatgtttttagttgtttcttcacccctccttacagagatatctggtcctgtttttccattgctaaccaagagttggctgttattttctcatctctctacttttctttttgtccatgtggtttattccttttaagaaaaaaatt

SEQ ID NO: 249699 - DNA, 1155 bp, Homo sapiens
acctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgtgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgagtcctcccagagctgcagttcgggccgccagaacatccgcctgcacagcgactccagcagcagcacacaggtgtttgagtctgtggatgaggtggagcaggtggaggctgaaggcagattggaggagaaacagcccaagatccccaatgggaacctagtgaacggcacttgttccccagactcgggtcatccttcctcccataacttctcctcgggcctctcagagcactcagagcccagtctgagcacagaagacagtgtcttggacgcccagc

SEQ ID NO: 249700 - DNA, 319 bp, Homo sapiens
ttctgttgaccaaactctttgctcctctccacccaccacagagttacgaggagcaggagctgctgcgcctcatctactacgggggcatccagcctgagatccgcaaggccgtgtggcccttcctcctgggccactaccagttcgggatgacggaaacagaaaggaaagaggtcggttacctgccatgggcactgggatctttggcaacaaaaggagccagatactgtggggctggggagtgctggttccacgctggaccaaggaaggggagggagatacggggaagatgggaacctgaaggcggcgctgtccaatagaa

SEQ ID NO: 249701 - DNA, 486 bp, Homo sapiens
gcggccgccctggccaaatgctcatccggggccagcttggacagccacctgcaccggatgttgcacagggactcaaccatcagcaatgaggtgatgggcggctggcctcggggagcgcgggggctggggaaggtcagggtctgcttcattgggctgttctaagagtggtgaagactgggtgtctggggcctggtgacagtctcacccctggctttttctttaagagtgtgcggtgactttggaatcagacctgaattcaaactctagtcccaccatttagtagttctggggttccctaccagtaccttttcttctgggcctcagttttctgcatctgtaaaatgggaataatcaggtgtagaggaggttcgtgtacagtccaaacaagacaatgtatataaagtgcctggcgcactgcctgactttcattgattcaacaaatgcttattgagtatctactatgtgcaggtactatcaggaatatcc

SEQ ID NO: 249702 - DNA, 316 bp, Homo sapiens
gctaaaaacttggatccttgtagctcttggccttagattcaggtcttgatttgaacatgtattagctccgtgatgatgggcaagttactatatttcttggtgccccacccagtttgttcatctatactaataatatttagagtctttaatacaaggttgagtatttaatacctttaatacaaggtagagtcaataatacaaggttgttgtgagtgataataggagaatgcacataaagccctcagcaagtacctggcactaattaggtgctaaataaagggttttctttgttttgttttttgagacggcatcttgc

SEQ ID NO: 249703 - DNA, 743 bp, Homo sapiens
tttttttcttgttgtgaggatgggagtgacaacttccaagctctttacatgttgaacaggaaactgaaagccccttggtgttcctttgtaaattcatcttaaaaatatttatcataattgaaaagtgctaatatcaaattttcagtctgtttatattccccctaaactcagataaatatacattttattttgtgtgtctgtgtgtgtgggttttgttgttgtttgttttttgtgtttttttttaagatatagggtcttgctctgtcaaggctggagtgcagtggcacaatcgtacatctctgcagcctcgaactcctgggagaaagtgatcctcccgctttagccttcagagtagctacgactacaggcactaaccaccaagcccagctaatttttaaaattttttgtagagatgggagtttcactttgttgcccaggctggtctcaaactcttggcctcaagtgatcctcctgcctcagcctcccaaaatgttggaatcacagatactttgtgtcttgattcttgaaaggaaaaaacaaagatttttaatgcctcttatcttgtacgcactttccttccaaacaatacccttttgctgccattgttctcgttatgaatagcttaaagaaaaagaaacaactaagggtagtaataggccaggaatcacttactgaatactaggtcttcttgtatagtttgataccctataaattgtgtgcatctgatgcatttcaccttcaaa

SEQ ID NO: 249704 - DNA, 687 bp, Homo sapiens
ggtttcctgtctttttagcctctttagataataaaaagatgagtgagacatgaactctgcctctccagagtccactatagcctagcagaagaaacattatacatactgaaagacagccccatttttagcatttttatttgaaatgtaataaaaggattttccgaattacccccttcatagctggatagcagaagggaactgtgagggtagaccctgaaaatgcagacacagtggaggtgtttcgtgtctacttacatttttaataactttttttatgacaaaggtagtacacacaaggtctgaaaaggatatacatctggccaggtgcggtggcttacacctgtaatccagcactttgggaggctgggtggatcacctgaggtcaggagttcaagaacagcctggccaacatggcaaaaccccaactctactaaaaatacaaaaattagccgggcatggtggtgcgtgcctgtaatcccagctactgaggaggctgaggcaggagaattgcttgagcctgggagatggaggttgcagtgagcccagattgcaccactgcgctccagcctgggcgacagagtgagactctgtctcaccaaaaaaagaaaaaagaagaagaaaaatcagatcaatgaaaaatcaagtcattgttttctagctgtcccaggataaaatcgaactcagcaa

SEQ ID NO: 249705 - DNA, 306 bp, Homo sapiens
ctagttctggaaataacttcttataataagactaagatataaaactaaaggtcaaaactgtgtaagtaaaagaagctactgccctttaagggaaaaataatacatgttaatttttgcagcaatttcaattgaatgggtttccagggaaacaggtatctgtaatgggttcatcccacttaatatttaagacaaaacatagggaatttctttcttgttatcttttccttgttatcttacacacgacatgctcattcttaaatttcctttgaagcgatcattctatgcttgagtcttatttgttctccc

SEQ ID NO: 249706 - DNA, 502 bp, Homo sapiens
tctattgctcctgttccttaagccctagcagtccctccacccagtaggccctgaaactgtaatgcagtcctctcaggctgaggacctgctctgtgcaaaggcctgagagggaggtggagagaagccaggcagaggccagatatattagcagttttcctagaacagttgctaaaatagagcagacaggggctatgggagttgatcaatagatattcattgaacatctactttgtgctgcgaatgatttcagtcatgagggacatagcagaccataaaacagaacaggggaagccttctttagaagtggtcctggtatatttctgtcaatcgacatatattcacaaattcacgcatccacttaataggtatttattgagctccttctgtatacgaggcactgttcttgttgctgaaaatacaaaactgaacaaaacagaaaagctcctgcccttgggagcttatgttctagtaaggaaatgaaataaacaacaaacagcgaaaa

SEQ ID NO: 249707 - DNA, 200 bp, Homo sapiens
gtgccgagtatttcgatgcacttgtggtgtgagccactgcacctggcccccttccttcaccttagtcaatcctatcccacctcttcttcctccagtcccctcacctgatggtcccgacacttcatcatccaccacctcctggagggggtaccctgaggtgctcagctgggggctctgctcctcatcctgggggtgcggtt

SEQ ID NO: 249708 - DNA, 525 bp, Homo sapiens
tacgcagtcattgatctaatttctgtctctatgtatttgtcattctggacatgtcatgtaaatggaaacatacaatacgtagtcttttgaggctggcttgctggcctaatgtttttgagactcatccatgttgtcgaatgtagagtgttgtggactatgtcagcactttgttcttgtggccgtgggccccttttcactgagccttctttgcctttatcttcacttgaatttgtgggctatgtgctgaatgacttccctgttactttcagtgttgttttagaggaaaacacagttgttgttttgtctttgttttaatgaactgatatctcctgtgtgtccatgctgattcttaagttgtttaaggaaatatttccttaatagaagaaccttctttcaggatcctcctattcttcctcccaatattgaaaatcattttttaaaatttgccattaaacaaatttttttgtttttcctgaagaaactccccttcatttaaaaatctatagtttcttgcttttagaaaag

SEQ ID NO: 249709 - DNA, 399 bp, Homo sapiens
aggggggtcggagcccggccacggggttgcatgacgcagagagaggtccgaacccggccgtggggttgcatgacgcagagggggtccgaacccgaccatggggttgcatggtgcagagtgggtcggagcccggccactgcagggaccttgctttattgagcttcacttgaccgcacttcgcagatgctgtgtctttacagattgaaggtttgtggcagccctgcaccaagcaaatctgttggcacaattttgccaacagcatgttctcacttcctttctgtgtgtcatgtttgggtaattcttgcaatatttcaaagtttctcattattaaatctgttatggtgatctgtggtcagtgatctctgatgttactgttgtaattgttttcgggctccatga

SEQ ID NO: 249710 - DNA, 481 bp, Homo sapiens
gcctcaacttcccaggctcaggtgatcctcccaggtagctggaactacagatgtgcaccaccacacctggctaattttttttgtaaaaacagagttttgccatgttgccaagatgaacttcttgaacttctgagctcaagcaattggcccacacccacagaactaggattacagatgtcagccaccatgcctggctcaaaatgctttttataaaatatgattaggttcttgggaggccgagatgggcggatcacctgaggtcaggagttcgagatcagcctaaccaacatgaagaaaccctatctctactaaaaatacaggattagccgggcgtggtggtgcatgcttgtaattccagctactcgggaggctgaggcaagagaatcgcttgaacccgggaggcggaggttgtggtgagccaagattgctccatagcacccagcctgggcaacaagagcgaaaactctgtctcaaaaaaaaa

SEQ ID NO: 249711 - DNA, 777 bp, Homo sapiens
  misc_feature (390)..(390): n is a, c, g, or t
ctccacacagcagtgggcgtggtcagcccttgcttcaggcagccccgagacgcagtaataacaatccccaaggatcttaatacgtaaacagtgattctctgcggccagcttgtcaaagcgggcgaagagctcgttgagggtcatgaccagttcctgtgcagtgcactgggacgccaggctggtgaagccctcgatgtcagcaaacaggatgctcacgttgtcatgtttctggacgtaaatcttatggaacatcatatcctcctgcttggcgttgatgtctgctttcatctccatggcaacatgacggggaaggacagacagcaggagccgttcctgctgctggttctcccgctgcgagtggagccgcgcctggatgcactctcgggtctnctggaaagcctgtctctgggagacctcagccggatagtgggtgcagacacccacgatgttggtgcaggagaaaatgagaacattggagacaagctgcttcagcaggaactggtcctgggcgttggtgcgcagggcgatggccaggtggagggcggacaggagcaccccgctgagcactgcggcccgcatgcgcacgggcagcagcgtgtagatggtgtagatgaagaacacggtccaccagatgccctcagaggcgctgcgtggctgcggcagcagcaggcccaccacctggacggccagcaccacggcgatgagcgcatagcaggccaggcccatgtggtcctggtggaaggcggcgcggttgcaaagcacagccatgatgaggat

SEQ ID NO: 249712 - DNA, 857 bp, Homo sapiens
tagctaaaccccccagttctatcaatcagacaagacttctgctagaaagaaaatcagcatttgctcccacaactctccgtccttggagagcacagtgtgctcagaagagcagcactgcttgcaaagggagcccgtagctctgggaggcaggctgactccacacccaagtcttcatctgtcactgttggccatttggcatgtagcactcagacctcagtttctttgtgtgcaaaatgggggtgatggcatggagaacatacacattttttaaaattcttaccgattttctgtgggtaacattaaaaaaagttattttatttttaaattttcatttgtttaaagtttaaatttttgtatctttttttagtatttaatttttgccttcagcttcgcagacatacacattttgaatgggactgatacatctattactcatttcccttcccttcctgcacagggtactgggaacatgaaataacagtctacgattgagtcagcattgctcaccggaatgttagtcatggcatatgccctgaaagtggtgccttccaggaccgttgagatgaggatggccagcccctaacagccatctgcatccggggcctgggagagccgaacctgagactgccaggaatggtgtcacattaaaagtgcctcattcttttggggctgatcaggcccttgactcgatatttggtaatactaagaaattatagagtgatgatttgttttcacctcataggtgtgtcttccttaaaccttgttaagatgttgacacattacccatttaaagggggaaagaaaagggaaaaaaaaaggaaaaaactgaagttcattgttctaggtgtgacaattgt

SEQ ID NO: 249713 - DNA, 461 bp, Homo sapiens
atgcacaaaatgatacgtgtgtgtgtgtatgtatgtgtgccaaagaaagagggagattaggccagtcgcggtggctcatgcctgtaatcccagcactttgggaggcggaggcaggtggatcacaaggtcaggagttcaaaaccagcctggccaagatggtgaaaccctgtctccactaaaaatacaaaaattacctgggcgcagtggcaggcgcctataatcccagctactcaggaggctgaggcaggagaattgcttgaactcgggcttcagaggttgcagtgagccaagatcgtgccactgcactccatccagcctgtgcgacagagtgagactccatctcgaaaaaagaaagagattaagggagagggaggtggtattgctaaatcttatccagatgtactgcagggcggggtttggtgagaattaataggttgtctgaaataacagcaagcatagaa

SEQ ID NO: 249714 - DNA, 840 bp, Homo sapiens
ccggcgtatattcttcttaatacttctgctaatttctgaattttcctatagtagatataatatgtattttcaaatatttacctgaaatatatatttgtgttattttaagaaggaagaaaagctgaaaataaaaatgtttatggatgaaattagaacaacagaaaacttgaagatgcattatgattgcattatgtgaaggtgcacacgcatttagtaataactagaagatgtcaaaacacatgattttgttagagtggattggtaactttttaagaactaagtcctttaaacttttaactaattaatttttacaataaaataaagggaaactcatgccatgtattcccttcataaacttaagagacccccattatcttttactttaaaattcctataggatgtcattatgcttctttctattgtaatggcttggtttcagatcactaataaagaatctggattacatttattgacagttagttttcctgatcatgtataaggaattaaccatttgagttactgattattctttaaagaactgtacattttggaagcctcaatataagttacaagtgatcgcatatctctgcaaacattatacagtgtttaaattcagttacttgacgcagcaaattctgggattaaaaacaaacttttctcatggtctgctctggcatatgaattaactaaaaccagaaattgtaattactgtctgaatgccttcctacaagataaaatgagatgttaaaatgatttgacattacagagtttaatgtttttatgtgaccttattataccaaatgcgctctgaaattttaaatagaatgtaatgacagagaa

SEQ ID NO: 249715 - DNA, 599 bp, Homo sapiens
agggacaggaaaggttcccagaaaggcatggactgacggccagaaataatgcagctgaccgcggtggacaggagcacctcacccgcagccccacctgctggacccagatgggcccttccccagcagccagacctgctctaccaggaagcagagcctgagaggagggtgcaaggccctcacccaggcaccggaggcacggtgtcacctcaccttccgtgtgatgcactccagtctgcagtcctgcactgagccagtcctgggccgacagctgggagcccctcttgtaccagacctgggctgatggcatgcagttctcagagacagtccctgaatgcattggtgcaggcagccaagttcaacagccccagacagcacaggggaccccatggggagccaggtcctcccaccaccagactgggaagccgcagccgctctcggccttcggacttggctcatacctgtgagtcaagcctttatcaccaagtgattcccaagtacattgagttgaagggtgtcctccccaaaattcacgtccctcctgaaacctcggaatgtaaccttatttggaaataaagtttttgcggttgtaattaaactaa

SEQ ID NO: 249716 - DNA, 476 bp, Homo sapiens
ggctattttagttgagtgattttaatgactggaggcagataattttatttgagaatatcttcatggaacaagtgagtcttgaaggaagcaactgtgagtgaagtttaagacaagggattagtgtgataacctttgcatatttgaaaatgtctaagcacctgaatgctgaaattattagctagatacgtgatgtttggagtaagaaaaatgaaagtgagtgcagactcgggacacatctttctttggttattcaaagaagccaatgacattttgaaatattttaatcacaaattaatgcgtggtttattggataacattttttgttgttgttcacgacagctgttgtttgggactaaaagtaacaaggtgctggatatttttcctatctaatgtctttcattatcttgacaaggacttggagtgcagtatagaaaaacctcaaactctttactactgtggagacgactgttgttgga

SEQ ID NO: 249717 - DNA, 209 bp, Homo sapiens
gtgggagtgagggaaaaaaaaaacctaacatattttaatttcttcttcggttttattaaaagcccagcaatagttttagatgtatatgaaggatactttcaaatataaaagtgtaggattttttgttgtatcattcatatatttgtaatgataaatttttgtcatcattttcagatactttttaaataaatctgcatgtgcatcttcaa

SEQ ID NO: 249718 - DNA, 594 bp, Homo sapiens
taatgaaaaatgcactgggcttatttaaaaatggttacatttcctcttctgtttttaaacatatgaagtgatttttcttggctctttactatgaaaagctgataaggttcctggaggtgaaacctatggaattgtggggtctctctaagactgcagctctgaagagtttatcactctcaagctgattcacatgaagcctctggcagtccatcaaaattatcattgatatgtccctaccattttataacaccagtgactttcattccgagtaagctgatctcagtgcctttctattcacgtctctgctgatttcagggttgtagttttccctgtgcctttaattctctgaagagtctaataaagaccattgattttcagtttgttcagcttttttcttgtgttaggatgagatgatgaattccaagctctttgtatgttaaaactgaaactggacatcttatctattttggaatattgaccttgaatccaggttcttgctgaattgacttgttaattgtaataatttctctgtaaatttttctaattctttaagtacaaaatcatgtcacctggaaataaagactgatttaatgc

SEQ ID NO: 249719 - DNA, 656 bp, Homo sapiens
tctggaaagggagtaagtgacagctgcagggccctggtattgagacttagatgaccttggacatttcagggggatttcatgatgggatagtatggatccttccatgccaggcccccagcttagatgcctatttatccatgtgctggtttctcctctcagttggggagcttgggaagagaatgggcatggggtaaagatgtgggggtatgcattgtgggtccttgggataggggctcttggtggtttcatctgttcccattgtggcagggcactgtgacctttgaagatgtggccgtacacttctcctgggaggaatggggtctccttgatgaggctcaaagatgcctgtaccgtgatgtgatgctggagaacttggctcttttaacctctctaggtaaggttcttttaccctttcctgtgccctgagctagtctgtgcccttcctcttttctctataggcaggtctgtccttctcatgacaagactatgggctctgcttctttctcagttccctgcatagttctgtcattggtaagactaaggtgtgcatactgtcttctcctctccttgaggagccccagtacctgtttcctcacagcctcacagggaaggattcagagtctgcagtcttgcagtcaccctagtggatcccacct

SEQ ID NO: 249720 - DNA, 587 bp, Homo sapiens
ccacgaaggcgtgaggggagtcgtcgtccctcctgcacgaaagcgtctaagccttggcgacgccgccctgggggacccacgtcaggcctgggatagggaccgctgtccccgggtccctaccaatgtcgcccgtcgctcccggcccagctctacccgcagagtctgatggcagcggccactctgaggacgccaactcagggcactgtgacctttgaagatgtggccgtacacttctcctgggaggaatggggtctccttgatgaggctcaaagatgcctgtaccgtgatgtgatgctggagaacttggctcttttaacctctctaggtaaggttcttttaccctttcctgtgccctgagctagtctgtgcccttcctcttttctctataggcaggtctgtccttctcatgacaagactatgggctctgcttctttctcagttccctgcatagttctgtcattggtaagactaaggtgtgcatactgtcttctcctctccttgaggagccccagtacctgtttcctcacagcctcacagggaaggattcagagtctgcagtcttgcagtcaccctagtggatcccacct

SEQ ID NO: 249721 - DNA, 305 bp, Homo sapiens
gagcgccgttggttccgtcatagcagctgtcggagtgggggttcctccccagcgtccaggcggcctggtggtcctgagaagccccgggctcgccgtgccctgcccccacgctcccgccccgaggccgcccgccgccgcccgggctgtcctccagccacggatggggacgtccagaaaggcccggaatgcccggcactgcggctcgttttcttcctttctggtgcttgtttctgtgtgttactaagacagttcatgtgtgtcatttgtgaaacttgatcataaaaatgtgtcgttgttgccatacc

SEQ ID NO: 249722 - DNA, 362 bp, Homo sapiens
gctagtttttgtattttgtatttttggtagggttttgccatgttggtcagggtgatcttgaactcctgacctcaggtgatccacctgccttggcctcccaaagtactgggattacaggtatgagccaccacgcccagccagctctgctcttataaatatgacctaaagtgttgaagtctcatttccaacttatgcaaaatttagattccttcaaagcctgattttctgtaattctaataatttcatcacaattaggactttgaaaccaatgcatcagatacgttgaatattgtgtttttctttcctaaaatatattcagctgtttatggataaatacgtagaaaattgcaggtaaaaaaaat

SEQ ID NO: 249723 - DNA, 725 bp, Homo sapiens
gattttggagtttctatgattgctccttttagggatttcccatcttgacttctaaccactctgacagcccaaactccattctctgactcctcagataggtaagactatgacattctgcctgagtcctacctgcccagtgccatggacaggggagtgcactcaggtaaagttgtataaacatgcatatctcctttacagcattgaatcccttacagttgctatcacggaaagtaatcattaggtgacatccccctatttaccctgaagttactgaaccatcttccctggatttgtgcagggtgtctcctaatttacgaagattccaattagattgggagtatgacttaactcatttaagtcacccaaatgctatttgatcataatttagtgtcttgttaacctaatggcttgaaataaattgacgcacttctgaaaatagggtaaaaatccctgatttttcaaggaggctaatcttccgtaaatgctaagcactatagaatcaattatgttattaatttgctcttggttgcaagctacaaagcttgatcaggctaattacagattatgctctgaggaaaatatttttatatgcactatttttttcttgcaggcactttaatatgaggttttaaaaaaccttacttaagacaaataaaaaagaaaaccttcatgtaattactttacctgcaggctaatttttaaatacttcaacaccgtaacaatta

SEQ ID NO: 249724 - DNA, 1182 bp, Homo sapiens
atctcccaagattgggtgcattagaccctttgtcatcacacccagtactccccacgtttattgagcgctcacgatgcgtcaggccctagtggaagcctttatgcacattatcttctttctcatttaattatcaagtagagcccacaaggtaggtactaccttttttttaacttttgagacagggtctcactgtatctcccagactggaatacagtggcgcaaacacagctcactgcagtctcatcctgggctcaagcaatcctcccatctcagcctcctgagtagctgggaccacaggcagatgcctgttgcccaggctggtctccaactcctgggctcaagccgttctaccttagcctcctaaagtgcagggattacaggtgtgcaactgtgcccggcctgggtagttactaatattatcccattttacagatgaagaaacaaggacatataggggttacttgcccaaacccagacaataagctagatctgaaagtcatcagcctgacctcagagttgtacttttaaccattatcagggtctcaggccagtacccactgatgaaacacataagtaacttagtgggtcattaccaacatttcattaaagaaatagaaaatggcagagaacatcaaacttagtaaggctcttgtttcgtgaaacttgtcagattctctaatatgataaatactaaatcttacaaacattgaaaatacaaaattaaacaaaatattaccaaggttaacacaaaagtatgaatactgcagatctgatttattttactatcctcatctttaatgcagaaccttcttaggattaaatgacatttaccattccgagcaaactgaggttactgccccaaacggactgggcttacctttgcaggagaacaggggaggctgtgttttggctggagatttttggctaagagtcaagacacagagattcttctgctaccactgtgaacacatcgagtccctttcacatagatgctgtttccacaagggtctccccacacccttccctacagattagattcccgtgatgccttatttaattcttgttggatctgttgatttggttatgaagtaggtgaaattctggtaacctcacccaggttccttcccctcttgattagatccagccagtctgttcgctggatgattaaatttggcattcatt

SEQ ID NO: 249725 - DNA, 525 bp, Homo sapiens
cattgaaattgggaagaagaaacattggagagcatgtcaagacacaaggggctcagggtacagcataattttgctttaattctacagcatgttttcaccaagggtggtaggagatagagatgaagtatagattttacagacattacatcgtgttcctaaaaacagacggaaaagtgatcataataacccataaacactgtagaacaagaactaacgagaccgctgatgtagaaattactttcctcaaggaagagggattgtcaggcagaaaggagggaaaataagaagttatttaggtaattttgttgtttcttctgaggaaacgtgagttcagatgcatattcaaatattttcctaaaagaagatttgattttggctgctttaggaaccaatggaagcaggaaggactcctagaattgggataaaccacagtgactcattactcctctttgttactcttgggcatcagagatatatgttttgttgatattagttattcaagtgaaataaacatgaatatacata

SEQ ID NO: 249726 - DNA, 364 bp, Homo sapiens
tcccaagtagctcggattacaggagtccaccatcacgcccagctaatttttgtatttttagtagagacagggtttcaccatgttggccaggctgggcttcaactcctgacctcaggtaatccacccacctcagcctctcaaattgctgggattacagccatgagccactgcgcccggccagcaatttttaaaataataaaagtctccctcaaattagaaattcaacaagaatcaacttcaaagctgaaaaatgaattgtacacataatatatgctattgccatatggcagttagtgtttccctagtaaacaaacacacccttgccaaggtgaggctggaacagtgagcggcaggaccttatccc

SEQ ID NO: 249727 - DNA, 362 bp, Homo sapiens
tgagatgaaatatgtaaatatgtcaagagaaattataaatgaaactgccaacagtgactacatctggagggtggaactagggggaatcagggactttaactcatgtttatttaaaattattttgaatagagattatatttatctgatataaagttattaagatataaaatagtataccatggaaagtgtcccttcttgctctgtcccccagatactcagtttctctccccagaggcaaccgtgattaactgtttctggcataactcccaagatattggatgcaggtaaaaacaaatgcctattttttcctgtttttctacacaaaaggtaatgcatcatgtcacttttaaaacaaaaaaaaa

SEQ ID NO: 249728 - DNA, 280 bp, Homo sapiens
ccctactttctaactttttccccctcatgatgtgtgtaaatcagttatccttcggtttaacattcacgaaatctatttgactgtaaacagtcagaaaaaggaaacaaaacagttcaaaaaaagtaaatggagttggttgtgtatgttttactaggatgtctattttaaatgtaattgactttgcaattttgttattgtgtcaccaagtgtctcatagttcttaacatgtaagtgcaaaacaatgagtaattgctgttttgctgaataatacatctgagtt

SEQ ID NO: 249729 - DNA, 483 bp, Homo sapiens
ttcattaaaaagaattccgttgctatatttataatttatttgtctaataagtaatgttacagtgacatttaaatggaaaaatacagtcttttttccctttctgtcatttatacttttaggaaatcttggctttttgaatcttgagcccataatcaaggcaccaagaactgtttgggggtaacaactctgagtgcaggcaaaagatccaagaaggataaaagggactcttgagtgctgttcacacagatgttaaaagtacaaatgactttgcccagctctgctttcccatcctgtactaatacgggggtggtggcagtggtggcgttccccgagtaggaggcccacagaacatggaaagagcctgtcgacagcacataaaagacacacactgaaaacactgctcgcaggaggagtgaagcttgtcaaagtactgcagaggctgggaaagtgaagagaagagaaggagcaattatagcccgcacc

SEQ ID NO: 249730 - DNA, 515 bp, Homo sapiens
gggcccttacaaataatactgccacagatattcttacagctcctgtgaatgtgtgcaggaatttttctagaagatatacttagaaggggaaaaaatgcaaattatagggaatgcaaattcataagaaaatgccaacttgttttccaaagtggtcataccactatgattatccatttcattctctctgctcatccatttcctcccttgtactgtaaaactttgagtgatcagtttaaaggattgttgcaatacttactttgaaaaccaaatgagttaacatatgtaagatgcttagcataagacctgacacatacatgctaaaaagtactagttctttctataataaataccttctcccttccctgcattctcttttgcctggaatcactaatgttacatgctagttggcttagccttgtttcacaatggagttcagttacattgttcatattttagaggcaaaaaaaaaaacaaaacaaaactgaggctcataaaggagatgaaatgtgattata

SEQ ID NO: 249731 - DNA, 598 bp, Homo sapiens
aggtcaaggtggaaggaacacttgagcccaggagttcgagactagcctgggcaacatagtgagaccccatttttacaaaaaatagaattagctgggtgtggtggcacacacctgtagtcccagcaacttaggaggctgaagtgagaggattgcatggctccaggaagttgaaactgcagtgaactgtggtcacgctattacactccagcctgggtgacagactgaatccctgtctcaaaaaggaaaaggtaagaaaattaccttgggctcaggtagaagtcatgcttgcatttttcatcaggaattacatcttttgagcagagttgagtagttgattttggaattgtgccatttgtatatgccacagcatttttgccaacacatatattttggccctaaaaatagacagtgaaaaagagatgggattgcttctctttcgattgttggcagacctattgggtaacatttaatcattttgggctggacacggtggctcctgcctgtactcgcagcactttgggagaccatggcaggcggatcacttgaggtcaggagtttgagagcagtgtggccaacatggcgaaaccctgtctctacc

SEQ ID NO: 249732 - DNA, 492 bp, Homo sapiens
ttctgacagtcttctatttcttgtctaaaattaaaatcctttatgatttttcaaactttagtagcaatttgtctagccctagaaatccaaccctctccatttgaatgttatacttctactttaatgcgattagcataacaaaattaagtcctaaagaggccaaaatttgtactttgtcgttagtagtgattatccttccaaataaaaccttaaggtgtcaacaaggaataccccaaagataggagaacaaattacactgatttaagtggtggggctcttcaactaacaagataaagtggtcaagcaactttcccctcttaaaatgttactagaaactggtgaaatgctttgaaaggtctggatgttttcaatgggctctgttctactggttcatgaatgccttttttttgttgttgttaaagctaatacaacgacttgggctttttaaaaatcttctttcctattcacgattaaaaatgtgataaatcaggt

SEQ ID NO: 249733 - DNA, 137 bp, Homo sapiens
ctgactaattttatatggtctatggaccaagtgccaggcaatgtgcaagccattggtggtaagtagtgatcaagcagacgtgtcgcttctcctcgtggactttgtagtctttgtggtaggctgaagaatgccccccc

SEQ ID NO: 249734 - DNA, 466 bp, Homo sapiens
atcacatcacacgaagtgccatcagtttccaaattttatgttaaaagtatataagtagattctgcttaaagacaaccaatcttggtgtagaagaagggaaatggaattcagatttattgagcacaatctatggtattttacatgcatgatagcaaaacctcatacagtgtactcctgaagggtacagtggttaagagtgggtgcctgagctgtgttgcctagggtctgaattccctcttggctacttactagccatgtatcttggtgcagattatgtaaactctctctgctatcactttcatcattataaatagtaaaatagggttattgtaaatataaaatgggttaatttctacaatgcatttgcagcagtgcctggcatatagttcgaattaaatgttatcatttccactttactgatgtgtaaacagaagctcaaatataaagacaattgccttaatttata

SEQ ID NO: 249735 - DNA, 383 bp, Homo sapiens
agctttgctgtcgttgaacttggctttttgggaattatgaaatagcatcatagagctttagggtacaaaattgcattcaaagtttattcgttttggctgggcacggtggctcatgcctgtaatcccaacactttgggaggccgaggcaggcagatcacttgaggtcaggagttcgagaccagcgtggccagcatgacgaaacccagtctctactaaaatacaaaacattagccggacgtggtggtatgtgcctgtaatcccagctactcaggaggctgaaacatgaaaatcgcttgaacttgggaggtagaggttgcagtgagctgagatcctgccatcacactccagcctggatgacagaatgagactctgtctcaaaaaaa

SEQ ID NO: 249736 - DNA, 631 bp, Homo sapiens
cgccttgatcatggactcctgggctccggaactgtaagaaaatttgtgttgtggaagccacccagcccatggtatttcgttatggcagcctgagcagaggtggtagctatgtggacagtttttggacttctctattgtaacacaggaggcaacacagattcttcaagtctcacagctactccctagggatcactggggaacttggaaaaaatctattggctcagctagtgagcgatcacttcctgtaccactgttctgagggcggacttccagctcaggatcatgcgagggcattttgttgcccttcatcactcagcagtgaagaatgaaaatcaacagagctttccccagcctgctgcttaagcagctgctagcaggctgaggctgcccagcctcattaacccattagatgctgcgttcgcccgggagtcattcttaatgaggctgctgcagatgagaaaacagaagcaaaggcagaaagatgctacattgccagctttgaagatggagggaagaggtcacaaaccaaggaagcaagacggccctcaccagatgccagcacctcctgtgatattggactttccagcctccagattcatgagaaataaatttctattgtttataaattaaa

SEQ ID NO: 249737 - DNA, 367 bp, Homo sapiens
attcacagcgatgggagacctggtccagccctgtccattgtgacccacacctcctcaggactgagcagaaagagctgctgcaataaacagtttgactatcattcctgaagtgccagagtttgagcaaacatcacataagtgtgctgcagaaatgagagagtgcacaacgtgccaaatgtactaacattctaaaagcagaattgggaacacatttaatgaaaaaaatcattcagacttcagcactatacctcagcaagtaatttgagtaaaaactgaatactgaaggtgtttatttcaacttgattattctttattacattgcattactgttttatactgattaaaatgctgactttctatgttaata

SEQ ID NO: 249738 - DNA, 368 bp, Homo sapiens
tattatgcctgtgtcaaaattacatgggctgcttgttaaaaaaaatacaggttcctgggactcatccaaggttaatgaattacgctctcttggggcgggatttgggactctacatttttgaactgcctcaagtgctttttaagtgtgccttaaaatttgagatccactgacataaagggaaagcagaagaagaggaatctgtgacagaggcagagagggacttgcctgagttaagaggaacccagaggccggcgcggtggctcacacctgtaatcccagcactttgggaggccgaggtgggtggatctcttgagctcatgagtttgataccagcatgggcaacatgacataaccccatctctacaaaa

SEQ ID NO: 249739 - DNA, 537 bp, Homo sapiens
gatttgaaagctgatgaacgtagctatgaagagctttatgatgaaaagggttattactggcctcccatctactggcttatctttttttattctttaagtcatgtgacaaatgagggttctgataggattgtctttggtgtggtttcatgagttgacataattaagagccatttccatttggcaatgctgcaagaaaaacatttccagtcagaagaacaaggaaataacttaattagcaactcaggtgagcgctggctctttagaaagatgttaagattggagggaagacaggagacccacagaggcagcgtgccacagttgggtgtttagccaaagacacgttcttctgtctctttcctcctgcatgagtcttttctgactgttcacctgaaattggatatggaagggctctgctgctgctgctgccagcctggtagacagaaaacgtcagtgtcaaagaaaaatgattgtgtgtttggttccctccagttttcacgaaataaacatcacttggcaattccttggaaaaaaaaaagc

SEQ ID NO: 249740 - DNA, 569 bp, Homo sapiens
ttttttaactgatgtacttatatgtgaccatgaaagtcagtgcttgcttcctttaaagattctttggcttttaaggcacatgaatctatttatattattgtgtctctcaattatttgggcagagcattaacctgcaaggttcttatatgtatactcttaaacacatactctctctctctctaaataaaggaaaaaagtccttgttatatcataatctctaacattgacttttaatacattcagagtagtacttagaagactgccatgacaggccgggcacggtggctcacacctgtaatcccccagcactttgggaggcggaggcagacggatcacttcaggccaggagttcaagaccagcccggtaaacatggtgaagccccatctctactaaaaataataataataaaaatagctgggcatggaggcacaggcctgtaatcccagctactcgggaggctgaggcgagaggatcgcttgaacctaggaggaagaagctgtagtgagctgagattatgccaccgcactccagcctgggagtgataagtgagactctgtctcaatttaaa

SEQ ID NO: 249741 - DNA, 501 bp, Homo sapiens
tgggcggatcacctgaggtcaggagtttgagaccagcctggccaacacagtgaaaccctgccgctactaaaaatacaaaaattagctgggtgtggtggcaggtgtctgtagtcccagccactcaggaggccgaggcaggataatcgctttaacctgagtggcagaggttgcagtgagccaagatcatgccactgcactccagcctgggcgacagagcaagactccgtctaaaaacaaaaacagaacaaacaaaaaaacttctcaactttttagctgctgctttctacttagctttatagccttttggtagctgcttccaaattggcaaatatctggagtccctgaagatgcttttggacaatggtctgaggttgggacagtggcaggagataccattcacccaggatctccaggacaagagatcagcctggcagttacatgtgttatttatcaaactggttgccaggttggcatgaacgatgacatcagagattccgagct

SEQ ID NO: 249742 - DNA, 477 bp, Homo sapiens
ctggttgggtaaaaacgccagctaatacaaagatgagtattaggaaaacccatagatattacagtatctataatatggaaacagttcagtgatggagaagcttcttccctggaaaattaaaggcattaagaatctggctggggcttctgcgaccagttctagcgagctctttggatcctctgcctgtaagatcctcagcatgccaacatctccagcactcacagcacttgctccatctcgctgcgaaaaggctgagcatgggtctgcatgattaccagctgctggtccagccactgtgtagcctggtcttggtaccaacatcatttgtctgagtttctggccttgcccaccacttctggaatttttgttgggttatgtcttacttaataatttttagtgtttttttttaaacatgtattttctggataagagtcctttgttggttatatgtattaccaaatagcttctacttctatt

SEQ ID NO: 249743 - DNA, 489 bp, Homo sapiens
caggaccatggcctgcataccttgttgttgttgttgttgttgagtattccctaaaaggagttttgaaattgtgtactcccttgtacttgtcaagtcgacatctaacgttttatcataaatttaaatagttgcagaggatgtcatttccatcatattgtaaatagtgacattttaaaataaaattacaccgctctttcaaaaatatccaaaagaatgcaaaaccagacggacatgacacccattaaaatctatctgatagtatgtgaacaggttcttaagagttgtgccatgattttactttgttcttttttcccttttgtttctactcttttttctacttcctctatggaattttattctaatttaatatacgtttatgtttagaaacttctatcaatcattatagctttaaaaatttcctgataccgtaagcctcatgtgtaaaaatttctttctggtaagttaccattaaaatatatctggtgtgca

SEQ ID NO: 249744 - DNA, 197 bp, Homo sapiens
ttattgtacttactaattttgaatatagatgtcttgcttttattgctccactgggggaaaatatttgtaacatatttttaaaaatattttcaagggacattttgtagtattttttagtaaactgaaatacagatgcctgacaatttcacttctagaagtttatcatacagaaatatatctatttgtcatatagaatt

SEQ ID NO: 249745 - DNA, 368 bp, Homo sapiens
aatgatgaaattggtgggaggagactagagaagtcattgcaatttggcaattggtctgaaaacgtggcctgactcttagatataaatgataataaaatctcctaagattatgtaggccacatgtctctgccttcccgatcttcatttctattatcctaagacccagaggcctgactacggagggaaatgagtcctcattagtggtaagaatattgtatttgtgtgttacatgtcttttaaatgtctttttcccctttccatatgaacattttgatgcccatacttagtattttcatttcggtatcttcagcgtcccttagaacataatgcctaggtctgcattaaataaatgcatgcgaatgaatgaa

SEQ ID NO: 249746 - DNA, 347 bp, Homo sapiens
cgcttcctccacggagtgggactttggacaagtcgccgcccctgtctgagcctcgggttcgtgctccgtcatctacacgatggcacccacatcaacaagtatttatggagcgcctaccgtttgctcgtaggtgcggtttggcggttcaggtcccactgtgggaggaacacgagaattcattacagatactggagcagggacagggcctcgctgaaaagaaccattccggctttaacagataaaattttgtatataaagttagtaaggacaacacagtgagactgcctctctacaaaaaaatacaaaaatttgtgtacacacggacataaaagaataaaaagtacaaa

SEQ ID NO: 249747 - DNA, 467 bp, Homo sapiens
agatgaagaaatggaagctccagagttgaagaaatgtgtcttcactcccacaagtaatcttgaagttccgagccaccatgagagttttcctgacactgaggtaatttcctaccatgttgacaccaccttgcgccagtgttcaagaccatcacagctatgaaccttgttggcttgtatcagatgcctgctgggaccttggctgcccatagtgctctctaaagactccagctttccataactcctacagttttaagttcaaggaatgatgaagaggacgccaatgtacggatttgatttaccaaatcaggcctgtacagcagctgaatcaacctatgggaaaattttggctctctttaacattctaatttttgagaacaccattgcaaatacatgatttccaaaataataacaatgcacttaattaatcacattatagatcatcatataaaaataaatacctaaataga

SEQ ID NO: 249748 - DNA, 456 bp, Homo sapiens
caaaaagtagtgtctcatctcattttctaaagctaaaatgcttccaaataccttattctattccctgtaattcatatattatattttactttcttccccaaatactacagaattgaaaagagaacatttaaaaatacaatgacacttaggaaagtaaagaaagctaattttatattgaacaatcatcagattaaaaattacttattgaggctggacatggtggctcatgcctgtaatcccagcactttgggaggccgaggcgaggcggactgcttgagcccgggagttcgaggccagcctgggcaacaaagtgagacctcttctctacaaaagaaaaatttaaaagtgaggcaggaggattgtttgagcccaggaggtcacgactgcaataagctgtcatcgtgccactgcactcccacctgaacgacaggagtgagaccctgtctcaaaaaaaaa

SEQ ID NO: 249749 - DNA, 214 bp, Homo sapiens
ttgaagcaatattaaatccctaggagtttagctagaacagtgtgacagcttttttttcccttaatgttgctgttttatgcagactactttaaataaatcatattcttttggaataatcctccagagtcacccttttaaagttttgtagtcttttaaaactactcagaatgtgattgactcagtggcttatcttccattctactaatatttacca

SEQ ID NO: 249750 - DNA, 317 bp, Homo sapiens
ttaaagctccccatggaggtctaaagtgcagagccactgccctagttgagaaactttagctctcttccagtgctagaattttagaacaaactgaatttcctattgttgcatatgaaagtcttcatatcttttataattcctataaagtttaaaattatgtttatgcctttcttgatatagtaaattgttttgttactgtccttgcatgtttctttttatgtattatcttatacttttgcagtcatgtgcattttagtgaatttttgtttttgcagcagcctcaaatattgcatgtaactcttaacaatataattaaa

SEQ ID NO: 249751 - DNA, 404 bp, Homo sapiens
gtgatgagtatgtcagattgcttactggtagtaatcatttcactatggatatgtatatcaaaacatcatgtcatacatgttaaagttatgccataaaaatagctatatgtgggccaggccaggcatggtggcttatgcctgtaataccagcattttgggaggctgaggcaggaggattgcttgaggccaggagtttaagaccagcctgggcaacgtagtgagaaacctgtctctccaaaaatgtttttaaaagttatctgcgtgtggtagtgcatgcctgtgatcccagctacttgggaggctgaggcaagaggattgcttgagcccgaaaggtagaggctgcagtgacctgcgattgcaccactgcactccagcctgcgtgacagagtgagaccctgtctctt

SEQ ID NO: 249752 - DNA, 344 bp, Homo sapiens
caaaaaaaaaaaaatgttcaggagaggcctgtccacaagggcagaaagcggactcgcgggtgctggaaactggaagaggggaaaatggaaagcgattgctaaattgggaaccaggtttttttggggtgagtggtaatggaatgttctggaattagagattccagaaatttatgatggtcacataactttctggttataaattgtacactttaaaacaatgattggccaggtgcggtggctcataactgtaatcccagcagtttgggaggcagagggaggaggatcaattgaggccaggagttcaagactagcctggccaacatagtgagacccggactcaactg

SEQ ID NO: 249753 - DNA, 372 bp, Homo sapiens
acactgggttgttctgcagggagtcagtttgttatagttttcttcctctactttttttcatcagctatactttgttcagtaataattcacatgactttatacaaaacagcacagatttagaaagaccaaggtaattttttttttgtataaatttatgggagccaggtgcagtggcccaccccagtaatcctaggctggggcagtagggtctcttgagcccaggagtttgagaccagcctggcaaaatagcaagaccctatttctacaaacaattttaaaaattcgctgggagtggtggcatgtgcctgtagtcctagctactcaggaggctaaggggagagaatcacttgtgcccaggagttccaggcttta

SEQ ID NO: 249754 - DNA, 473 bp, Homo sapiens
aattaacttctgctatttctatgtatactagaaaatttttcagcatgaatggaaaacctgttatataaaatgaattccatctattttagacatattgtggacattattatagctaaataaactaaaatgtattttaaattgtgttattataaatatgttattttaaaaggctataaaagttattaagtgttgctcggtgccatggctcatgcctataatcccagcactttgtgaggccgaggcggtggatcacctgaggtcaggagtttgagaccagcctggctaacatgataaaaccccgtctctactaaaaattcaaaattagccaggtgtggtggcgagtgcctgtagtcccagctatttgggaggctgagacaggagaatcacttgaacccgggaggtggaggctgcagtgagccaacttcataccactgtactccagcctgggcaagacagagcgagactctgcctca

SEQ ID NO: 249755 - DNA, 480 bp, Homo sapiens
agcgaattggattagagcccatcctaatgacctcattttaacttgattaccactgtaaaaatactgtctccaaataaggttacattctgaagtgctaggggttaggtcttcaagatgatatattttttgagggatcctattcagctcacatcaggtgccaccatcccagaggcatcgtaaatagtgagagactggggataggaaagatcttacctgattagtaaaagtgcaagatgaggaaacaggttcaccccatgctccccattttgtttttactattatctctttgtctgaagcagggccgagctgggggaggagagtcacttttcttttaaatggaattcagagttgtgactgttacacagaatcagacgttttaggtcctgaagtgagaatgttttctgtgattagaagtgacaacacaactttttaatttttatgttttaaataagagagtaatgagaaaatacaaaaaccaaa

SEQ ID NO: 249756 - DNA, 378 bp, Homo sapiens
caagtcaagcctgactgtcaggatccccagcctttctctctcctggctgagtgaacttgggaaaatccattaatctctccaacgttcagcttccttgtctacaaaatgggcgtaataatagtgcctacctcacatgggcaaagggattcattaggtaaagcccttagtctattgcctggcacatatcactcaatgaatgtttgtttttcttgttattagttgtaaagatgattttaagggagattttctctttgctgtaagacaaactctctgtgtactcttcacagagggttagtgctattatgataaatcactcctgtctctttcttagaggcacctggacttgcagatactgtaatgaagtagtaaatcaataat

SEQ ID NO: 249757 - DNA, 1000 bp, Homo sapiens
ggaaccatggggcacagccccgggcgaccctcgggccggcgggggccttccgcttcctggcgtctttcttccccgccccgccggctgctggggaagcggcgggcgcccagtgcctggaggtcgctccctcgcctcctctggctgcgggaacggagaggcggcggcggccggagcagggtgggcggcctgagccgagagcccggccggcccccgcgaggaatatggcgacctgcggcgaccggagcagcagcggcgtcagttgctgcaccgccgacttcttggagcagcgaaagcgactcgcgagaagacgccgccaagtggaacccgggccctgcggccctgggagggggcagcaccgacacagccatgaagccccgggcgcggcgctgggcgccaacgagagccacggcaacctccagacggcgccacagcaacctctaggcagtgcccacaccagcctacaggtggcgcccctcgcactgcacctgccgcggccgccccgggtgtgaactgcgctgtcagcagggccgcgctgacacgggtggcccaggcccgcagcagccgaggagcccaggggcactgcccggggtgacgagaaggagaagacggtgccccagaaaaaggcaagagctcagagctcgggtccccgtgccaggaatggccaggagcagaagatggagaggtggagatggagaaggagaagcagcaggtgggaaggagcggcgctccaccggtggggtcaacatgcgctggctgagcttagagtatgaagaggatgaagcaagtcagaaagagcggaaacgagaaggtgcaatgacacagcagagcacaatgcagaatccagccctaggactccaataaaggctgggtttaattccaactcacaccctcccacccctaatcagagaggatcacaggagagagaggacccaaggaacactggaacctgaaggacaggaatctgaggccaagactgattgctggaaattgtgggaatcag

SEQ ID NO: 249758 - DNA, 312 bp, Homo sapiens
tccctataaaccgtgaaattttagaagaagtgacaaaacatacctatattgacagtgagttatttgcattgagatatatatgtccatatatatgtgcatatatttatacatttttttccggatatcaattttgtgatctgtcctttgcttctccttttttctcttgattcttaccttttgccattgacactgtttactggtgtctatagtaagaaatagtctagaaaaattaaatgagaggtttctaaaattgttatagtttggtatgtttggttaaagaataaaatgaattttaaaaaattcagccttaca

SEQ ID NO: 249759 - DNA, 464 bp, Homo sapiens
gatttgtttcattgattttacatatattaatagtgcaaagcactgtacaaatgccaaagagagattcctgccaaagatcctgccctagcagggtttgcaaccaaacagaacagaaaaacttaattaaacaagcaattacacaaattacttgtgcaattattaatcctgaactttatattatctcccttctgtgtggaacattcttccctcagctattcccacagcagggtaaatctcatcctcccagtcatcaatattgggcatgaggagcttccatggcctgtgattggacagcaattggtcttagctcaaagactgtttgctttttgtagaaaaaccaggcattatcttcctgcactcaaaataaggcttaattttttcttgactataatggtagtaaatgtcaattgcagtaaatctaacgcaagctggaaattataaaagaatatatataaatcatatgt

SEQ ID NO: 249760 - DNA, 370 bp, Homo sapiens
caggcatatatgcatgtgttcacaaagtgacatcaaggacatagaaacatgtttgtgatgtaatgttgagggaaacaagcaggtcacagaatgttacaggattttataaagatgtaaaggaattttactaaattatgggcaatcatactatggcatccttttttctgcacctttataactttctcttccttaaaagtatttaactgtgagatgtattttgtcaggaaaaaaagaaagaaagaacacagtgctagcattaaacattaaacattttttaaaaaacatttttacacttttaaattctaatggatatctactttgggccagtagagtaagagggaccagagttactttcccatctgaaacaaat

SEQ ID NO: 249761 - DNA, 755 bp, Homo sapiens
taggtaaaattattaatcataaagctatatgaatttattttattccatgttattttattattccatgttattatttatgtattgttaggaacatttgcttagaaatcatatttggacatagtatcagatactttacatcctttgaatcagttattttataacagtatatactaaacatcattactccttttcaaacataaataatgcaatacaaattggacaaaaaattcaggaaagatctgggatcaaaaaggaggtattgaaacatcacatgtactccataattatatacaaatattttgtacccataatatttaaaatacagaaaattaaaaggtacattttcctcaaagtgcatgctgcttttgctatgcaaaactgcaggatatggaaagaagtgtattaaaacactaaatcactttatgtggaagataaaagggatggtatccaatgtacgacttcatgtagtgcactgatacattcaatacaaatgatgtattaacttcaagataacatgagaaagttaaattatctaacttatttcaaactaggggatagtatgttctcattattagaagccagaattctgcttatccatttctattattagaaaaaaacataatttttattcttgtcttaaaaatagacaccttgatataattctctgtaaatgtagcatgatagtctgtttacagagtttatatcattccaagactgcacttctaaagtgagaaaatattaaaggatataaactc

SEQ ID NO: 249762 - DNA, 356 bp, Homo sapiens
aactaaacaaaaaatcatagtagatattagaaagtatatgaaatagaattgaactttaacatacattctatatatagtttgtgggatgtccttaaagccacgcatatagagagatttattgctctgaatgcatattaaaaacagaggtaaaaatcactgagccttagctcacttagatcctcacttacgatctatctcaagaagtcggaaaaagaacagcaaattaagcccaaaggaaatagaagcggctgggcatggtggctcatgcctggaatcccagcactttggagactgaggtgggtggatcatctgaggtcaggagttcaagaccagcttggccaacatggcaaaaccct

SEQ ID NO: 249763 - DNA, 551 bp, Homo sapiens
cccatggacttagaagccagtgctctgaaattgttccagtgttatacatgctaaattataaggatggataaagtaatctgactgaaaaatcaccaaggtgatcagagcaagacatccaaaggaaactatagaaatctatcatctgagtggccagtttggggttagatgtggcaaatttaagactgtcgccattagtgtaaattgacctttgttaaagattcctgcgccagggccttctgaatctgaaggactggaaataggtaccaagagtgtgtatttattgtaaagctcccaaggtgattcttatgcagccaatcctacaattgtccttggattaaagtttgggaatgatattatctaaaattaatataatcaactcaaggtggcagaggggaaatcaatcaaaccaattatttaaagttaatatataaagagatacactggttttggatgaatttcttttttaaaaaatattagctttgttggtattatttatacaaaaagggcctttcttcttccttaaataaaaacaatcaaaaagacaaatttgg

SEQ ID NO: 249764 - DNA, 664 bp, Homo sapiens
cattagcacattgaaatttatgattaggttaatgctagaaagagaatccaatattctcattgttgtgccttcttatagtacattcagaaaaatttaaattcccaataataagtaaaattgaatcaatatttttaggcagatacatggggaaatcaataataaaagattgcttactatatgtctggtactctactgattaaatactttaatggcatttaacttattgaattagtttttaaataaatatttaaattaaatagttaatagtatttaaatagtttaatgacttttactcaaagataagaagctgaattcattgactaattaatgactaacttgtcacacagctagtgggtggcagtcagtagttgaatttggatttctgtgactcaaagacctgtattcttaactgctgttttattatactgtggtttttgtgagattttaataacagacctctagattttaatgatagatctctttcattgtctgactcttatgtttatattcaaataaacttatattgttaaaaatgtcatcagtgccggctgggcatggtggctcacacctgtaatcccagcattttgggaggctgagatgggcagatcatgaagtcaagagatcaagaccagcctggcaacatggtgaaaccccgtctctacta

SEQ ID NO: 249765 - DNA, 618 bp, Homo sapiens
tcattgcagatggagccaagatggccgaataggaacagctccagtctacagctcccagcgtgagtgaggcagaagacgggtgatttctgcatttccaactgaggatctcactctgttacccagggtggagtgcaggggcatgaacacggatcactgcagcttcgacttcctggctcaagcaatccttccacttcctggctcaagcaatccttccacctcagcctcctaggtactggtaactgcatcctgggcaatatccccagctgaaagattacgcttcccagccttccttgcagctagacgtagccatatgacaaaatgacgcccaatgaagcatacatagaaaagtcatgtgagacttctggaaaagcttctgtaaaagtgaggagcagacacccttttctttttcttctcctttctcttgctgttggcctggaatgtggacctgatggatggagctctggcaatcatcttggagtatgaagtgaccttaaggatgaacagaaaagaaaatgagcctgggcctttaatgacacagtggagctgctcccagcttggctaccttcctcttagtctgcttttatacgaaaatatatatatatcttgtttaagcacaaa

SEQ ID NO: 249766 - DNA, 612 bp, Homo sapiens
cacagagagacagtccaccacctctaccctcttaactcttccttagaaatcctactgtctgcagctgggaatgaatggaatgaaggtcaaggatgaagatctcactctgttacccagggtggagtgcaggggcatgaacacggatcactgcagcttcgacttcctggctcaagcaatccttccacttcctggctcaagcaatccttccacctcagcctcctaggtactggtaactgcatcctgggcaatatccccagctgaaagattacgcttcccagccttccttgcagctagacgtagccatatgacaaaatgacgcccaatgaagcatacatagaaaagtcatgtgagacttctggaaaagcttctgtaaaagtgaggagcagacacccttttctttttcttctcctttctcttgctgttggcctggaatgtggacctgatggatggagctctggcaatcatcttggagtatgaagtgaccttaaggatgaacagaaaagaaaatgagcctgggcctttaatgacacagtggagctgctcccagcttggctaccttcctcttagtctgcttttatacgaaaatatatatatatcttgtttaagcacaaa

SEQ ID NO: 249767 - DNA, 662 bp, Homo sapiens
tcaacatctcatttctgtagatctccagttatatctattataatgtgacactgggattaggtcatctgccttgattactaccagtcccattagactagatgcctgtagaaggcagggtcctggcaaactatcaatgtattcaatttctttatatattattgagacagacttcccctgttccccaggctgaagtgcaaataaaagaataaaacaaaaggaaacataaactgctcctaaggggagaagaaaaggagcggaggagcggacacgacacttcccccagcaagcagacgtttctggttcttctctctctctccttcccacatcaaccacaaatgccatcgacctcctccgggttcccacgacagaggccacagttcaggtccccctcgcatcactcgaatccactgtcaaatgctccctgctggggtctcctggagtctctccccaagccagggggctccctagtgcagcctgaacatctttccacggcacgatgccctcactgcccacctgaacaacctccttagctgacatctttctaaatcgaggccagggtaacagtgccaattccaccctctctacaatctctacaaccacactggctcgccttcttggtgtttcctggcttggcttcactgctccttccaaatgtcctccac

SEQ ID NO: 249768 - DNA, 399 bp, Homo sapiens
tcagccagacatatgcctcacttgacagctaatctatttcttccaacacaaatgctgcagcattcatattatctataatgtaaagaaatggatgtcatagataagccttttgtctacagatatacaaagaaactttgcagtaagtctaaaattagacaagaatgttacactggtcaccttctgcaggtctttgatccacatcttcttccccataatcccagggtaggcacactgcagaccccttggaaaagtgcagccatccctacaggtccagtgctcacctggttatggaatttcctaggaataagaagtggagcccctgcacttctttttaagaaaaaacatgatctttggcacacctagatctgaaggataatacggcagtttaggccaagctac

SEQ ID NO: 249769 - DNA, 334 bp, Homo sapiens
ttgaaatgtaagaagttattttagttttgtttggaggtaaaataattagactagaaaataatggaaacttagcagtagaaatgttatctactaattttagtgtaattaaaatgttagccaggcgtggtggtgggcacctataatcccagctacttgggaggctgaggcaggagaattgcttgaacccgggaggcggaggttgcagtgagcccaagattgtgccactgcccttcagtctgggcgataaagcaagactctgtctcaaaaaacaaatgaacgaacaaataaataaagagcaaaaaatgtgtgtattttatagttgaataagaaaaaa

SEQ ID NO: 249770 - DNA, 881 bp, Homo sapiens
atggctaaaaacagattaagtcctcataataacagcttaccctgggtccagggtagaatgaacaacaaactcatacctagataaatgtagtcaaaacataaaatatagaaaaataattagtaaagtcttcagtaagaaaataacagattatctacaactggaagacaaaatagcagtatggaggaaactattgaaagatattattcagattcagtgttagacacaatgagtgcatgcagtaaaagtagaaagaaaattttgtttatcaaatagtatggaaaaaatggcagacagtgataagctaatatttatgaatttgggcttgatgcagagaattgtagaggaaatttaatgtcaaaatatgccagaaaacccatccttgaacaaggtatagataggggcaacaatttattagtggactggaaatgaacagattgaaaatgaattacctgtattttatccccaagtggaaaatttgtattctcccaatttgcttataattatgatttaaagattgcatctctttcacaatattttcttttgaatgtgacctcaaaatattaaaaattaaggatttggcaaaaataatggggcataaaacacattttctatataaaaggatgtgatttaagaaaattttaaaagtggataacatatatcaacaaaaatttgtaaatgggattgagtccctaaaacctggaaaaactgacatgggctagctatttattcactcatcgagttacttattccttcgtaaaaaaaaaaaaaaatcatttgagatgataaaaatggtagggtatagtttaagatgaactgaatgaaattgaacagtaaataaaataaccctgataggggttattttgaggacaagccccctagac

SEQ ID NO: 249771 - DNA, 658 bp, Homo sapiens
agaataaatacctaattcttcaatggccagacatcaataaacgtccacaagcatcaaaaccatccaggaaatcatgacttcaccaaatgaactaaataaggcaccagggaccaatcctggagagacagagacatgtgacctttcagacagagaatttagaatagctgttttgaggaaactcagtgaaaatcaagataacacagagaaggaattcagaattatatcagataaatttaacaaagagatttaaataactaaaaagaatcaaacagaaattctggaagtgaaaaatgcaattgatgtactgaagaatgcgtcagagtctgttagcagcagaattgatcaagcagaagaaagaattagtgagcttgaagatagactattcgaaaatacacagaggagacaaaagataagagttattggccccaatgaggaggtagagagatagaggtagaaagtttattcaaagggataataacagaacttcccaaagctagagaaagatatcaatattcaagtacaggaaggttatagaacacaaagaaggttaaacccaaataataatcaaactcccaaaaattaaagacatttaataatcaaactcccaaaagtcaagagtaaagaaaggatcctaaaagcaagagaaaagaaacaacat

SEQ ID NO: 249772 - DNA, 682 bp, Homo sapiens
cggtccctctatctgatcagatgtggtggggacagaaacgaataccagagccgaacaaacgggtcccaatgatcaatacaagttctactcagtgaatgtggattacagcaaatggaagaaagaaggttcagatttctacatgaaaggttttactataaagctcctttagaatgaaggtcttccagaagccatccgcacaattttccacttaacaggaaatatttctcctctaaatgcatgaaatcatgtcgaggtaatctactggagattacactgattaataaataactgaaagttgaaaaaaaaacccaaaaaacccagcatctggctatgttgcctaggctgttcttagacttctggcccctcgtgatccgcctgccttagcctcccaaagtgctgggattacaggtgtgagccaccacacctggccgattttccgattcttaaagaagcttgttaaaaatgttttgacggtcttttctagttctgagctggaaagtagtctgaatgccctagtctcacataactggaacagaattgaggagccaagatttgaattcaactgtatcttaacttcaaggtctatgcttttaaccatttattatatgtattaatccattttcacactgctgataaagacatacccaagactgggcaatttacacaacaaaaaagtttattg

SEQ ID NO: 249773 - DNA, 466 bp, Homo sapiens
tgcctcccaggttcacaccattctcctgcctcagtctccccagtagctgggactacaggcacccaccaccacgcccggctaattttttatatttttagtagagacagggtttcaccgtgttagccaggatggtctcgatctcctgacctcgtgatccgcctgccttagcctcccaaagtgctgggattacaggtgtgagccaccacacctggccgattttccgattcttaaagaagcttgttaaaaatgttttgacggtcttttctagttctgagctggaaagtagtctgaatgccctagtctcacataactggaacagaattgaggagccaagatttgaattcaactgtatcttaacttcaaggtctatgcttttaaccatttattatatgtattaatccattttcacactgctgataaagacatacccaagactgggcaatttacacaacaaaaaagtttattg

SEQ ID NO: 249774 - DNA, 421 bp, Homo sapiens
gtcaaggggagggtcaggtggaggcagccagctgtgagtgaggaacagcacaagactgctgagaagctgatattaagaaggcagagccagatggccagacagaagcttctaccaaacctcctcctcacaggagcaccagattggacaaccatccacacaaaaaagtaccttcatgagaaccacaattcaggttcttaccaagccagataagtggttgtcatggagacgatacgttgtgacaacaactgtgatgccaggtgttcagagcagcacactggcaccccactcccagagaggatgctgaagcagattgaatcacttcaggagaaaagcacacttaggcacgaagccctggcttttcttcttctttcttctgtgtctataatgtgttttatcttaaataaaacttcataaatgccat

SEQ ID NO: 249775 - DNA, 473 bp, Homo sapiens
tacatatgagtgcataatagtttttaattttaggatttagtgtaaatttagttttcataaataagatagtcatatccacatttaatatttttttctaataattcagtatctcttttaatgatttcttcactggtttgggttttcctaccctgtttaagaatgataatctacaagacttccctactgactactctgggtttgttactctttggagattatgttttttaaatcatttaaacagctaagagttaacagatttcagaccttgcttactatgcatttatagcagatattttatttaagaagtatttcataactagaaatactacaagaacactaagaatatagtttcagccaggtgaggtggctcatgctttgtaatcccagtgctttgcaaagctgaggcaggaaggtcacttgaggctaggagttcaagaccagcctgggcaacatagtgagacccgtctgtacca

SEQ ID NO: 249776 - DNA, 388 bp, Homo sapiens
caatgagtcaagctaacgactacatttcccagagtagcaagatttgcagcaagacgtgcaatgtgactaagttctggtcaaagtaatgtattcaggaatgtgtgttacttgctggaagtctttttaagaaaggagggagcagaactttcttcttcttgctatttggaatgcagtggaatgcctagaactgaagaagccatcttcaaccataagtcaacacaccaagtcaacatgtgtgttgcaagaaaaaaagtatgctggttttctaatgatcctggagccatgaaattagttctagactgcctacttctggatatcttccctgtgagaggaaataaaactcttttcttgtttataacactgctactctgctgtttggtcacttgca

SEQ ID NO: 249777 - DNA, 526 bp, Homo sapiens
actatatgatcctcatcaggccaatccacgtcacagaatggtctaggcattggatgagtgcctcaatctgagccaatgaaggtcattgctgagacattttactggttgccaggctgcaggcatcccaggcttcctgctgccctcatgtctacaacctgtcgtctggaacattccaggagccacttttatcacttgcagcaatcttcttcagtgagttccccaggacttgatttcatcttacaatctgattccatgtgtctcccatattttaaggattctttattatttctggcttacagagaacaaacattattttttgctttcctggtctgttctagattttcaaaaataactctgtcacttctgttatatggtatcattgcttgtaattatctatttacttatctgtctctggactggactctttacagacaggcaataactaattatctgtctgtctggcatttggtagtcactcataaatcgtttattgcattactaactaaataaaaaagttgaccttgca

SEQ ID NO: 249778 - DNA, 289 bp, Homo sapiens
cttgaattaggaatcacataaggataaattcttatgacatttactcaacactctattggaggtctaagttaatgcagtaaagcaagtaaaagacctaaaagacacaaaggctggaaaagatgaaacaactgtcattattcatagttatgagtgcatatgtgattaatccaaaaaaaccacagatacatacttaaaaatcaatcatgaagattaacaaagttgttggatacaaggtcaatatataaaaattaattatatttctagatactggcagcataaagttagaaaa

SEQ ID NO: 249779 - DNA, 426 bp, Homo sapiens
caatgtaaaagccctgtaacgacatcctgagtcatctatcttctttgttcagagctgactcctaaaatggaaggcaacacttgagaaatacctgtaatttgaagaacttctggtggtatatctgaaaaacagtgtggtataagttggaatggaccgatcaatggtttttcttttgtctatttttatatgcagttggcaataaaaaaaaaattactgttgggtgtgaaaaatgggcctggtagctgcaatgcttatattaatagtagtatcataggagagtaatcaaatgacttcagagtaataagaaaaataccccttagtgttatcaatggcctatttgaaattattttaataaatgaatcatctttcaaaatttgccctatatatgtatgtgcatttatgctctatataggtttaaaaaaaaaa

SEQ ID NO: 249780 - DNA, 488 bp, Homo sapiens
ggagtggatgacccggcccagaagtcggtagaaaagcacagggtcggaaagcactggaagaggcagaagcgacgccccgggagccccacagggggtcctttcagaaggagctcacctccgcagcactgacagggcccggccacccctcggcagtctgggtcaagcaccaggtcacctgaggatgggaggagtttgggattggaggaggcgagtaagggctgaagcaggaggtaaactgagccccggtcaggaggaccacgccaggtatcccaagggtctgaactacttcctgtgggaagtgggaattcgcttggggttctcgaggcgagggaaggacctgggtgtgacattctgttgccccacaaggctggctcataggggtcacttcctcggggtggcccacaggctctggcgtacagctgcctgtgtccttagcaagggttcccattttcgggtccctcacttccaagtctcctctatctggcctc

SEQ ID NO: 249781 - DNA, 302 bp, Homo sapiens
gcggatcaaagatggatttgagctctggatctgaaccaacgaacacacaatgacctatgaattttttggacaggaacattgaagatggcatgagctatccagtggagacacacatccatatgcatgtgcatttttatatatttttatgaaatgcatgacatgtcttaaaaagccatttatgtagtgtgtaggtgtgagtctatgaaagaattggaaatgaatgtatgcctcctttcactttgttgtttagtattccttaggaagaagcaatattgaataaaattttaactaattatccaaga

SEQ ID NO: 249782 - DNA, 246 bp, Homo sapiens
caatcttaacagtctctcttttttttttaattagttagaaactggaaatatttctaaagtttatttggatggaagtttagaagtgaatattgatttctcttatcttttccacagaaatactcatgggccaggcgtggtggctcacgcctgtaatcccagcactttgggaggccgaggcgggtggatcagttgaggccaggagtttgagaccagcctggccaacacggtgaaaccccgtctccacta

SEQ ID NO: 249783 - DNA, 373 bp, Homo sapiens
gacccggcttccctgggccgtgctcccttgagtcccagtctccctgggtccctcgtccccagccctggcgccttcttctgcagcgccgtcccgcaggcccctggacccggtggacgggctccctcggcacccccgcaggtcccgcgccctcttccctccttgcctcctcgtcccctcacgctgtcccttccttggggccccagcactccgtccctcccttgcaggaaatcgggcctatggcggggctgggtcggcggcagggcggaggtgagccgcatctgagtaaccgagtgatcggggaggctggggcgcggtcctccggggcccgattgctgcatggcgtgaagataggtgggtggacggctgtggggaa

SEQ ID NO: 249784 - DNA, 492 bp, Homo sapiens
ccatatggagctgtaactatatgagatgactgagggaagccagcgagagaaagacttggcagtgaggacggaatctcgtttacttggaagagtctggctgggtaggaattacgttcattgtccttttcagcaccttagcgctaagccagcccctcatgggagccaggccactggctgcttttaggccgccagggactagtgaggagtctggggtttctgcaggtacaacaccagtgccatgaaggtgagacatggtgacagaggaaggtgtctgacttcagagcagggagtggtttcaacttgaggattctggttgagtgaatattgaataacaaggcaatgctcccactctgtcttgctcttttcttccacgggcttggaaaatattcacaagggggaaaacttggcccgaggtgtgtatctgaaggttggtaatgacacgcttgcaaaattagatcatccttgtgcatgggctctggaggttcctgccaa

SEQ ID NO: 249785 - DNA, 451 bp, Homo sapiens
cactcatacagaacacaaacacacacatctatacacaccccataaatttctcccatgacactctcagtgcacacactatacacacactccccttcccccatgcccctggcaggtacagattgtaactttcccctacacccatcggcacacatctcactcctgtgctgctgtcacacacacacacacacacacacacacatctctgcccccgccattcagacagaacccagacttcaaaggccatagacccaaaggacggggtggggtagaggggagagcttcccagagcttatccctgccaagtgtggaaacccttcccaggaaggcaccttccatcagattactgttcaatgtgattaagcaggctggagccacttcaactacaagtgggaactgtgaaagctaccccatggtctaactaaagggttttcaagcttttgtgaccatgacc

SEQ ID NO: 249786 - DNA, 294 bp, Homo sapiens
tattgtttcattaaagactcgtagatgcttctgtccatgggagattgcattttggaggatttgctttagctttatattggatatgaggaggaatccacattttctttttcttcttcttttttttttatttcttaagactgggtcttgctctgtcacccaggctagggagcgcagtggtgtgatcatggttccctgcagccttgacatccctggctcaaatcatcctcccatctcagcctcctgagtagctgggactacaacaggcacatgtcaccatgcccagctaattttaaa

SEQ ID NO: 249787 - DNA, 415 bp, Homo sapiens
caagggaagtgatttttaattataccttctgtaagtacctgatattgtgcttaaaacatagaaaattaatcaaacaattcaactaaatggtaaattaccttagtgcttgtggaaatggaatttcatagaaaatgctaagtaaaatacaggaattgcttatcagagttttctttgcctgaagttgtaacttgcttgaattttctttgtcttttcatatacccttaggatttaggaggaaaaaaagaagatgcaacaaaattttagagtagaaagtgatttagaataaatatcactctagcttaaatattttgttctatagttttgatggtttatctccaatctaaaaatactgcaagggcatatgaaaaagttatcatatgtgtatgctaatattttatatatatattcaactatt

SEQ ID NO: 249788 - DNA, 255 bp, Homo sapiens
gggtcaatgaaggcctttttgtgggtccataaagatatagtcaagaaggtatatgaggtacacttccttcttgcatgttataaatgagggtgggttgatcccttccaaagcctctacatggaaatgatttagaaaatgacaggcgtggctgttgagtatttgcctttataagccagagggcactgaatgcaaattgaaaaagcataaattgattaaagtagagctagtatttctagaggaattttaaaggtgttt

SEQ ID NO: 249789 - DNA, 398 bp, Homo sapiens
agttaaattggtttttaacaaaaccaattttatcataggcttgtgaaagttagagataccaggaagaaatcacttttctcagacccaggcaaagtaggaccaggaaggtctgaaggagaggaggctcatgcttgcatatctgaaataagaactgtttccaaggactttctaaaaatcctttcatatccttcacaaatctcctgctttgataaggtttatcactagacattctttaggatttcagtaattcggttaagatgttcttgaaagaacacttgcatctccaccaaggaactgacaactctggctttgaacctctggaagtgatgaactctgtttccaagcagcttatgtaatctctttttgctaataaaagctcccctcacccttccctcact

SEQ ID NO: 249790 - DNA, 355 bp, Homo sapiens
gacgagaaaggcttttgaaaatgtgctccgatatgattatagcatgtaaaaatacatgtatttatttcacataaaaaatgtaagttgaactttgtaagagtacaaccactttgatttacctctgtattttttaaacactccagcctgggcaacagagcaagactccatctcaaaaaaaaagagcagctgcagatgaatgattccatttgaagtgactgctggcaggaaaactgggcaggagcctgttaaaatggctgtgtgtgatagctttagaagacttcgggtaaacaatgcacatagtacacagagcctaacacaaaataggagctcgttaaatatatgcagaaagaagaaa

SEQ ID NO: 249791 - DNA, 327 bp, Homo sapiens
attgagtcatgctatataaacatcacttgttttttaccttttatatgtactacatcactttgaaaatgtgatgacattgacccttttccccagaaaaatgaacattctcactaaattctgtagataatttctcggcattcatgaactacatgaagccattcatgggcaaggactccaggctaagaaccctggtagcttttttcaaaattttcaaaaatttaactcctgggctccttccatcttatccccagcatctgaacacctctccgtgccaataactgtttccaacaccatattcttctaatggctgtgttatgttctgcttta

SEQ ID NO: 249792 - DNA, 340 bp, Homo sapiens
atacatctgaagagttatgtgtgcatgtttgtgggggatgcaaggacctaattggccctagaaatctgaaacagggagaatcactgaagccaatgtccttaggcccagagctaacagttggctatgaaaacttgtactgacatttccctacctctgggaaggagattatacagttagttaatacgtattttgagtacagagataaattattcaattcagaaccattttttgagaacttactaggagtctgcttctagactaggcaccaggataataaagattagtacaatacaatcctttctctggaataactaccagtagcaagtgaaaaggtagaggc

SEQ ID NO: 249793 - DNA, 460 bp, Homo sapiens
tgcccagttcatggtattctgcaacagcagcctggcagactaatacaccagcattctcttcactagtgttcaagagttcaacaagtagaggagcatcacctctgtccacacagtttggatatctgtcctcacccaaatctcatgttgaattgtgatccccagtgctagaggtggggcctggcagaaggtgtgtggatcatgaggcggatccctcacggctcagagctgtctttgtgatagtgggttcccgcgagatctggtcatttagaagcgtgtggcacctctggcctctctctcgcctgctcctgctctcactatgtgactcgcctgctccctcttcacctgctgccatgagtaaaagctctctgaggcctccccagaagctgagtgatgtgggtgctatgcttcctgtaacccctgcagaactgtgagccaattaaatctctttttcttttttaga

SEQ ID NO: 249794 - DNA, 471 bp, Homo sapiens
cccagggaaaacagtgtctgtccccacggaaagaagaagggcagctggcagggccacttctgctgcaaaggtgattttactatgcagccactattaaaaaccacagatgttcattgatgatgatgatgatgatgatgatgatgatgatgatgatcatgatcatgatgatggtgatcatgatgatggtgatgaagacggcaatgactgcagaatttggggaagaggaagcctgaaggagtccacaaaacaatgtccttcaaatcagagtttattcaatgctgatttttcatttttctatggttctgtttggggacaagtcagtcaaataacttgaacctcagcgtcctcatctgcagaatgggaataataacagtttgtaaagttatcgtgaagatgacacaaaatgctggagacgttggacgtgctctatagaaaataatttctaaacaataaagaatattataataaaca

SEQ ID NO: 249795 - DNA, 361 bp, Homo sapiens
catctcttatgctgtttattgaatgactagccatgtgttttcctggggtgggaacagctgtggttaagagcatgagggtggccaggcgcagtggctcatgcctgtaatcctagaactttgggagacagaggcaggtagataatttgagctcaggggttcaaggccagcctgggcaacatggtaaaaccccatctctacaaaaaatacaaaaattagccaggtgaggtggcgcacgtctgtagtcccagctattctggaggctgaggtgggaggattgcctgagcccaggaggttgaggctgcagtgagctgtgattgtaccactgcactccagtgtgggcaagagagtgagaccctatctc

SEQ ID NO: 249796 - DNA, 534 bp, Homo sapiens
gcagaggaaggcggagaactgttcctgattaaaagagactggaaaaatgcaactgctaaaggcaatgtatggctctctattggatcttgggatcagggaagaaattgctacaaagaacatcattgggacaattgacaaaactggaatatggactgtagattagttgatagtatcagatcactgttaggttttatgaagtggataactgtgtgtggttctgtaagagaatgtccttgttcttaggaaataagaatactgggattgcaggcatgaggcaccgtgcccagccccattcactctgttcctgcttctgtttctgagacttcccagatgcatccaccctgggcctttgcacttgctgtttgctttacctggaggaaaccctctgcatctgccatactgcaggcctctccaccagccctcatctgcagttccttcctagccagacacttgcagttgtctggttcatttattggctcactcacttattttttgagagtctccagcctgggcgacagagacagactccatctc

SEQ ID NO: 249797 - DNA, 553 bp, Homo sapiens
agagtaagacatctctactcttccgtactcatttttttaagcaaatgaatgtattacttttgcgataaccattttagtacaaatattggcatattatggagtagaatactgagtagtaagcattggcaccgacaaagctgagaagccccagtggaagtgccatgtatttctggtgaacagtgtgcacttgcacctgtgtcagtgtcttctcccatcacccagacgcctctgctgtcatcacaagccacctggtacgggagtggctattgtggtaagtcataacccacagatagatcaacctaagaatcctggcctttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttggcaggccaggacagatcacttgaggtcaggag

SEQ ID NO: 249798 - DNA, 452 bp, Homo sapiens
acactgcgttcctgtctgacctcctggggttcctcatttacgtggtcggtgagctgttgagaggcttcaggaagtcaggagtgaggaggtctgcctagctctgtgaatgcagctttcctaagtttctctggccatggaaccactttcccagaatgcctgttgacatcttcgtgctccaccaagatgttgggaagtgcggctctttccctggttcccacttggactttctccttaaatctttgcagccctgggatttccagctggttccatgcccatccatagcccacatagcctctcagtctgccttggccccttctcctacctcggccctcaacccattcaaacaacagacctggtcacctctgaaatttggtgttaactccagggattgattgctcactttgaacacgatagattcagcccacaatgtgcccaacatccgggatcctcta

SEQ ID NO: 249799 - DNA, 585 bp, Homo sapiens
acactgcgttcctgtctgacctcctggggttcctcatttacgtggtcggtgagctgttgagaggcttcaggaagtcaggagtgaggaggtctgcctagctctgtgaatgcagctttcctaagtttctctggccatggaaccactttcccagaatgcctgttgacatcttcgtgctccaccaagatgttgggaagtgcggctctttccctggttcccacttggactttctccttaaatctttgcagccctgggatttccagctggttccatgcccatccatagcccacatagcctctcagtctgccttggccccttctcctacctcggccctcaacccattcaaacaacagacctggtcacctctgaaatttggtgttaactccagggattgattgctcactggggagcaggggctagatccagcccacagtggtgcttgacggggtcacccatgtttaaaaacacaacttgagccaatattgggctcttggaagatacttagagatctggtttcttattccataatccatgtgcctgtgaaaatgggaaaaagaaactttgacagggatagccatatgtttcagg

SEQ ID NO: 249800 - DNA, 314 bp, Homo sapiens
ccagaacatacagctgggagccagacaccctgacggggcaccagaacatacagctaagagtaaaatggctgtgcattgctggtgaatttttaaaagaacccaccagcatccacacagtgggacaagagtagtgggaataaagaatggactgtggctcacacagaatgccctctcaaaggtcccattgaaagaggtcctttaggaagcacccatagaagtagaaacattgtaaggaatagatattgaatattcttcatgtatttcgttacttacagaatggcacacctaaaaatgaaaagctctgaatttaaaaa

SEQ ID NO: 249801 - DNA, 389 bp, Homo sapiens
ctttcagagccatcactggatctttactcatgaaggaaaataatctggtgaggctctcctgaactagcaaacacttcgaatatgacggactactgcgtctgccacatcctgccagacagctctgactgcagttgattgccatactccttcaccttaataagaaaactactgaaaagagcagaaaatggcccagctcctgcatctctcatgcaaaacatctgtcagcacctctgggtatctttcccactcctgctcctgtaaattttgctagtcattctatagagtagatgaataccacctggctggtggcaaggacaaatagaatggtatggactgaaggccctcgggcagtccctccataaataaaaactaggctcagttattcaaac

SEQ ID NO: 249802 - DNA, 578 bp, Homo sapiens
gtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaaggcatcctgtgcagcctccaactttggggaaagagaatgcccaactcccgctctccaact

SEQ ID NO: 249803 - DNA, 577 bp, Homo sapiens
cctaggccagtaaagatttgttcacaccttcacagtaattggcatgtaatagacatttgatcagtagttggtatatgaaggaatagagtcctcagatgtataactcccctgaaagtgaacacaaaattgcatgtaggtgcacaatgcattttttgggcagagagggctttttatttatttatttgtttttaaattgtaagaggaatttatgatgaaaaaagtccaagaaccctgcactagtctatgctgccctagggctatctggaataattaattttcaaatattgaggcacttaagagacaaagaactaccttgtttccttggacagtaaaatgaaatgggtagaaacaaggaaggccttcttgatgaagacgtttgctgaataaaaatacttcgtattttatgtgaattgataatcatttgcatttgcctgttccaaatgcacaagttacaaagtgaaagctagttttcttcactccagctcttctcagtgtggccttagtcctttgtaaatgtggtttctctctccagtattgctgagctattagagttttctaccgcatcttaaagaaaaaa

SEQ ID NO: 249804 - DNA, 192 bp, Homo sapiens
attgttctcagcaaggaggaagaatggaaaggtttgtttcagagtcacaactttattttttttaaaaggcacccaagttgtttcaacaagctgctacaaaacttgggcttcctgagtggaggctgttttgcacagtgcatgtactgtacaaaaatccaggcagggaggggtcagagagttcgtcattaaaga

SEQ ID NO: 249805 - DNA, 503 bp, Homo sapiens
aggatcagggcttgattcctggctgggtgaccttagtacatcaactgctttctgtaggccatagctgatggggaaagccctggatagagctttaaaaaatagccatgtttgtgtttgtggttctcaaactacccttcagggaacagaagtgcttcagatgtggctgtgctcacccccatgcccagccttcattaaaaatagatttgtggctgaacacagtggctcctgtctgtcatctcagcactttgggaggctgaagtaaaagggttgcttgaggccacaagttctagatcagcttgggcagtgtagtgagatcacatctctacaaaaataggttaaaaattaaccagggatggtggcgcatgtctgtagtctcagctactcaaaaggcaaaaacaagaagatcatttgggctcaggaatttgaggctgcaatgagctatggtcgtaccactgcactccagcctgggtgacagagcgagacctcatctctaaaaaattaga

SEQ ID NO: 249806 - DNA, 506 bp, Homo sapiens
tattttaaaggctgaatgtggcatgaagataatagcatactaaccctcacctacttagtaatatatttgaagacagagatttttgtctttcgccttcatctctgcatctgtctgaggtttaaatgtagcagataaagctataaagtactttctggctgcttcaaactgctctttcttccaagctaggctagaggatataatagtttaccaacatatttgggtcctagaatcccgaaatagaagctttgattattaattttagatgcttcttcctaatatatgcatttaataattttcatttcagtactgctttcatagcatccaactaattttaatacatttgattttgttcttcatttatatgtgtatgtgtgtatgtatttctcttaagacttctttttaacccttgaattatttagaaatgtgtttatttcttaatgttggggacttttccaactacctcttcttggttcctttctaataaacttctgttttaaaaaatacat

SEQ ID NO: 249807 - DNA, 1324 bp, Homo sapiens
  misc_feature (69)..(69): n is a, c, g, or t
  misc_feature (344)..(344): n is a, c, g, or t
  misc_feature (578)..(578): n is a, c, g, or t
ccactcgtctgtgatttattttgtaattctttgcacagtatctggccagaggaggtgctgtagtgctanttcctcaatgaactcttaggcagaatcctgatgtattaaccaaataaaaacagagctgttctgataggagtggagtgggaatgtccagagccctgaaccttcacggaagcccccgagacacctattattagtgacttcctctgaaatattcagtttaacatatagaaatatggtttatctaggagatgaaaaatatatttagatcctcaaggagcacttggtttgggtcagccttgaagacccagctgcattctcactcttgggttctgtgaaanaaccttacgcccatataacaaatgtttttgttgttgttgtttggcttaaagctgtctgaaatgggtttctgtttcttgcaactgaagagtcttagctgaagaggcttaactagggcaacgatgcttcagtgtggttatgaggattaaataacataaagtatttcaagcacttcagttagcacctccagaaatgtttctcccctcttccaactgttaacagtatcgcatgtaccnagaccatcagacttacctgtgttttgtacatgctcaaaataagagcccattttgcggtcagttttcttttctttttatttatttatgtatttatgtatttatttattttttgagtcggagacggagtttcgctcttgttgcccaggctggagtgcaatggtaagatctcggctcaccacaacctccgcgtccctggttcaagagattctcctgcctcagcctcccaagtagctgggattacaggcatgcgtcaccactcccggctaattttgtatttttagtagagacggggtttctccatgttggtcagggtggtctcgaactcccgacctcagattatccgcccccccccccaccccggcctcccaaagtgctgggattacaggcgtgagccacctcgcccagccagttttcttttttgcaagtttttcctcattccagccttcatctttcaggtggtgttatgatttatgtttttttttttgctatgttttaaagttttgtttgttcctgaaaggattgagttagtcatactcctcagttcatggcatactatcatcagaccatgacagtgaggccctcttgttttatttatttatttatttatttatacccttcaagtcccattttctcactacaataggcaattttctaatgtgcttaatgtggatatttccatttatgtgttttctaaacatagttattatttcgtgagcatgcattattaaatgtacttcaaacctact

SEQ ID NO: 249808 - DNA, 392 bp, Homo sapiens
ggttttgtttttttcagacggagtttcgcttttgttgcccaggctggagtgcaatggcgcgttctcagctcactgcaacctccgcctccctggctgaggcaggaaaattgcttggaggcggaggctgcagtgagccgagatcgcgccactgcactcaggcctgggagacagagtgagactctgtctcaaaaaaacaaaacaaaaaacaaacagaaaaaatggggggtagggggtttgaggagcacaaggcttggacctactagacctggagatttggggaacgagggatgccagccatgttccttgtactgtatgcaaaagggaagtaacaagtattgaatgttcacttacctctttcattccccaatatgaaatagatattcccatttgca

SEQ ID NO: 249809 - DNA, 180 bp, Homo sapiens
ttttttttttccccccccccccccccccttttttttggggggaaaaatttaaaaaaaaaaaaaattggggaaggagttggattagatgatctctgggtttttttgtttgtttttgcactagtaataaaataattttcacaaattgcttggagaccctgaacatcccccaatttagacaaa

SEQ ID NO: 249810 - DNA, 407 bp, Homo sapiens
tctcagcagaaactgtgtactgcagaccatattaacaacctaggaccacctgctcagctgggaattatgggcccaaagcatagcaaaatcctcaatcccagattgcagtgttaaatctttctatggagagtatgttcatagaaaaatctttctctctgggggattgcccagattgtttttcatagagatccttcatttgaattatactatactgtcctgctctcagtttttaaaaatatacatttatttgctccttttatgtgcttctaactcagctatatgtgcactgtgccacagcactttaaaaatagttccaagtaaattctcaatatttataccagctcagaaggtagaacaaaacagattgaatgtctttatattttccaactaagttgagagtttgatat

SEQ ID NO: 249811 - DNA, 429 bp, Homo sapiens
ttttcttttactttttctgtatttttccgattttatataaccatgcatgtattagaaaacaaacaacaaacaaaacgataatgtacacaatctaatctgactttctcacaggaggtaggagagtcagggaggcctgggaggctcagggcctccccagcagcctctcaggacatctccaaagccacaggatcatcaccagtaatcagcctttctcggggtcaggagggcgagagctcatctgaggatcactgggggtgtccctgggacccctccaggctccacctcctgctgaccccacagcaactcatgtcagggtccgaggcaaagtcctggttctcacccacgaccccacagagcctctctgcagcgaagaggggctgacacctgctccctcaacccccgagtccatataaacacagaggcggccgc

SEQ ID NO: 249812 - DNA, 471 bp, Homo sapiens
ttagaaggttgtgtgcatgttcaaggctgcatgcatgttcaggaaataccaacaggggccaagttacttattcatctcttactgaccttggagctcagtgtaagcaggcaatgaaacctaaggcaaatttataaactgcctgaactttgaaggcatgtggaaactcataaacagcttctctcagccagttgcggaagatttacttattcaagtcatttaagaaaaccttctaaccaatcattgtctgacccctgaagtatgtaaacacaggggaacccttaggaagttaggcttaaaaatagaaacaagaatttttaaaaaagtgagcatagatttctgtggcagcatactgcagggactctatagaactagcctatgtaaattgctaaacagacaacaacaaaccctggtgtgggtggggtaataaaatttcagagtcattaaaatactctggtgtttagcaaaaaaaaa

SEQ ID NO: 249813 - DNA, 306 bp, Homo sapiens
cctgggcaacaggacaatagtctatatttttttaaaaaaagcatcatcaacttataatattaccaacttatgatgggtttattggaacataatcctatcataagttgaagtgtatctttatatagtagaatatagtaacatactacagacttattttctcaaagcataaaaataaaccacactaatgatcatccatgggagagggacacctagacaatgtcctgcaaaacgagaaatactggtaagacatactttacattccagactgagtctctttcaccatgaaataaaatcattaagaaattt

SEQ ID NO: 249814 - DNA, 731 bp, Homo sapiens
catctagcaccttcctctttgatgatctaaagggcaattagccttcacatcttccgagaaagaagaagcacgcttctgctgagataatacaaacacttagagattgtgctcattttgtaactaactctcttaagttctttacttagagcaaacttctgtccaccttccttttcttatcctgattttctaagcaccttggtttcctcatctatttttattttatttgcagtttttgtcagcagcctcaaatggtcttctgaatgaggcagaatataaaaataaattatctcacttatatatagaatctaaaaaagtggatctcatagaaacagagtagaaaggtggttatagcaggggctgtggggagagggagaaggtgttggtcaaaggccacaaagtctcaggcgggaggaatacgttttagtgacctatcgcactgcacagtgaccagagttaataataatgtgttacatatttcaaaactgctttaaaaaaggatttttaatgttctcatcacacacacacaaaaggtaagttggtgaggtgatagatatgttaattagcttgatttaatctttctacaatgtatgcatagatcaaaacattacttgatttaatctttatacgatgtatacatagaacaaaacatgacactgtaccccatagatgttcacaattactacttgtcaattaaaaaataaattaataaagtatgaataatgtgagcaata

SEQ ID NO: 249815 - DNA, 785 bp, Homo sapiens
catctagcaccttcctctttgatgatctaaagggcaattagccttcacatcttccgagaaagaagaagcacgcttctgctgagataatacaaacacttagagattgtgctcattttgtaactaactctcttaagttctttacttagagcaaacttctgtccaccttcaccaaatgtggcaacttaatgattggggtcctgaatttactccagctttcttttcttttcttatcctgattttctaagcaccttggtttcctcatctatttttattttatttgcagtttttgtcagcagcctcaaatggtcttctgaatgaggcagaatataaaaataaattatctcacttatatatagaatctaaaaaagtggatctcatagaaacagagtagaaaggtggttatagcaggggctgtggggagagggagaaggtgttggtcaaaggccacaaagtctcaggcgggaggaatacgttttagtgacctatcgcactgcacagtgaccagagttaataataatgtgttacatatttcaaaactgctttaaaaaaggatttttaatgttctcatcacacacacacaaaaggtaagttggtgaggtgatagatatgttaattagcttgatttaatctttctacaatgtatgcatagatcaaaacattacttgatttaatctttatacgatgtatacatagaacaaaacatgacactgtaccccatagatgttcacaattactacttgtcaattaaaaaataaattaataaagtatgaataatgtgagcaata

SEQ ID NO: 249816 - DNA, 190 bp, Homo sapiens
gaataatacttccctgaagagctgcactaatttattgaggcactgagctggatgcttcacacacatgatctcattgaatgtccacagcaccctaggaggttgatctcattattaacttcatgaagtgactgaggcttagagatattaaatagcttccagcctgggaaacatagtgaaaccccatctctgc

SEQ ID NO: 249817 - DNA, 663 bp, Homo sapiens
tggtcacctctgctcaggtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggttggggaggacccc

SEQ ID NO: 249818 - DNA, 631 bp, Homo sapiens
tggtcacctctgctcaggtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcccttcctggacaaggccccctgcctttgcctcacataaactgtacagtattttcattaaaagcctctttcataacttccaaaaaaaaa

SEQ ID NO: 249819 - DNA, 625 bp, Homo sapiens
cagcattaacggtcaggccagtacccaagaaattagacagacatgtgctgctgagaatagggtgaatggaagcagagtctagatcctcaggttaaataaacgatggtcacaggaggaacatggcatagcctggaaggaggggcacacacgatgaggaggtgaggacaggcaaggggaaggcgtaggtgaatatttctgacacctatgatgggtcaccttactgcccctgccacctggtatgaattaaattgggggtgatgaacattcatccatggatataccctaccattttgcgttgacttattaccaagggacactccccataagagtttactgcacacaaagaacacccaaataaacacccttcttgaatttacaactcattatctgcgacaggttttctttaaatccaagacacatgatgggaaatgggtgttcccaccatgtactcagagggctgcatgaagtgactcccgggcaaggcagacttcagtaatctcttgagcgtgagcatgtggactgcaaggctgagtgcggactggtggatgtccttggagctccagaaccttggcgttctcatggaattccctcccaagttttactatgctcttttgtggggggggct

SEQ ID NO: 249820 - DNA, 680 bp, Homo sapiens
tccaaagagagacagaggtccgtgcaggatgcctcatcactgggtttgagcttttcagcaaaattggtggggaagacatctgcacagaattagaaaaataataaatgcagacatggtaccttagagtgctggaaaaggcaccccaccctcggggaagctgatctgagaggcatgcagggcgtcctggtgtggggagctgtgtggagagtgcgtctggaggcagtgagtcttacttcctgactttgtagccatgcagctcagcagcctcaggaagactcagctccctgcaatttgctttacaggtactgctctcgggcgtttagacttccacaatggggaagataaaagaaatacattttaatttctaggaaaatgaagcatgtaaaaataaaatcacttgctctatccagtgtatcatttgcttttccagactattttagcagttacagtggacaactgctaagcacacttgactcattcatttgtagatttcattataagcaccacaattaacccatcttaaaaaaaaatcttgacagaaaagtatttaagttcttgactaaattcagctttcagaaggcatcagtgattctgctgatggtgattgagaagattaaatatgtagatgttttcttcttggtgtatgagagacatgtttgtgttggtgggagcaccaggtg

SEQ ID NO: 249821 - DNA, 765 bp, Homo sapiens
cgtctcctgacactttatatatgccagccatactaaacttttctcagaattcccaaattcgcccctttctctttcaattcttgctgtcagattcttcccacttctcactgtgcctggttatctccacgtcatttttcacatgtctgctccgacactgctgccttttcaggagcttggcaggctggttagtgctctagcttctgagttcccatccgtgtgaacttttgcctgccttcttgcctgtgtactgcactggggctgtgagctccttgagggtgagggctgtgttttgatcactgttagttcactgcctagttttatgactggctctgctactttcttgtgactctgagcaagttacttattactttgcctctccgttcatcattggtaaaatggatatagtaattgttcccacctcataagataaaaatcagttaatataaaacacccagaacagagtctgacacatgggaactacttaattcttgtccttatagccatagcatcaagcagtgagcatctactttgtgttggcaataactcagatgactgaataaatagcaatcctgtagaagaactgtttgtaccttacttagcatcaacactgtggattagttcaaacaattagtattaacaaagaaatgactaaaagatgtgtgtttagacaccaagaatagcatgtctggttatatgcctataacattgtcaccttggtagtacggtcagtatataaaggattatctttagagaaaaagatggtta

SEQ ID NO: 249822 - DNA, 528 bp, Homo sapiens
actgggtcacctatctagtccatatgtctgcaggaattatactgataaatggacaactcaccatgcaatcaatctcccgctctatcctgttccctgaccggcatggtttctacttcctgtcagcacaactaggacgtctggtttctgctgggctgccctctcatgggaagcctttaatcactctatctcaatatatcctctggggaccatcaacatttcctattaaagataactacacctggccgagcgcggtggctaacgcctgtaatcccagaactttgggaagccaaggcgggtggatcacaaagtcgggagatcaagaccatcctggctaacacagtgaaacccctcctctactaaaaatacaaaaaattagccaggcgtggtggtgggtgcctgtaatcccagctacttgggaggctgaggcaagagaatggcgaacctaggaggcagagtttgcagtgagctgagatggtgccactgcactccagcctgggggacagagctacactccatcccaaaaaaaaa

SEQ ID NO: 249823 - DNA, 675 bp, Homo sapiens
aagaaaaatctaagttgtacagcttagggttttgatctaaatatatcttgagtaatgattcctacagtcaagctaattaacatatccatcacttgaatggttaccattttcttgtgtgtgagataagaacatttcagatctactctcagcaaatttcaagtattcagtaatacattattatttataatagttaccatggtgtacattgaatctctagaaattattcatcttataactaaaagtttgtatcctttgaccaacatatccccatttcccccacccccagcccctggcaaacactactctactgtatgtttctctaagtttgacttttttagattccacctataagtgacgggatcagtattactgatgttttttttcctcagcctccaacatggctcaatatagtactgggcagcagagagaaagtaacccacatgtaagcggcttaagcccagatactcatacttcctacgtatatgtgggagagagtagtaagattcaaagtaacctgctggctgatcaccaatgtgatataccaatggcatatactcaggtccttgtcaggactaatttcataaagtataattatgcacatattttgttgaacttagtttacagcagtgatctgtgtataatctgttgtataaaatgaaagaatgaaaacatttc

SEQ ID NO: 249824 - DNA, 477 bp, Homo sapiens
caacagagactggatggttgtcaaagactgaaatctttaccaccagcctctgcatagacagttgtttcctgacccctgttttaaggtatttcagtcaacctactaaatgccaattagagatcctccagctccatttcatgatgtcttgtttttagactttagtctcaaaattacagttacaatacaataaaataatcttaatttatgaatgcacagaaaaataaaaatattaattcacagcccaacactggtaaattgtgaaaggtgaaataagattttatctggtacgtggtggttgatacactgaaactggaaggagttcctttgtttattaccagggtttattattatgggagtctgggtatgactctggacttttaattaccacctgtcctgtgtctcaaaaaaattaacctcatataatataaactagttcattttaaagagagtgctagtcctattctctaatacaagctt

SEQ ID NO: 249825 - DNA, 467 bp, Homo sapiens
cagagcgagactctgtctcaaaaaaaaaaataaaataaagagggcttgggtaattggcaaaatgctgcatattagtggtagtgggaggcagttgagtgttttgttttaatgggcctcttactccttgcaaactagccagaccattgtactttcagagtgtaaatctttggctcaccaaatttcagctatctctcaaattcagcttttgcttttcttcccacttgctcaaatatgtctatattctttgtgcatgcaagtatcccacgtaggagggattgatgaagcagatactatttcagtttttatagggagaaactattccaggaagggtggggattacagcgcaagtagatagtagagcctgaagctgagccctagtttcttcacccctttgccttcagcttttgcattttctgccagatgattctgtggttcttacactttggttcgtaactacaggtgcaaaa

SEQ ID NO: 249826 - DNA, 440 bp, Homo sapiens
ggcctccattcctatttttcttcaagagaaccatgaagctcctttgcaaaataggtgagttcttttctttgagacagagtctccttccatcacacaggctggagtgcagtggtgcgatcttggcttactgcaacctctgcctcccaggctcaagtgattctcatgcctcagcctcctgagtagctggaactacaggtgtgcaccacaccacacctggctaatttttgtatttttagtagaaacggggtttcgctatgttggccagggctggtctcaaactcctggcctcaagtgatctgcccatctcggtctcctcaagtgctaggattacagatgtgagccccggggcgggtgagccacacacttggatctcactgcagttgtggcctctgggaagaaggctttgaatgcagattttaaacaggtactcaactcatact

SEQ ID NO: 249827 - DNA, 1912 bp, Homo sapiens
ctttattcccggtcctgggtcccccgtttggaggccccctagtggccctcggcctccccttgagtgtgttcacacaccgccggtgtgtcgccccggcgtttttattttggtgggaagccccaccgcctggtgtctggccccgggggttccctctggggccctgtcttagtccacgtgttgccctcttaccacactggggcgccggggccccccaccagagttggttttgaaaagcttttttccgggtggcgcgggcccgccgcacacacagtgtcgtttttttttttgttttttttttttttttgtatttagtagagacgcggcttcaccatgttggccaggctggtctcgaactcctgacctcaggtgatctacctgccttggccttccaaagtgctgggattacaggcgtgagccactgcacctggccaaagttttttttttcttcttttttttagtattaacaactttgaccaggaaaaacaaaccctgcttttcctttacagtctctcgtcaggtcttcgccacaaatctctgtccagaggatcgtggctgaggcaccatggaatgctgctgttctactggagatgcaatttcatccaaaagaaaaagggaaaagtatccaaaagtctttctagtctccaggcatttagaaaagctttagaacaagatctgcactggcacaagaatttgagtggaaatcaccctgcccagctgtgagccccggggcgggtgagccacacacttggatctcactgcagttgtggcctctgggaagaaggctttgaatgcagattttaaacaggtactcaactcatactgagccacggctactttcaacttaacaatatgtgagaaacccatctgatcactgcagacctgctgaaatctgttacaactaatccttcaatcctcaccagaatgctggctgtcctgcctctgccgtcccgagagaagatgaaagctactgggtggccacagggcagttatgtccccttctctaggttctgtgattctggcagttagaatgggtttccagacttttacaagcagaaacccttatacatgtgattatatgctgtccgtcaacatgtaaaacaggccaagcgtggtggctcacacctgtaatctcagcgttttgggaggccaaggtgggaggaccacttgaggccaggcgtttgagaccagtctgggcaacatagcaagaccctatctcttaaaaaaaaaaaaagaaaagaaagaaagaaaagaaaaagaaaaagaaaaagaaaaaaaaaagtagtcctggcctcaagtgatctgcccatctcggtctcctcaagtgctaggattacagatgtgagccactgcacctgactgcaaaatgggagagttctgagaagtgtggactggaaaccagtgagaggaggtaacttctagaacctcttcccagctctgattccactaacatggtctaaactttccaaactcaacccacaccaccgttaaagtccttattttctaagccgtttctctttcgggcactttccaggaggcctgggcctgaaactccacaccccaccagctgacacactgtgcgtgacctggaactagaaatgaccttctcacagggcagatggccacccacgggggatgtcttgttagaaagcctctccaaagacctgggagagtcaaatcctgacacaaacatatcaaagaaatgttctactttactagaaattttgtttaaaacatacaagttaaaatcagcggctgagcatggtggctcacacctataatcttagctactcgggaggtggagggaagaggattgcttgaggccaggaggtcaagaccagcctgggcaacacagagagacccccatctctatttattaaaaaaaacggaaaagaaaacaatttggtaatatatg

SEQ ID NO: 249828 - DNA, 1497 bp, Homo sapiens
gcaccggctgttggagtgccggtccagggtccaacatttagtaaccaacatcaaatgtacttgtctctcctaagctgcacagactgccaagtctctcgtcaggtcttcgccacaaatctctgtccagaggatcgtggctgaggcaccatggaatgctgctgttctactggagatgcaatttcatccaaaagaaaaagggaaaagtatccaaaagtctttctagtctccaggcatttagaaaagctttagaacaagatctgcactggcacaagaatttgagtggaaatcaccctgcccagctgtgagccccggggcgggtgagccacacacttggatctcactgcagttgtggcctctgggaagaaggctttgaatgcagattttaaacaggtactcaactcatactgagccacggctactttcaacttaacaatatgtgagaaacccatctgatcactgcagacctgctgaaatctgttacaactaatccttcaatcctcaccagaatgctggctgtcctgcctctgccgtcccgagagaagatgaaagctactgggtggccacagggcagttatgtccccttctctaggttctgtgattctggcagttagaatgggtttccagacttttacaagcagaaacccttatacatgtgattatatgctgtccgtcaacatgtaaaacaggccaagcgtggtggctcacacctgtaatctcagcgttttgggaggccaaggtgggaggaccacttgaggccaggcgtttgagaccagtctgggcaacatagcaagaccctatctcttaaaaaaaaaaaaagaaaagaaagaaagaaaagaaaaagaaaaagaaaaagaaaaaaaaaagtagtcctggcctcaagtgatctgcccatctcggtctcctcaagtgctaggattacagatgtgagccactgcacctgactgcaaaatgggagagttctgagaagtgtggactggaaaccagtgagaggaggtaacttctagaacctcttcccagctctgattccactaacatggtctaaactttccaaactcaacccacaccaccgttaaagtccttattttctaagccgtttctctttcgggcactttccaggaggcctgggcctgaaactccacaccccaccagctgacacactgtgcgtgacctggaactagaaatgaccttctcacagggcagatggccacccacgggggatgtcttgttagaaagcctctccaaagacctgggagagtcaaatcctgacacaaacatatcaaagaaatgttctactttactagaaattttgtttaaaacatacaagttaaaatcagcggctgagcatggtggctcacacctataatcttagctactcgggaggtggagggaagaggattgcttgaggccaggaggtcaagaccagcctgggcaacacagagagacccccatctctatttattaaaaaaaacggaaaagaaaacaatttggtaatatatg

SEQ ID NO: 249829 - DNA, 715 bp, Homo sapiens
gaataggtgaatttctataatcaatataatttaatttgataattagattgctggatatttcccttttatcttttcttaaagtaaaaatttgttctttaacaaatgtcttttaataaatgaacgtacagacacatatgtttgagaatctctaaatatccaacctaaaaacttgggtttgtttctgtgttttcccttaacttgtactttccccaaaccaagatcacctggtctcttctctgctacatcatttctttatgacaaagtagttatgactctctttaaaaagccaggcatttcagcactctggttactttgatcagattatctattcgtatctacttttatattttttgtaactttcataggttatttgtggagtccttggtttctgtgaggtctcttttccctgtatttaaagattcccatctcattgtaccgatgtgggtgccagatcatatgaacataagaaatctgtttacaccattctccattcttttctctgggagtactgccaattatgggatggtgtgatgaagtcataaaatacaaccttaggtaggataggcatttaaaccaagtccactctctttcctttttctaagggatcataatcaaaggtaaatgtgaatctacttgtattttatacaggtgaagactcagtaaatctagcttttctttctcactagtctgagtggtatacctggcactagaatta

SEQ ID NO: 249830 - DNA, 428 bp, Homo sapiens
actgcccttcagcctgggtgacagagggaggccctgaaaaaaaaaagaaagaaaaggaaaaagaaagaaagaagaaggcaggcaggcaggcaggcacgaaagaaaagaaaagaaagagaagagaagagaagaaagaaagaaggaaagaaagaaaggaagaaagaaaaaaagttttcaggccacagagtatggtgcaacaaaaagtgacagggtatatgtgattagagaaggatcagtcagggtctgaactttaccctgagggctatggagaactactgaaggattttgagtatggcactgacatgcttagatgtgtgctttaagaaagtttggttttccagtggcaaggaagtaaagtgacattggggaccaggaaactggggcaatatcagaggaagcagagcctttgtggaatatgccaaccaaga

SEQ ID NO: 249831 - DNA, 263 bp, Homo sapiens
gggggcgggatttattctttttcttaatttttgtataccctcaaatatctaagggtttgttctgaaatatacttcattaacttggaaaatagtcaaacctttttcatcttcagagtcctcttagagtgctggtgattttgtctgggagcttttgcagatcagccagctctgccttttcgtttttgatggtcactgagtcctttttttttcttttcccccagaggagtgattttctgtgtgtttttgtttttggagtgtgtgtg

SEQ ID NO: 249832 - DNA, 430 bp, Homo sapiens
cgttaatacttgaagagttttgtcagtctgaaagcatcatgcatggaaggacatgagcagagaggcaccttgaggacaccggaccacacacagtgccagtcacagaagcgcaaaggcccagagcagcgaaatccaccgtcgcagggaagcggacagcggggccgagggagaggggatctgtggacatggggaggacggatccacggttgcggagagcaggatggcggggccggggagagggagtgggatttcatgggtgcagaatttcagtttgggagagaagttttggggtggatggtggtgacggttgcacaaccatgtaaatgtacctattgccactgggccgtgacctgacacagagttaagacagtaaattgtgtgttatgtgtattttatcacaataaaaaaaaaactttttttaaagcaaaca

SEQ ID NO: 249833 - DNA, 340 bp, Homo sapiens
gtatattgaggagcatgaattttttacacttttaagctcagtaattccacttctggaaatctatcctaaagaaccaattccaggccaggcacagtggctcatgcctgtaattccaatgctttcagaggtggaggcaggaggatcacttgaggccaggaatcaagacaagcctgggcaacacagtgagaccctgtctctatcaataataaaaacattagccaggcatggtggcgcacgcctgtagccctaagctactcaggaagctgaggcccaggagtttagggatgcagtgagctatgatggtgccactgtactatagcctgagtgacagggtgagggc

SEQ ID NO: 249834 - DNA, 397 bp, Homo sapiens
gaccatgaagtgtcccattcacctggtgggtgggtcctgggcctgtgcgtcccccaggatgtccctctctcatgttttgtttggacagagggttcagtagccaagaagaccagttggagacccctggcctagtccatgttgttcagagcaggccaggcgcagagaggggcagggccggctgtcacatagcctggggtgcggagctggaatggggagttgggtctccctcggccggcactctcctcctcacccagctgtcctgcctctgctggtccctgaggcaggggttgcactgtgtgtgcagatgaggaaactgagggtcccacaggagacactgtcacccagcagctcaagtgggaccgtaagaagaagcggtttgtgggacagtcaggacagg

SEQ ID NO: 249835 - DNA, 520 bp, Homo sapiens
tttcactttgctctcttggctcgctcttcctgtttggagccaagaacccacatgacttcctgggctgaaccccaattttggggttcaccctgtgacatcttgacaagcagtggctttatcagccgtgtggctgctgggtctccttaggggttatctggcaggggctatgttaaggacggtgagagctatttatggttctgtcacttaaccagctcagggtccctaactaagtttcccttcttctcagggcctcagtttctccctccatagaatggaggaattggactagacacctcaagggtaccttacagccttgtgaggaacagtagttctaacggaattgaactgaacacataccggtgtgggcagtatcctgcataaggaggaggttacaagaaatacacatgacacagtcctcccgtattattgggaagtagatttatacctttctgacaatttttacaagtatttattgcttttgcaagtaaaaaaaaggcagggagagggaacaaataaactg

SEQ ID NO: 249836 - DNA, 420 bp, Homo sapiens
cggttctaagcgtgagccccagctctgcaacctaccagcctatttgggactctccatttctcatctgaaaatgcgtaggccggaaatagctgctgccctgcctgctgtcatcatctcagtcactgaacaagtgtatggggatcatcagtctgtatcaggtacccttgtagacatgggactggcattgtgtgttcagacacgggccctgactgcacgtctcacatcccagtggtgaggagacagacagcaaacaggtaggtaattaaataaatacgatcatttaatcttctttatgtgtgtggtgatgctggcataaacagacatactgctctgccagtcctataaaagtctagcacacacaattatattctgtacataataagtgataatgataataaaaggtttactgatttacatatt

SEQ ID NO: 249837 - DNA, 463 bp, Homo sapiens
tttttatttgcatcagggactggttttgtggaagacaaaacccagggtggggttggggggtggctggggatggtttcaggatgattcaagcatattacattttattgtgtactttatttccattattattacattgtaatatataatgaaataattacacaactcttgcttatggtagactgccagtttctgagtggtaaatgtaaaagggagtgacagtttgaaaattatcattgtgtttatttaggaattcccattataaagaatattttaaattagaaaactgcacattttaaatgttttgattaataatgctatgtaatagcttcctaattggtatttctaccacactttctcttcattctaatgcatcctggtaaatttttcaaagataccactttgactatcactagccttgttccaaagtttttagttttccttttgtctatagatatgcttctct

SEQ ID NO: 249838 - DNA, 562 bp, Homo sapiens
gtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctgcggccaacatgatggctgggctgagcagcctgagcagcggcttcggtgggtattttctgcctaagtgctacgtgatcctctgccgcccagacctcaacagcacagagcacttccaggcctccattcaggactacacgaggcgctgcggctccacctgaccagtgggtcagcaggcacggctggcagccttctctgccctgagggtcgaaggtcgagcaggccgggggtgtccgggaggtctttgggcatcgcggtctggggttgggacgtgtaagcgcctgggagagcctagaccaggctccgggctgccaataaagaagtgaaatgcgtaaaaagtct

SEQ ID NO: 249839 - DNA, 235 bp, Homo sapiens
aaaaaaaaaaaaaaaaaagaatggtcttcagcaataatataattcaatgggtattttggcgtaaaacgacaagtgagataaacagagtattattaaagagagattcacaccaactgcaaacagtggtaacatcctggaaatttaattggggaaggggtggggtcaaggataagacaccttattttacgcatgattagattcctgggatttacaataaatatgatgacttacatca

SEQ ID NO: 249840 - DNA, 728 bp, Homo sapiens
caggcagggtgtagcccctgcctattctttgctggcttgttttaacaagcaatagggaggaaggggggacagaggtggctcagtgagctggcacaggaggaacacttagtgcctttagccggcccgtgtccccgcaccatagcccactcagtcagagcctcctggggcagcggacaccgccacccacactggaggctctgaggggagaactcctccagcggccaggcaggcacttggtgggctgtcatgactactctgcctcctctccagttggtattccttcctttccctcccactgagaccccagataagacaacactcccctgctcaccccagggccctctaatgccaacaccaggaagacacccaatcctgccacctcgtcctgctgccatttcctcggctgaacgtgggcttcctgccacttaggtctccttccctgccaccaggtacattcctcttctggccctcccggcctccatccctgcccattatcaggcctgaagtggctgccaaggtcagcgccgcctgggctgcagacaggagcccggcctctcttctgtcttggcctgtagcatggctctgcccccgtggccaccactgctgtacccttcaccaccaatctctgacgagtgggggccaccgtggggtaatttggctatgggccagactgggacagggagagggggaattctttgaggtggggagtagggctggcctggtgtgtg

SEQ ID NO: 249841 - DNA, 552 bp, Homo sapiens
gccaaagtgctgggattccaggtgtgagccaccacgcctggccaacaaaaaagattttttttaacatgagaagattgtcagctttccctggtggtcagagaggaagggctttagagaggtcttggggctgcagggacaaagggtgcaggagaagaagccttagagctgagcaggaggaaactgacactacatggctgcaggcccagcatggaaatgaacttctagaatgctgtagtcgaagagccagcttaattttttaactcttgtgttgtgtgatttttccatccttcctcatttctaggggtattagttaggctatgggcttggaaattaatttgaagaacccaaataaatgtggtttaaatttgatgaaagtttatttctctctcatgtatcatcagaaagtaagccatctggggctgatatagcagctctgtgcctcctccttttagttgctctgtcatccccagcagccacacccttattcacatggtccaagatgctctgatgctctcccttgtcaacattccacctggtcgatgaaggtttggg

SEQ ID NO: 249842 - DNA, 692 bp, Homo sapiens
agaagtagatatgactgtgaggaatatgaatacataaattttgtacctttaagttcctttttaatcagaaacatactctgcatctgctgtatgatgacctagaagggagtgaaaccacaggcacatcaagatgcctttgaaacaggcaagaggcatcaaaatgtcaaaaccatagatttttgtgtggggttttttttttttgagacagtttttgccctgttgcccaggctggagtgcaatggcgttgtatcggctcactgcaacttccgcctcctgggttcaagcaattctccttcttcagcctcccgagtagtatgtgggtcctggctcccattgctcatgcctaggtaattgtctgaatgattggtcaacgtaatgtcttccacgttgactagtcttgcttacaacttttgacttgcagctatctaccctcgtatgcctctaatagtcctgagattaaccggccttggccccatcatgcttagattctattcctattcgtttacgttagaacgttcctcatcttttgctctaccttatgcttaggatagattttctctagaacacctcctttcttcttgtctcaaccacaatgctccgctttttttgtctcatctgtgcaccttacacgatctgcactaatgactccaatgctttcccttctaacatatcttttcgctgcctcttgtctc

SEQ ID NO: 249843 - DNA, 798 bp, Homo sapiens
ttaaaattacatttaaaaacgagtgatattcagggtcatgactttctgaacccatcagagagctgaattgcagggcaattaaatagtttaaaatgaaggaaagagaggtgcctcctacaataacagagatgggctgcaaacattggatgacctgtggcagagcacggaaagaaggcaaggatgacagctacatgcagacaaggtctccagatttgccacccatgctgagtgccgtggtgtgatcatggcttatttcaacctcaacctcccccactcaagcgatcctcctgcctcagcctctggagtagctgggactacaggcacgcaccaccacacccagccataatttgcctcttgctgtaactaaaaggtcacaaaaacaaagaattctaaaaaatcttcttcttaagtggtatgtttagtatttatcatgatgacaatgttctaaattgcacctgcctccactagcagaatgccaggattactgccagacagagaattcggactgctggtccagggacatagctatgaaatgcaccaaggacagcagagtgtgttttggagaaagccaggtagctcttgatagggcctatatgagtacttattcctgctgataggaaaaaaatgattagaaaaatctcatttctttattcatttctactctgagagctttttacttctagaaacacggtcttagttttctgtgttattatgttttttttttgaaactgacaaaatttcacaattaatttatgttcattcaaatgtttaataattataccttgaatttgtcttata

SEQ ID NO: 249844 - DNA, 759 bp, Homo sapiens
agggtgggaacaacagagaagaacctattattgggccacctatcaagcaaaaagaaaatacagcaatagagatcacactggatgcatggtgaactgtggcagatggagaaatggttggaagccatgggacgaatgcctagagttttgaaggaatgtagacaaggtctccagatttgccacccatgctgagtgccgtggtgtgatcatggcttatttcaacctcaacctcccccactcaagcgatcctcctgcctcagcctctggagtagctgggactacaggcacgcaccaccacacccagccataatttgcctcttgctgtaactaaaaggtcacaaaaacaaagaattctaaaaaatcttcttcttaagtggtatgtttagtatttatcatgatgacaatgttctaaattgcacctgcctccactagcagaatgccaggattactgccagacagagaattcggactgctggtccagggacatagctatgaaatgcaccaaggacagcagagtgtgttttggagaaagccaggtagctcttgatagggcctatatgagtacttattcctgctgataggaaaaaaatgattagaaaaatctcatttctttattcatttctactctgagagctttttacttctagaaacacggtcttagttttctgtgttattatgttttttttttgaaactgacaaaatttcacaattaatttatgttcattcaaatgtttaataattataccttgaatttgtcttata

SEQ ID NO: 249845 - DNA, 435 bp, Homo sapiens
agtagtaaaaattctttatccagaacctttgtgccaagggtgcctagaaatttgaattgaaaaaaaaaattgaagcgtgatatggtacatagtatagatatcatatataacatcttgaagtggggtcctcatggtaagttagagcaagtttttccactaaacaaatttgccagaaacttacaagaaaactattggttttcagattagcttttaagattttggaatcacaactacaaagagctttggaactaagttgtttttttttgtttttttgtttttttgttttttgagacgaagtctcactctgttgcccagattactcgggaggctgaggcactataatcacttgaagaacccgggaaatggaaattgcagtgagccaagattgcaccactgcactccagcctgggcaacagagtgagaccctatctccaa

SEQ ID NO: 249846 - DNA, 581 bp, Homo sapiens
tagaagacacaagactcctgggtcagagatgaaggacagtttattactcacagcaatggcagtagccaggctatcagcctgtttgtgcatacttgagccctagttccacagggagacatgaaaagggccaaatgacactggcagatgcaagggatgcactatagaagaaccctgagcttagggaacccacatcttttatcgagggcagcaagcagcagtccatttactaagacagggaagactggagggatagcgggaggaggtgggctttgcacatggatttaggagttcttttgggggctaattaggtttgagatgcctgttaaacattcaagatgtcaagtaagtggcaggatccatgaattagatcccaagagagaggtcaggacttgccacgtatgaaagatggtactgttgagacagtttataaagtattttcattatactcagaactcccaagaatcttcattatacttagtgggaaaacacgagaattatttctcttaaaaacaagaacaaaaaagaatacttgcttactttagtacttcttgccctcaaatgtgggataaggaaaaaagaaa

SEQ ID NO: 249847 - DNA, 674 bp, Homo sapiens
atatattaatgcttctgaagcaaagtgtgggcaggcagattactttataaaaagaaataaaagtcatctcaattagaaggaaagaagtaaaactagctctatttgcacttgaaattatctttcacatataagatcctaaagcaaccagaaagaagccattagaatgaagagctggtaagtttagcaagggtttggtatactcagtcaatatacaaaaatcaatctgcctttatgcactagaaatgaaacaatccaaaatttaaatgaaaacaattccatttacaacaatagcatccaaaatgaaatgcttaagaacacatttagcaaaagaagtgcaagacttctacactgaaaactaaaaaacatcgttatgtgtgaaggggagggaagaaaggaggctagaggataacttaagaattaagggcatcttattttgggttgataatgttgaggatgcttatgactgaaagggagttattcattcttcagtgatttcttaatttgaaatatggaaccaatgtttctgcataacataaacatacaaatgaattaaagtgaaaattctaaggttcccattattgctatgcttatgtttatgagagtattttaagattttatcaagttcccaaagtactcagaaaaagaaaaaaaaatcatggtgggtattatatagc

SEQ ID NO: 249848 - DNA, 856 bp, Homo sapiens
  misc_feature (516)..(516): n is a, c, g, or t
gttcattgttcattggtcctttaagagagagctttagcttttacttgagggttgtaagcacattagaggaataattccctttggatactatacagaaggagccacctgcaaaatgttgatgctgttattgaagtctcaagtggaatcagctttcaaaaaattagatattagatacatccgatataatttgcaatgtgtaattatactaatgtgcatatagttgtctgttgctttacatgttgcctacttgagtttttttcttttcttgtgcatttctcatcattgaaatggttcctgagtagaatctttttaaaataagcttattttaaaaaaattctttgttaattaatatagggatacgaggactctacgatctgtgttcttatgcaagaataaatatgtgcgacctagatgttggaaattaattatctctgaaagggttatcattgtggacacttgcttaatttgtaaaatatttgctactcttgattgatttagtctttttttcttgacttnttagaaccaactttgaaggtacatttgaggaaataattacgtttccctatatggatgtgaattaacccaaaaatatgtaattgccccgtgggaaaaatgtaaccctttaaggccagcaggaattaataaattttttaacattttaaaccccaaagggttaaattcacaaaactcattttaacccattaaatttcaagcccaatttaccttttttaaaatgggtttttttcacacttggttattgggcaattgggcaacacatgggtttggaaattacttggaaaacttttctgggccctttaaggggtttttggtggcacactttcccttcctttttcct

SEQ ID NO: 249849 - DNA, 357 bp, Homo sapiens
gacaaactgcctttaaatgtgttaggtgttgagctgggaatttgatactgggtggtggtgttatcaagagagatcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacctgggaggcggagcttgcagtgagccgagatcccgccactgcactccagcctgggcgacagagcgagactccgtctc

SEQ ID NO: 249850 - DNA, 421 bp, Homo sapiens
agatgtaattgggttcctgtagcaaatggggtaagggctctgcgtgtcttaatacatcattgccaccagaaggcccatttacaacttgcttagattttgttgagaagaagaggaaggctgacatccgaagtgcattacagatgctgagttgatcgttaacttctgtagctgggatctgagggacaaccaagacaggtctgcttcaacacatcacgaccatgttcttgaactgcatggaccctggagcatctcagcgtggcatcacagtgctgctcatggaaaacatgaactggcagacccattgagacattttcaaaacataaacattgtttttcttatttccatcgtttacccattgtagaaaatgtaagaaaacatgaaaagggtgaaaatctaacttaaactcccttatacaggtaat

SEQ ID NO: 249851 - DNA, 497 bp, Homo sapiens
agtttacagccttccgggaggggggaaaaatagtctccagaggagctgccctgcagaatttgctactgggtgggataatttatggtacgcatagatattgtcactttgccacagcattaaccattgtggtggttaacactgaagtgtcaacttgaaggaggcaaactattgttcctgagtatatctgtgagggtgttgccagataaaaatttgagtcagtgggctgcgaaaaccagacccaacccttctcatctgttgggcacaatctaatcagctgccagcaaatataaagcaggcaggaaaaatgaaacggtgagactgacctagacccccagcctacatctttgtcccatgctggatgcttcctaacctctcaaacatcggactaagttcttcagttgagacttggactggctctgctcctcaagcttgcagacagcctattggggatcttatggttgtgtaagttaataaactcccctttatatgtgtgtatc

SEQ ID NO: 249852 - DNA, 415 bp, Homo sapiens
gactgtatcttttcttagaaggagctacaaagttgtatctcaaaaaggtatgaatagatacaggaaagagtaaaagattttaatgatttttgtaagatttctcatacctgaaaggagaattagtaaaataagatagatctaaagaaataactcagtatgaaatatagacagagagatggaaagtgttaggacaggttatgagacatgaagataatattggaaactgttagctatgtctaattagagttccagggagaagaaaatatagaatgagcaaaaggcaatataagagataatggcttatacttttgcattttgaaggtagttcaacaaatccaaagcacaatacagggagtatatacttcatgtgaacattttagaactccctaagtacataagagatttaaaaatcagt

SEQ ID NO: 249853 - DNA, 178 bp, Homo sapiens
ttccgcttctgcctcaaagtgctaggattacaggcatgagccactgcgtgcagctgatactatctcttaataacagacttttgacagaatggtttcctatttgtgcttttgtttttactcagaagtcagacttctgctggccatttttatggagggccattgttgatttcttgagttt

SEQ ID NO: 249854 - DNA, 428 bp, Homo sapiens
tccttacttatatatttgaatccttgtgaatgaactgtaacctagcttaatagtcagatgagactgaaaacctaacttaagagtatgcactggtaacaatagctaagtttggccaatgccagcagccatacttcaaccattcatatactgatgagtgttcaaactatgttcaaataaggcataaggcgagctgaattatgtctgaactatggttcattggattcttgagaagttataaaatattttggattaaaagattttctggtataattttgagagtttttctagatttgctgaacacacacacatatttttggaagtctttttaaaaatttattttattattttattttattttttattttgagacagtctcgccctgtcacccaggctggactgcagtggcgcaatctcggctcactgcaaac

SEQ ID NO: 249855 - DNA, 436 bp, Homo sapiens
cgtgtgcatgcttgtgtgtaccgtttacatgtagtgtgtgtgtgcacctgcatgtgtgggttggtgtgcatttctagacggcaagaaattccagtagaacttttgactttcgtactattctacagacattcttttccatccgtcccctgtaatgatgacttcaatgggtcagatactcttgagccttttcatgaacgatctttgctccaagtcttccctcagcttctcactgcctgcatccttccgcgattagactgggatctcagtctattcccagaggtctgagactctcggcagcccagcagtcgtcagagagaccatggcgggagggcatcttagccttcactccttctactgcaggtttgaaactcaggctcccttaaaggtaaaccaggatatcacacagataataatagtatgataataaactcacatt

SEQ ID NO: 249856 - DNA, 427 bp, Homo sapiens
gacctcgccaagccccatacgcccttgtctctcttccctctgcacagctctcctctccctccccaactctcccgggagccctgtccctctccatgtccccacccccacccctgtgcacagtgccactgtctgctgctgagccagaccccatgagagaccctgccggctgggggcagggctgggcgccctccaggaggggccagactctttcattccccgtcctagcctgggagctgcctctgggaatcccttcctcggctactgacttcgtgggtactgggtggggggtggggagcaggctgcatcaggaacctggggagagagttgaaacccctatcctggaatagggagacactcctgacacccacagtgggtatggaaacaccactctaccttgcaatttttgcaggaggaagaaagaggagtt

SEQ ID NO: 249857 - DNA, 683 bp, Homo sapiens
tctgttcttgttccttactcactcattattctcattattctaaaatgctcttacttaaaaatatttcattaaagtactcttactattctaaaatattcttactatcctaagataatgtcactctctcaattaatatttcacttttccagttcatttttcatttatttttgttcaaagagacattggcattcttttacccatgtaaatgtatagacactgggctataagataccaaagagtaggcccctggagagtttgaggcatcatgctatcaaagacagcaatggtggctgtttccttcaagatatactatgactttatctaaatctttctaaatcaaaaattttatgagaagaagacataattaacttgatagttatcaagttctctttatacaaagaaattaaaaagcagaggtagaataagagtaattaatattaatagtataagtaaaagagtcaatgacaaacccaaatagaaagacatgggaaatagttttgtgagaaagctaggacagaaatgttttacttgaaaggaaattaaggtcccatgaggtaataaagggattgtggttaggagcttaccaacctgggggtcttagatatcattagattcccagttagatatcatttttgttttaaggggctggattccattttttgtcccttcaggggaaggatcta

SEQ ID NO: 249858 - DNA, 431 bp, Homo sapiens
tttttaacaaattttaaaggaatccgtaagccaaaatactaagaatctttgatttgggagactttttttcttccctaacagaaaaattccaggtctaataactcacacaaagatatcaaatttctgaaaatcaataaggccaggcgcggtgactcacatctgtaatcccatcactttgggaggctgaggcaggcagatcatttgaggtcaggggttccagaccagcctgaccaaactggtgaaacgccatctctactaaaattacaaaaaaaattagctgggcatggtggcacacgcctgtaatgccagctacttctcggaaagctgaggcaggagaattgcttgaacctgagatgcagaggtggcagtgagccgagatcgcaccactgcactccagcctggatgacagagcaagactccgtctcaaaaaa

SEQ ID NO: 249859 - DNA, 523 bp, Homo sapiens
aaccacctaataacatttctttaggcgacagagtctctatggaacacaaatgggaaacattgctatatttttaatggggatagaaaatacatacagaaaagtgcacaggtcataggtatacagctgaatgaattcttacaaagtgtgcaaccagcacataaatcaagaaacaaaatattaccagcatcccagatgcctctttgtaattccttccagtcgctactctcctatgaagataactagtattttttagtgttttattcatggattacatatgctcttttgtgtctggcttcgtttgctccatattatattcatgagggtcattcatgtttggtatatagtcatagttttcatttgccttgctgtaactcattgtatacttgtttctggttgttgaccagagctgctgttatctttcatatatatctttattactatgagctgttttctagcctctttgtacagctgactttttacaggagtatgcctcccatctctaaataaacatgtaaggtagaac

SEQ ID NO: 249860 - DNA, 269 bp, Homo sapiens
gctcaggtcggagagcgagaccccgcagatcggctacttccggaagaagttcggctcctgtcgggcaaccgctcggctatttccgtcgcagctcggccccacccccttttccgagggcgggagaggagtcgggcttaactctgtcctcgctggagccctgcagctcctcctcgcgccccaaagactcgcgcgccttagcgcttcgccaggttatttgcaagcggctttgcctgtcatttgcataaatggtctacgctcccttacccttt

SEQ ID NO: 249861 - DNA, 531 bp, Homo sapiens
ttttatgatttgatattgaacaaaatatcagacgtttaaacaaagacgagatccgaccagtcatttgcacgaccttgcctcaatcacctcaccctaattccatccctgtttccaataaactttatttacaaaagcgggcatattatttacctcatgagctgtagattattgatttaattttttaaaaaatattgcattaatgttattcattttgattactgaattttttgagacctcaccccaccctgttactggccctgccctttgacgttgctgcaaattgcctagaagataatcgtcattcaaagcagccctattccttgagctgtctggttacctaaattcggtttccacactcacaaacagaagtaatagttttactgctttggattgttgagaggatcatcagtgcatacatattaattctcagcaatcccagcacttcgggaggctaaggccggcagattgcttgagctcaagagttcgaaaccagcctgcatagaaaacatggcaaaaccccgcctctacaaa

SEQ ID NO: 249862 - DNA, 353 bp, Homo sapiens
tactaatgctcatattagtagtctttgtccaaatctctgattctttccttaggaaaaattcctaaaagaacaattaatggttcgagtcagtaatttatgtaattgtcaaaatggttttagtaaatgatgtaacaatttacatttttactaagagtgaagaaaggatacaaacctaatcacacattagccaactattaaaaagtaatgttcatttaaaaatacaaaatttaggctgggtgcagtggctcacccctgtaatcccagctgggagctgaggcaagaggattacttgagcccaaaacttcaagacttgcctgggcaacatagtgagaccccatcctcacaaaaagtta

SEQ ID NO: 249863 - DNA, 556 bp, Homo sapiens
gtttcattcatcccatctgtcattgctttccattggccaaacccagctgaaagctagagggcaagggagcctaagtgataaagtctacagagctcagccttcagggacacagggaagaggggagaatggtggatacacagaataaccagaacattcacccacaacctcctttttataaaagtcagtgttttgcttggtattgttgaccactgcctccttgaaataatcttttcctgtggcatgtgtggcagcatatttggccacttttccctctacaggatgctcctgctcagtttcttttgctggttcctcttcctctgtcctttcctttgtattggtgtttttttgttttggttttttttgtttgtttgtttgtttgttttacaaactcccaaagctccatctataagttgaaaattcacaaaggtatacctctatttcagatttctttcctgaactttagacttcagggtatgtaactagagcacatctctgtatatctgatgatcttgaagcacctcatattcaatgtgtcttcagttgaactcacctccca

SEQ ID NO: 249864 - DNA, 431 bp, Homo sapiens
agtagctgggactacaggtgtgcaccaccacacccagctaatattttgtattttagtagagacggggtttcaccatgttggccaggatggtctcgatctcctgacctcgtgatccacccgccttggcctcccaaagtgctgggattacaggcgtgagccacggtgcctggccttgttggtctttttaaggaaccaacttcgggatttgttaatggtttctatggcttttctttattactttattgatttctgctctttagttccttagacttactttggttgtaccttgtgcttttgctagaacagtcattgattttaggcctttctttctttttaaatataagcatttaaagttgcacctttcacattttgttttactttcattataacttggcttgaagtgtattctaatttcccttctgacttctttg

SEQ ID NO: 249865 - DNA, 138 bp, Homo sapiens
gagaaaggaaaagagcccacacaatggagtaaattacattgacacttactgggagatataatcaatagtcactctgacaattacatcatcttttagcaattctgatgtcatcttgaaataaaatcacttggcaattta

SEQ ID NO: 249866 - DNA, 564 bp, Homo sapiens
gttttcttttatctgaaattttctgttaggatctctgaattctgtttgatgtatttattaattctgggataaaactatccatgtgttgaattatctttgtcatctgtgttcatacttttgtctctactctttattattatcattattattattttttgagatggaggtctcactatgttggccaggctggtcttgaactgctgggcttaagtgatcttctggctttagcctcctgagtagctggaattataggtgcatgccaccatgtccagtttttgtctctaattattgttttgagttttcttttttccctcatttactgattgtcagtgtttttatcctccttgtgttcatctttataaatttttagttcatatattgtataatggtttttgtttgatctcagtctgttttttttctagaatcacgcttttcatctggttctaattgttttatgatcttatgtttaagcttttataggatttatattttaatttaattatgaagcatctttggttaatttgcctttgttcttaatttgtctttgtccaaatttgcggctgc

SEQ ID NO: 249867 - DNA, 761 bp, Homo sapiens
  misc_feature (720)..(720): n is a, c, g, or t
  misc_feature (739)..(739): n is a, c, g, or t
  misc_feature (761)..(761): n is a, c, g, or t
ctgcctcagcttcccgagtagctggaactgcaggcacgcaccaccacccttggctaatttttgcacttttttggtagagatggggttttgccttgttggtcttgaactcctaggctcaagcgatccacccaactcggtctcccaaagtgctgggattacaagcatgagccagcacgatcggcctgaatttcttaatgttttccttcactgggcatttaggaccttgttaaagaaggcctttcatctccagagcccatgaagatgctctcccatagcatcttctaggctttaaaacattcagagcttatttgctgtgtggtgttggtgagggctctaatttttctccccgcaacccagataaccagggtcacccagttaacagagctttagagtccacgttgctttccgttgctcacgtcttcactgactgctctgttcatctgcctatctcagaatcacaccctttctccaggaccactctccttctgctggaagtacgttcttcagtgagttccttgagtctcactctcctgagtttcgtgttgtgataaattctgtttcccatctggaaatgccctttaccgtgagcagattcttgaacaaccatcaatttcaactcctgattctaatttgatggtgaagagtcccaggccaggcgacctttctctcaagaaggagatgtcagaggcccctcgtgacagcgagcttccggggacaggnctccttgtgttgtcaagtnaataatgagtaatatcccgccn

SEQ ID NO: 249868 - DNA, 438 bp, Homo sapiens
ttcttacgactgttttcccgtaaatttgctatcatttggagatggctgatggtattgttttaaaaatacagtgtcagcttggtggattaaaaattccaagatgatttgtgcataattaaatgtttccctggagcaaagaaatcctctttttctgcggtgggtgcggtgtggggtccaggtctgtggtgcggtgtgcggttgtgggtgctaggcgttgaggcagacgctggcaaaacgcctgtttatcaccaatagctttgtctaaaaaggtgtgtttgtcctgcgcttggacctcctctcatgacctcttctgcttggaaatcctttcatccaatttgttctaagtgtcttaagtgaagtcaagacccctccatgtctcccctaatacgataatgactaattcttacaggcaaggcagtccggaattcgcaccaaaaa

SEQ ID NO: 249869 - DNA, 420 bp, Homo sapiens
ctgtcatggtctgctcctttaaacactgatgactttatgagtacctaaagatagcaagcttgacacaaacataagatatctcaagagagacaacgtttatagtgtcagtggagaaagtctttctaccagctccaagaataaggacttttgacccaagggaactgaatcaggagagaaataatatgtttgatggtatttggtaactattttaaatgacttatttgcacatatactgagttactcctttggtatagcagaaatatttgagcaacaattttcagttatgaaaaaagttaccaaaagccaacaattgtgccaatgagtagcaatgcaagaaacatttcacttctactgcaggatggtaaaaattgtatgtaaatttttttgtatcaaatacatttttattagaattctaatata

SEQ ID NO: 249870 - DNA, 805 bp, Homo sapiens
aggggatggcttggatttgaataataccatattgacagtttcaccatttagaactgctgttttttgttttaatgttcggctttagattcatggaccacaaattgaactgagtgccaaggaaagtttgaggtagtgctatgttctctggtttggctgcagccccacttctctgtctttccttctatttaagtgattcaaacatttgtttcctgcctgccttttgagaaaatttggagtttgtgaaccctgctacatgagaattcctagcccaaataccttggatattgttagtaccttcgatagaggtagaaaaaattcaatttaatgtgataagtttggttttacatgtgttcagttagaaatgacaaacagtgtcttgaaaaggggatctggtccttgaaaattagagtgcatgaatgtgaaagcaggtcatgtaatggaattcaagattagaccttagatgtaaaaaatgaatatgtatttatatttgaaaattatcaataatgagatagtagctaaatccacaagagtggaattattcattcaacagtaatgtattaataatatgttgagcatctattatgagctagacatggacgtgctgaagatatagtggagaacaagacaggtaagccctcagctctcatgaagttgaccatctgaatggctgaatacagagtatactctcccagaaatagtggaaagcataataataagcatccgtgacttgagatttgggaaacattgtcagttaagaaggtcgaaaagtttcacatgtgttttaaagataaaacagtgtgaaagt

SEQ ID NO: 249871 - DNA, 473 bp, Homo sapiens
gagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgttttcattacaaataagaccaccgagtgggctcctggcgtgggggcgggaccagccgcgcgcagtcttcagaggcagccccccaggctgtctctggagggtgtgtctctgcttccctttccccgtgtttattttcagacgaagccaagtggcc

SEQ ID NO: 249872 - DNA, 474 bp, Homo sapiens
acggcgggctgaaggggctcctcaagtgcgccaaagcgggagcccaggcagaggagacgcccagagccagcgagggctgtgaggactgccagcacactgtcacctctcagtaacatggtcccagataataattaggaaaacaaatcaggaccgaaactccagagagtctgaaattggctgaccatggaacacctaacccgaaaatatgcatatccctttcagagggcaaaagacagatactgcagttcctaggacagccatctctccatctcatctgcttagctgagaaaaacaagctcaccatattgtacatatctctggtgggaagatataaaagtgagaatagcaacatggaaagaaaccttgctggagaaccattttcccaatgcaactatatttcctgcttatcccagggccacatcaccaaaaatatacattgtgagatggatcatataaaagtattataaaataaaa

SEQ ID NO: 249873 - DNA, 551 bp, Homo sapiens
acggcgggctgaaggggctcctcaagtgcgccaaagcgggagcccaggcagaggagacgcccagagccagcgagggctgtgaggactgccagcacactgtcacctctcagtaacatggtcccagataataattaggaaaacaaatcaggaccgaaactccagagagtcagaaaaggataagggaccgatggctgaaagcttgggaatccttgcatcatccacaactggcttacgacaagaaatcaaacaagcgcagtttaatatgtcttcccagtcaattcacagatattgctgagtggatggggttgagtctgaaattggctgaccatggaacacctaacccgaaaatatgcatatccctttcagagggcaaaaaggaggaagcaagaacacagaggcacacagggaagaccaggtgaaggcacaaggagaagatgagcatcttcaagccaagacaagagatctcagaagaaaactgccctgccaactccttgatctcagatttacaatgcccagagctgggagaaaataaatttctgttgtttatgtca

SEQ ID NO: 249874 - DNA, 682 bp, Homo sapiens
ctgggaaagccacaccctgaatctcactcaggactgtcagaatgcccatcagggtaagtggaacacactgggctataacaagcgctgaaggtttggaccccgcaaccaggctcatgtgcaagacagatgtggtatgagataaaatcccttggcctcctctcccagtgccttgtagcccttcccagggtagccctggcctccaggcacacagttcctgtaaagctaggcctatcctactctggaaaaaaatgttatccctatttccttctgggagatgcaagcttttcttctgcagagggagggcatagttgtttggtgagtgacagtcctgaaatggctcctgaacattattttcttcctgggagaggctgatggagaactgtcctctcctcttgagtgataactttctccaagccacatagttcaagaggtagctacactgtgcagcagtagcctggagcaggagcatcaggatgaccccagggatacctagatgagttcttgggctgttgcttatgctcatcctaagagttacctgagttaccgttccacaactttttattacataaacagggacttaatgtaccagcagcatgggcattataggaaaaaaaaaccatacagctctcattcataaggaacttatagccaaatggggcaacaaaaataactacttgtggac

SEQ ID NO: 249875 - DNA, 770 bp, Homo sapiens
acccgggctgcaggaaaatttaaaaagtctaattacaagatgaaaggaatggctgttctagaagaaaaatgtatcttttaagttgatatggaattcattattgaagcaattgtttattgcctaaaaggtggattttggtaattttttttcccttcctaacatttaggctgatttgagaaattctgtgtttcagaaagaatctgctaagggcaatgctgtagtttgtttcatcttgtaggagaataaaacctctatttagtatggggggaaagcacaaaacaacccttgattttctatcatgactgatatatgcattgaaatggaccaggtcattaaaaacttctctgtttgtagtggttcctatatagtctagcaatacctgaattagggaaatttgagtagagatccttagaagcattgttaagttacaaattatggttaataataagctcagtaaacactttagaatagtgttataattggtatatatgtgccaggaatgatacgaggaactttatgtgtcatgatccctgatttacagatcaggaaaccacggctcaaagaggtgaagttcttttcccaaggtcacatagcatgtaagatcaactccaagccctgtagttgtccagctgtaatatgttacgttgtaacaaattgctggacttttccttcaggctgctggatgaagcatctgtgtttctatgagctagtgctccctgtaaaacccttttggacaatgttgaacctttgccataaagcatttgagaggt

SEQ ID NO: 249876 - DNA, 643 bp, Homo sapiens
ggtggacagtgaggcgctgcaggtatacatgaaacccccagcattctgagtcctttatgaatgcattttcctacaaaatgttcaacttaggttcttaaccatgccgtattgaaaattaacctcaagcaaaaacttagagcctgaaacacatctttttttacaaagctgtactggttttcaaactccctggcctttgggcacccacacaccgttgcccaacacttgcttctcttccttctctcttcctactcactgtagcctacttctaaccctttctccacactacagccaacacagtattacacacactgacatgacagtctctccttcagaagccttcactggctcctcgaagctgccaggacaaaggtcaggcttcagtgtgccctgtgcatgtcccttgtctttctcactcaaccctctcccatttgataaaacaggatctgctttagccactcactgcgaacactgtgcccgtcacactgccctgatctccctgcagcctccccttctcatccccctaactcacactctattttttttttttttttgagacagagtcacgctctgtcacccaggctggagtgcagtggcgccatctcgggtcactgtaagctctgcctcccgggttcacgccattctc

SEQ ID NO: 249877 - DNA, 542 bp, Homo sapiens
ggtggacagtgaggcgctgcaggtatacatgaaacccccagcattctgagtcctttatgaatgcattttcctacaaaatgttcaacttaggttcttaaccatgccgtattgaaaattaacctcaagcaaaaacttagagcctgaaacacatctttttttacaaagctgtactggttttcaaactccctggcctttgggcacccacacaccgttgcccaacacttgcttctcttccttctctcttcctactcactgtagcctacttctaaccctttctccacactacagccaacacagtattacacacactgacatgacagtctctccttcagaagccttcactggctcctcgaagctgccaggacaaaggtcaggcttcagtgtgccctgtgcatgtcccttgtctttctcactcgtcccactgcctaaaaaatcccaatcatataactgaactcctcacacccaattggagcaatctatccccctatagaagaactgatgttagcataagtaacatgaaaacattgggcgttgcagatcat

SEQ ID NO: 249878 - DNA, 919 bp, Homo sapiens
tctggaaggtttcatacgggaagtgacatgttaagatctggatcttaaagaacttggggaacctcagaggatccagaacggcagctggtccttgctggactgttcctgtccatgtgcctggtcatggtgctggggaacctgctcatcatccggccatgagccctgactcccacctccacacctccatgtacttcttcctctccaacctgtccttgcctgacatcggtttcacctccaccacggtcccccagatgactgtggacatccagtctcgcagcagagtcatctcctatgcaggctgcctgactcagaagtctctctttgccatttttggaggcacggaagagagacatgctcctgagtgtgatggcctatgaccggtttgtagccatctgtcaccctctatatcattcagccatcatgaacctgtgtttctgtggcttcctagttttgctgtcttttttttttctcagtcttttagactcccagctgtacaacttgattgccttactaatgacctgcttcaaggaggtggacattcctaatttcttctgtgacctttctcaactcccccatcttgccgttgtgacaccttcatcaataacataatcatgtatttccctactgccatatttggttttcttcccatctcggggacccttttctcttactataaaattgtttcctccattctgagggtttcatcatcaggtgggaagtataaagccttctccacctgtgggtctcacctgtcagttgtttgctgattttatggaagaggtgttggagggtacctcagttcagatgtgtcatcttcccccagaaagggtgcagtggctgcagtgatgtacacggtggtcacctccatgctcaacccctttatctacagcctgggaaacagggatattaaaagtgtctt

SEQ ID NO: 249879 - DNA, 356 bp, Homo sapiens
  misc_feature (203)..(203): n is a, c, g, or t
cagagctacaacgccatgctgggaaaaccactgctctctttagagctgtcagacagggatgtttcttctttgcatatttttaaattgagttgtttccttgctattgagctgtctgaatcccttatatattatgaatagtagcactttttcagatgtatggtttgcaaatatatactcccatcccataggagcatatatttgcnaaccatacatctcaaagagttaataggaaaagaaaggaaggacgtgggctatatcacaaaggaaacagtcatgtgcagaagctttttagtttgatgcaatcctgtttgtctatttttgcttttattgtctgtactttccaggtcatataaaaa

SEQ ID NO: 249880 - DNA, 527 bp, Homo sapiens
gcctaatgaaattactgaagtcaaccacatatttattaaatgaacagttaaatgaatgagagattacttttcattcaaatgggagacctggattacttggtgtggtagacagggtaattgttccccacagatgtctatgtcttaatcttctaaatttgggaatatgttaccttacatggcaagagggactttgaagatgtaattagattaagaaccttatgattgggagatttttttctggattatttggttaggctcattctcatcaaaatatgaaaaagagaggcaggaggtctgaaccagagaacaagatgtgaccatagaaacagagataagagagggaaagttagtgcagttgatgatgctatcctcctgacattggagaaatgtcttattttaagccacaagtttctagtaatttgttatagcttcaataggaaattaatacgtttgggatgtactgctgttcatctacctttctaataccttctcacagagcctgaatggaaaaactgttgtttacagtc

SEQ ID NO: 249881 - DNA, 470 bp, Homo sapiens
cctgccctgcttgggtatttggccccagggccagggctgtccctcccacagctattgaacaccaggtccttgctgcgtctggctgggctgcagaatacccttgacctttcagcatcctcagtacctctgtggagtgctgccatgaccaaactagagactgttattattacgcacattttaagacagcatcggccggacgtggggggctcccaccagcactttgggaggctgaggcaggcggatcacttgaggtcaggagttcaacaccagcctggccaacatggggaaaccctgtctctactaaaaatacaaaaaaactagctgggcatgatggtgcatgcctataatcccagctactcaggaggcggaggcaagagaatcacttgaacctaggaggcagaggttgtagtgagccaagatcatgccattgcactccagcctgggcggcagagtgagactccatctcaaaa

SEQ ID NO: 249882 - DNA, 179 bp, Homo sapiens
aatattctttgtgtcccagctattttaaatggattcagaaatccatttaagatgaagaaggacccttttcccatatttctggctatatacaaggatatccagacactgaaatgaataatgttccctttttgtaatcttttatgcaaaaattaaaaccattatggtaattgaacaacatg

SEQ ID NO: 249883 - DNA, 416 bp, Homo sapiens
aatgaaatgctaactactcaaggcattatatgcagattcatcacaatccctaccatgattccaactgtctttttcacagataaagaagtcgatcgtcaaattcacacggaattgcagtctcaaaaagccaaaacagccaggcgtggtggctcacacgtgtaatgccagcactttgggaggccaaggcgggaggattacaaggtcaggagttcgagaccagcctggccaatatggtgaaacactgtctctactaaaaatacaaaaatttagctgggcgtggtggcgtgcgcctgcagtctcagctactcgggaggctgaggcaggagaatcgcttggacccaggaggcagaggttgcagtgagctgagatcacgccactgcactccagcctgggcgacacggacagtctccagctca

SEQ ID NO: 249884 - DNA, 278 bp, Homo sapiens
gaagaaagctaacctcatttcatgctgattatttaaccttggtcataactcccaattaaatgcatttcttgaacccgtaacaaagcaaaatatggcacttactggtcagaaattcaaagcaggagagagaaaaaatggcttaatagctggaaataaaaacatcagtgaatttttcttatggattccttcatgtcaaattcatatcatgagtgactcgcagttttccctttagatcatcttggcatcatcgaggagcaaaaataaaaatgatttctagt

SEQ ID NO: 249885 - DNA, 275 bp, Homo sapiens
tttttatttgtggatttgctttagcagtcagtgttaaaactgtgacatgtgatagatcactgtttctaaatgtatgctttgaacattaatattacagaagtcctaaatttctgtgcatcttaaattatttttaaactttgtgaatagataatacactcatatggttcaaaagtaaagtataagaggatatacaataaatgtctacccccttcacgtgattcaaaaataaagtataagaggatatacaaaaaagtctaccccccctaaaaaaaaaa

SEQ ID NO: 249886 - DNA, 428 bp, Homo sapiens
ctgagatgatggggggactggtgccatggagggaggaggagtgaggtggagatcgggaattccagccaaagagaaatggggtccctgggagaaaattcccactctagcagtcctggagttgtgctcatggagacttgcttacgcgagtacaaggacagcgttgtattgacaaaatttcagccctcagtctagtcttgtaaacgatagatcaggagtgtacttaaccgtcgttactttgatccagccctaggtttcccttttctcatttgtaaaattgttatagtaatacctttttcatccatttgtggtaacatttaaatgaggtaatttgtgtgaagcccttagcaaacacagcgcttcttagtcgtgggttccgcgtggggtggattcaaccaacctcaaatcaaaaatattcttcaaaaaagaaa

SEQ ID NO: 249887 - DNA, 473 bp, Homo sapiens
tgcaatagtaggctatagagagataaaaaacaaaatctcactaactgtgggccattaattggcatacctcaaactgccctatattgttacctaccttttttggtgtctgatttttgaattccataaggacagcgaccatatgttaaacctccatgtgtgcctgctcttttcagtcatctaataaatgattctgccattattgttactcttgtgcaagcacgggcaaataccacaagcaagacttgaaaacaaatcctcagttccctgtctttaacaatgaattttgtgaggatgaatataataaaatataacagagtaatgtgataatggtcacatttaaatatatgtatgtatctacatacatatatgtatacacatcataaaacacatgtagacatgctttatatatcttactttctaccaagctcttttcatatttataagggaaattaaagtataatatatgtggttca

SEQ ID NO: 249888 - DNA, 512 bp, Homo sapiens
gtaattatgttaggagagattctcagttcaatctaatcctgtctaaacaggctgaaagaaattagtcactcagaattatataaaaggctctattgagtgcttgcaatggtaaacaacagaccctggagtttgaggacaacaccaaggtactgccatacttgaggtggagatggcgtttctcagccagtatcgtactgaataggcaaaagctggaagcagtccctttgaaaaccagcacaagacaacgatgacctctctcaccactcctattcaacatagtattggaagctctggccagagcattcagccaatcttggcagattgaggtactgcaaaaatcatgagcagaagactttatgccattgaatgccattgagacggtcaatgtaacaaaggacagctgtttgtttttcttctgcttttcatgggccagtatcaactaaagattgtcagtttttaagaccttacttaaggatgcaatgattagtaaagaaaattcaacaataaaatgt

SEQ ID NO: 249889 - DNA, 380 bp, Homo sapiens
gtaattatgttaggagagattctcagttcaatctaatcctgtctaaacaggctgaaagaaattagtcactcagaattatataaaaggctctattgaggacacagaaagaagaggcccatctgtaaaccaggaaaaggaccctcatcaaactgagtctgccaacacactgatcttggacttcccagcctccagaattgcttgcaatggtaaacaacagaccctggagtttgaggacaacaccaaggtactgccatacttgaggtggagatggcgtttctcagaggttgcagtgagccgagattgtaccactgcaatccagcctggtgaaggaacgagactaaagtctaaaagacaaaaaataaaacaaacaaacaaaataa

SEQ ID NO: 249890 - DNA, 618 bp, Homo sapiens
ttagaatgctaggatagaatttctgtctccattgtagtgtagggggtgcagatgggaaacctggaacagataccacgaaagaagcttgtctcaagaaggctgacacaatgggagacatagcagggagatggaaagaaactgctgttgtgatagccattagttcctgaattaaatcaactctaccctctgttcttcctctggattttcagttacacacatttttcttacataatcaagcttttctgttacctgcaaccatatttcagctaatactcagtatttttcaggtttttaacaaatatacattacttttatgctaacaaaataattattatattcattgattctaagacaaacttttttttaccttttaaaatccttgaaattggcatgtattatacaatccatggcatgtcataatttaatagaactttctttcataggatacattaaaaagtaatgttgcgaggcacagaaagataaatattacatgttctcactcatatatagaagaaaaaaagtagatctcatgaagatagagaatagattggtggttaccagaggccaggaagagtaggggagaggaggaaatgaaaagaagttgattgatgggtacag

SEQ ID NO: 249891 - DNA, 652 bp, Homo sapiens
gctttgccatagggtaggcacagagccagcttttaaaaagattggtcattttccaaagtgattgcatgaccttaatttctatgcaccaaataaaatagcaaattgtaaaaagttacattgtactaaaattatagccactttttgttacatataatcttcaaaatatatggaacatcctaaaaaatcagttcttggccaatagggaggatttttaatttcaggtgttgaactgagattttgagcaaagaactataaatctaacaatgatcactactgttattactgctactaccacaactacaactaattacaatgactgcaacaaaataacaaatacagtagccctgccttatacacagcttccaagacccccaatggatgcctgaaacttcggatagtactgaatcctttatatgctttgtttttttctatacatccacacctgtgacaaagtttaatttataaaattagacatagtaagatattaacaacaataaataataataaaatagaacaattaaaacaatatactgtattctgagttatgtgaatttggtctctctctctctaaacatcttactgtactgcactcatgtattttcagaccatggttgatcaaggaaaactcaaactgcagaaagtggagctgcag

SEQ ID NO: 249892 - DNA, 212 bp, Homo sapiens
gtatccatattggtacatgtagctttggttctttcatttttctatcagagtatttcattgtatgaatggcctgtgttgtatttatccaggtcctcttggtcctcttgatgggcatttaggctgttgcccatttctcactattattaagcacactgagtgaatgtctagtctgtgcttccttgagtggaattgctgggttgtagcatacatgc

SEQ ID NO: 249893 - DNA, 570 bp, Homo sapiens
gaaagatttctaaagccaccacactgagttttctaggacaagaaattcacagccgggatcagcagtttctatagagaccccagagaccgaaagagatgcagagacacaaaggccacatgtgggagagacaccaggttacagggcagacagaggggcacaagccagtcctacagcaagcccagagacatggcggagaggtggcggccccggggatctgagaagggagaggggttcccaccccacgcagggtggcctcggccagccctccctgcatgggtcccccctttgcaattacgcagaaagctgctggatactccactgtttggtcgtttccatagtaaccctgtccctggcaagatgcccaaatattattacaaccatccagaggagagaacaatccaagtggctgtctctctgagcgtgtgtaatatccatcctgtgtacgtgccatctgggcctccaaaggtacttcctgtgactgcctgtcagtcatatgtgtgtccagatgcatctatgtgtgtgtgcagagccaccaacaaacatgctgatgctgagctctgataatgcctg

SEQ ID NO: 249894 - DNA, 289 bp, Homo sapiens
gtccctccggcaccactcccatacttgcatttttctttgcatttttgtttgctaacatttaaagtgtggaatttcgcataaacgtctgtatttcctctgcttgaaaaagggctttgactccaacctctgaaaatgcttcaattcaatgaaactaatggcactttggtctctggaattagatcctgttatcaatgacttccacatggaaagatcattccaaaatgtgtaattaaccaagaaaatgcaaataaaccaatttgtacctgctatttagaggtaagacacagaa

SEQ ID NO: 249895 - DNA, 259 bp, Homo sapiens
tgttttcccagcatgtaatgggcaaacaaggcccttcaaaaaacagatctgaccctgttgacttctgcagacacatctagcatctctttcaacttgaaaaatcatgtctatattcctgcattcctaagctaccagctaaattttttataagtttaaatttatatttggatgtaattatatatttataaattacatatatattttatatttttaagatatttacttgtgtaaaataaataaataaatgggtaaaattttc

SEQ ID NO: 249896 - DNA, 447 bp, Homo sapiens
ttttttttttgaagcagagtcttgttctgtcgcccaggctgaagtgggatgatctcagctcactgcaacttctgcctcccgggttcaaacgattctcctgcctcagcctcctgagtacttgggattacaggcacctgctaccacacctggctaatttttcgtatttttgtagagatgggttttgccatgggacctggacaagtgaaaacttttctgagcctctagtttctctctgtttctcttttttatgtgaagcattttctcatctgtaacttgggcctaacatataaaggacttggcatcacacctaactataaggaagtagtcaacaaactggcctggcacagtggctcacgcctgtaatcccatcactttggacttttaaggtggtgctagaaaaacttaaggcttttgtcgacgcggccgcgaatttagtagtagtagtag

SEQ ID NO: 249897 - DNA, 432 bp, Homo sapiens
ttccaatgagacagggcacaccaaactccatctgtgctacaactcagttgcttattgaaatgaagagggagtttgcaagctgaaaagtggatatgagctaccctggaggaattttttcttggtagggaaacagctttgtccctataggagttgttgaacaccctggcttttggagggtgttcagaatttatttggggagatagtggagatcactgccagccacagcagtcttggcatttcacctttccttccagatctctttcagtcccattctctccccactgcactatagcatttgcccccatacctaagtcttactcttctgcttccctctctccttctgtcagttctctgcctgaggccctgctttatttcccattcctttgtaggagaaaagggaagataatccctaagccaggggcttaagttctc

SEQ ID NO: 249898 - DNA, 569 bp, Homo sapiens
tgagtagtattccttaacatgtcgaggctataccatgtatgtttgtactttcacttgttattggacatttctatcattccgcgtttgggctattatgaagaaactatcatgagcatccatacgtggcaggccaggtctcactaacacaggcctccgtaacaactgtttcagtaccgactgagtggttcaattaaatattaagaggaaaaaaaaaaaaggaagccagtgcccttatacaaaggctggaatgtaccaaaagcccaccaagagttttgcctaggttttcccggggccttaaagcatgacgaaataacgaaggcattcttaacaggagccatttagtattaaataagttttacggggggtctgaagaaactccccaggcctccacaaacaagtttattggagatctgaagggactctccaaacctctgtgatttagcaggagacaagataagggcccccagcacctagacccatttagattaactgaatttaactgaggttccagaggaaggtcttcaggactcagacttagttatagattaaaagaagttaatcacttatgt

SEQ ID NO: 249899 - DNA, 398 bp, Homo sapiens
gctcttttggtcattgaatgacagcgtatcccagagtgacttttgggagctatttttgagcttacccatatttgtagttccccaactcaccgggaatggaggctgggtgagtagcagaggaacgtgcctagatgtgacaaaagagtggggtagatgtattaaatgaatattcaatgagaacccactgtacgccaagcccttttctagtccaggaaactcagcaatgagcaaagtcataaaaatcccttctctcatagaatttacaatttgggatgtgtgtgtgtgtgtgtgtgtgtgtgtgtgtgtgtgtatgtgtgtgtatgacacatacacacattagggacagggtgggtaagatataatgactaaaatgtgtggaaaacttcatatggtatatt

SEQ ID NO: 249900 - DNA, 558 bp, Homo sapiens
gttcccaaataagcactcaagatactctcaacaagcttttaaaaattctacatttccagtttcctgtcagccaaattgatttatttcctacaatgttcctaagtacatctcaaacacatcttaactataatctttccaaaaatggtcctgtattagtctatcatgcaaaattggtacacaatacatagatttatacatagttatttaaagaaacaaaacactccttagctaccaaccatctgtactggaatatatttaaatactataagcttttcactttaccttttatcaatatttctaaactttaaacaacatcagaagattctgaagcacacagcacttcagatttacttttcaaacaagtatgtgttggatacaaatattttaaaaaccagaatctcttagtcacagtatataaacagaaatacaacatactgaattaggaccactgcaaatctatattcacaacaatgagtatagtctttccagtcctgctaccaatgcaatatggccattttattatatctcattattcttcatcactcaaaaaacaaacta

SEQ ID NO: 249901 - DNA, 376 bp, Homo sapiens
caagcagcctcacctccccaagccctgtgcctcattcacaccaggggttagccaaaggacacagcaggtgccatagctgctccttgtgaagtgcctgtgagccctgatcaatgtgaatgaatgttgtcatggtcacaggcatttcaggcatgagtgtctgtcctacatattggatctgtattagtttattttcatactcatactgctatgaagaaataacccaagacttgccgggcgtggtggcgcatgcctgtggtcccagctacttgggaggctgaggcagaagaattgcttgaacccaggatgcagaggttgcagtgagctgaaatcatgccattgcactccagcctgggaaacagagtgagactctgtctca

SEQ ID NO: 249902 - DNA, 486 bp, Homo sapiens
ccttcccccagcacttcttgaattgcccagacctcccacaattaccctcttaaaaccacacacacacacacttactcactctctcctttatatatggcagaaattaatgcctgtagaagtgaagggggtgaggttctgagagctcttcaagatttgagtcaaaaggtgattttctgtttatgagggcagcgagtttaagcagttcactcccagggcagtaatgtcaaaaagcgtttggatgacgaccaagtggaataaatatcttgtaaaatggcatgtttaatagtaaaaatagattaatggagctgtcaagtggttgaatgggactaccataaaggtttaagtttaaagggaaagttatgtaaagctgtatacacagcttcttttaaggccagaagggaaaaaatctacaagtaaggctgaaatgtgtcactgacaataattggactggtgatgtgtggaaatatcatcgctgtttaaatgctc

SEQ ID NO: 249903 - DNA, 687 bp, Homo sapiens
gccctctcctcaggcgccagtggagcatgagctgtgctgtggatgaagtccgttggcacagtgagtccctgggatggaacctgcactcgctgcttgacccatggctgggtgagtggtgaagcggtcagcacaagcttctagcccaggcttccctcttagcagcatgtggccttgggcatgtcacagagtctcccttccctctcccccattttctcttctgtcaaccgagcataactgacgctacaatctcactgacagatggtgagcgaggatggagtgagcgggcatgtgcggctcttagctccatgcatggctcaccgacgttggccgctcttgttatcattacagtgatgattattagcctttctacatgacagattctcaaacctggctgctacccatgagaatcatgtggacagcccttaaacaaagattcctgggctcccccttgaacttctgcaccagaactgccaagatggagtccgggaatgtgttagctacgtgcttttaagacgactctggtgcccagcctgggaacccacaaggggcatactcctggcatgggcaatgtctgtgtttagtggggccaaatactgccccattgaatcaagaagtgcactctatactgggctgaatagtgtcccctcccaaaattcctgtccacctggaatccatgaatgtaacctt

SEQ ID NO: 249904 - DNA, 919 bp, Homo sapiens
ttcctttcttctcttagtatattaggacctgcagagcaaggcataatagtagtagtaaagataggcaacttcatcttgttcctcagtctaatagaaaggtgtctagtattttcctactaactactacaatgatttagtttgtcatcagatacaaccttatggcattaagggcaatccattctaaggtggcgatgagtcccccacttttataaggaatgaggactggcttttatcaaatactttttgttcatctatagagatcaaatggttttctccttaaaatggtgcctggcaattaggcaactgcttgtttttacaattattacaatatcttaataacgatcttttcaaaaagttttcctatgctgacctttctttgtattctagggataaatcctttttgaacacagtgcattattctttcaatacactactgaatatgacttgctaatattgagatttatgctttcagtgtattagaatctaaggagcaaggcagaatgatgaataaccttaagctttctttctcttttgtattttccttgctcagttttagcaaaaaaattatgctagcctcagatatttcctgagagcagtatgtctattttgccttctgagttcaaagttcgctaaacagccttcaattttaacttgctaattgtgttattcaaatttcctatatcccccttttcaactcaggttagtcaataaatttgtaaggaatttccatgattctcgagttgtctactttcccttgtactttcattttcctttctatattgtgaagttatgtccctaatgattgctataaattattgatgaatatcaaatactactgttaagttttctatttaaattctgacattaatagtgctattgtctgtagtttttaaatttcagactcattctcataaaatta

SEQ ID NO: 249905 - DNA, 703 bp, Homo sapiens
tcatataattgtttcatatatactgttttaatattccaaaaataaaaataataaaagaatagttacatatttttggttgatctcctgggggaaggtaatagggtcattaatgtgatcacttgcttggcaaagactgactgagaccctgctttgtgccaggctatacagaaagaacactaacatgaggaacatggtccctaccctcagaaatcttacagtctagggaaaaagacattaaataaatcatcttgtaaccacatacataaatgcaaactgtgttaagtgctacaaaaaaacaacagggtacccaagttagactggggtagtggtttcagttatttaattgtggaagcgatatttgggctgggccctgacaggtggagaactgagccctaggggtggaggcacattccaggaagaaggactagcatatgcaaaggccacagtctgaggaaggagaagcgagtggataccagttatgtgtccactggtctggtccaggtgtgggtgaaggggcgcagactggagtggtaacaaaggggatggagacaagcgagcagatgagaatggatctgacacaagtgacaagctgtggagtcaggactgagagagagcatacaacaacataaaacaattgggagaatatgacctttcacttaaaaaccaggacaccaaacaatatacaattcaactaagtcaaaaa

SEQ ID NO: 249906 - DNA, 331 bp, Homo sapiens
agtgtgtgttcatagtttcccaaagtggctttgccatttgcatttgaaccaggacttttgtgtgtgagaattctagctccttcttgtccttacagagcagctggatgctgcgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacaaatgagttggggtttccaacagggcaggtgggggcctgtgggtggatgggtgtggcagccacagaggctggg

SEQ ID NO: 249907 - DNA, 757 bp, Homo sapiens
tccctggggcagatgaatgctcagccacgtcagtcattcccatctgctgtgccacggaggttcaggtgcctgttagagtgaaagaaagagtgtatcaggtgtaccttcttcttagccttcctacttcagtccttcaaagagatttgatttctctaaggtgtctcttgtttatacagaatggattgagttttgtcacattcaattctgattatgtgagattcctgctgagtgaagccaaagctagttactttaatgcctattagaataggttccttacaatgtaattctgagaaaaagaaggacccattctgactcgtacacatacctgaacttgaattttgatgttggtcacaagagttctttctgatgtggagggaacaaacatgactggatgaaaagtgaccaggcttgttattaatactaatgaataaattaattagtaccaggtacagagcagaaagaatagagacaggggcatccctagttcaatttctgggataaataaaagaaaaacattagaagtatatgtgtccatgatgcatgtggtgtgtgtgtgtgtgtgtgtgtgtgtgtgtgtgtgtgtgtgtgttttacaagagagagagtccaggaatgaaaaaagatatatttatcccaactcattaccttgttcaaccaaaagatgactgtcttagaaatagcctaaaattaggttgcagtgagtcgagatcgtgccactgcactccagcctggcaacagagcgagactccgtctcaaa

SEQ ID NO: 249908 - DNA, 942 bp, Homo sapiens
gatacaggagacgaaactcagcgagtgagggacgggcagcctggggtgaggcgagtccaagacgggatccgtgcaattgagacgaaacccagcgagtgagggacaggcagcctggggtgaggcgagtccaagacgggatccgtgcaattgagacgaaactcagcgagtgagggacgggcagcctggggtgaggtgagtccaacacaggatccatgcgattcaggagtaaggacagctgctgttaatgcgagcaggtgcccccattgctgtcatgctcgggaaaccaaccgctgtcgggaggacaggcctgcaggggctcaaaggctgctcctggagcaagaatctggtaaaaccctgggaacccagtgcaccctgaatgcgggacatgcacccgcagacccctgcccaggaacgttcatagcctccccggaccaggaaaacacgtgcacccctcagccacgcactggatagagtgtggtagatccacagctgaagatgggcaacctgctgccgtgttcaacaaagagaaatcaagatataatgcccagtaaaaaaaaagaaaaagataaatgtagtcatgttccatgtgcatgaaggtcaaagacagtcccgtgcatcggagggagagatgggaggatgccggggaggcccctgaggacggggcagagcaagtgtgtgaagcgctttcttcctccttgttcctccacccgggtgggggctgcaccgtgttcattttggagcagtttgtctacctgtgcccgtgcggaatgtcctctacccgcgcccgtgtggaatgtgcgtcttgaagtgcagtattgcatttcataaaaagcccttaaaacggcattagaagcagggccggaggcacccactgaatccagctacacccatctctccagaaatcgcctcacatggccgcctgtgcatgcagccatcttttga

SEQ ID NO: 249909 - DNA, 549 bp, Homo sapiens
gaataatagtaatacagtgattaaaaatatagttttgagaattaaatacattaatacctatagaggacttagaacagtacctggcatattataaatgtctaataaatatcaatattacctctaacccatgggtctctactgggggctgtttttcctctcaaaggacatttgccaatgtctgcagacagttttcattgtcatgagtggggagcaggggtagaggcctgggatgctgctcagcatcctaggatgcatgagacagcccttgaaaatgaagaatgaggcatcgcaaaatgtcagcattgctgaggctgaaaagctcggctccacttatgccaccattttctcaagcctcaatcaagcgtccattctgttttttctccgtcctccactcccttgaatgctcattttctcacctggtttcagttacaaactggttttgatcattctgcaatctacagttccatcatcctgaataataatatctccagtggtggatagaaaaatctctcctggcatgttctcccaatattggaaatggtgaagacc

SEQ ID NO: 249910 - DNA, 462 bp, Homo sapiens
cttattgcattgctgtccacgcagcaggtgctcagaacatgcagtgagtgaaccggtgacgttccttcagcttccctctcccatcacattcaagcaggggatgcagcggcctccttttccccacccccacttccatacattcacagtcccatcttgattcaaaggcaacttcaattataacttttagtctgggcacagtggctcacgcctgtaatcccagcacttgggaggccgagtctggtggatcacttgaggtcaggagtttgagacaagcctggccaacatggtgaaaccctgcatctactaaaaatataaaaattagcctggtgtggtggcacgtgcctgtaatcccagctacttgggaggctgaggcaggagaatcacttgaacctgagataggtattagtaagccgagatcatgccactgcactccagcctgggcaacagagcaagactgtctca

SEQ ID NO: 249911 - DNA, 426 bp, Homo sapiens
tagcaaataatagtgaaatcataatagagctgtgattcaggctgtctccatcctctaatgtcagcctctaaaactcagccaaagagcttaaaagtcctggaacttgacttaactatggaagcttccagatctttagttagaatttccttacacattgtcttacagaatgaacttccgtcttctagaaagccaaacaaccaaaacaaaccaaaaggcagaattaggtgggaaatctcagtttaagaatttgactgatgattttctaactctgaaaccctaactcaggtcagaagtatacaagtcaggttacagaagatttaatgtcgtattcagaacccatgtgatttgttataaggctggatgaagaagagaaaaaacaaaaataagataaaggaagtgagactgtaaacaaaaaataaaaaacaa

SEQ ID NO: 249912 - DNA, 438 bp, Homo sapiens
tctggaccacatatctgataattcttacagccctttaaagataatcataactagaatattatcttattttgtagctcatagatgtcaaaagactagctcataattttattgcggatacatagcagaaccaagatttgaactcagacctgtctcattccacaactcattttccttgaagtcaatagatgccactgatctctaaatacctacaaaaggggctcggaggtggagaggggatgtctgaggagccttaggactaccacccaatgttctgtctttagatagagatgctatcaccaatctctctttcacacatactcctcctcttctcatttctgttcgtgtacttggttctcagtgtaagattttgttagaagaaagaggcatgttggtaaaataagaaataatatatcaaaaataaaataaaattgtttgaaa

SEQ ID NO: 249913 - DNA, 461 bp, Homo sapiens
gctgccaactcccatctggctgcctgttgtcagcagccttgagtacatgcatcttgtctcatttctcctgtctcctcattagcactaagcctcatgacctcagctgtctggtaagtgttgtggaagcccttgcaatctagcttagacataaaaagggagtacatctgggcaccgtgagggacagaaaccaggaactggaaccaaaaaccggagactttattggagggaaggattgggaggtgggagaaggggggacacttgatcttctgtaaaggaagagtcccaaacccctcagcctggcactcaaagcctgccctggccgtgtggtttcctaccttaccaacagcacctcttgaacgtttctcctcaaaaacaccatgaacattcatgcttctttttcctcatatcattcaaaaaatatgattttaaattataaggggccttatgaaataaaaatgtct

SEQ ID NO: 249914 - DNA, 391 bp, Homo sapiens
gaataactggggttacagatgcccaccaccatgcccagctaatttatttttttttgtatttttagtagagacagggtttcaccatgttggccaggctgacctcgaactcctgacctcaagtgatccgtccgcctcagcctcccaaagttctaggattacaggcatgagccaccgtgtgcagccgtctcctactatccctttaaatgccactggatacaaacaaaggcagtcccttgacttttctggtcactttaagacacaaacacagtctcaattcagagataattagaacatacggtcctagattaatcccagctttattcagaggagcagcccctcacacagccaccgcttgctgcagagcgacgcctaggacagtgaagaggatttg

SEQ ID NO: 249915 - DNA, 529 bp, Homo sapiens
caaagagagtgggggtggggaggtgccacacccttttaaatgaccaagaactcacacactatcacgaagacagcaccaagccatgagagatccacccccaggatccaaacgctttcaaccatcccctgccttcagcactggggattgtaatccaacatgagatttgggtggagacaaataccaaaactgtatcaaactgagaactttggagccagggaaaggagagagcttaccattgctgagagacagaaagatatctatctatctatcgatagatagaaagatatctatctatcgatagagagatagatagatagacagatagatacatagatacaaactatatatatgtcaaccatatatatatcaactatatatatatctttatatatatatagagggagagagagaagaaacataaatatttgagcaagtttttctcatagatgtgtcattactaaacttttattccttggttaggaaatggagctgatccataatgcacagttgagattctaaatttcatgtt

SEQ ID NO: 249916 - DNA, 710 bp, Homo sapiens
tgtggcccaggctggtgtaccgtggggaattatagatcacagcagcctcaaacacctaggctcaaacaatcctctccactattttttttttaatctttcgtagagacagggtctcactatgttgcccaggctggtctgaaattcctgagctcaagtgatccttctacttcggcctccccaagtgctgggattacaggaatgaaacatcgtgcccagcctgtaatttgcctattgattatagcatttcaagtggttgtttctgcttttcttttatactattctgttgatttttttttctataataattatgtttcatcttaatgatcaggagaaataaaataagccgatggaaaacgcaagagaaaataataggaagggaaaccattaatgtaatgaggaagaaaaggatgtttcccctgctccatggaactggggatggggtaggtggttacagggaaggattgaaaccagagacttacaggattcagaggatgggcaaatgcatgctgccagagtagcattcggtgacaatgcctgacccaaatttcctccctcttttcaagattagctggatttactgttaggtttccgtctccctgacaactcttaaaaaatcttgacctgagtccatggaattttaagtctgatttggttccatcatattcagcctccaattgaatcctacctggtcctagaaacttcatacactg

SEQ ID NO: 249917 - DNA, 568 bp, Homo sapiens
tgtggcccaggctggtgtaccgtggggaattatagatcacagcagcctcaaacacctaggctcaaacaatcctctccactattttttttttaatctttcgtagagacagggtctcactatgttgcccaggctggtctgaaattcctgagctcaagtgatccttctacttcggcctccccaagtgctgggattacaggaatgaaacatcgtgcccagcctgtaatttgcctattgattatagcatttcaagtggttgtttctgcttttcttttatactattctgttgatttttttttctataataattatgtttcatcttaatgatcaggagaaataaaataagccgatggaaaacgcaagagaaaataataggaagggaaaccattaatgtaatgaggaagaaaaggatgtttcccctgctccatggaactggggatggggtaggtggttacagggaaggattgaaaccagagacttacaggattcagaggatgggcaaatgcatgctgccagagtagcattcggtgacatggcacaccttactggacgtgagactcctctagaacgc

SEQ ID NO: 249918 - DNA, 763 bp, Homo sapiens
ggccgtcgctaagacagtgacggacgggaaattagataagccaacacagcaattacaagaatgatgtcatgatcagaaaagaggcttatgtacataaaagtatgatggaggaactgaagagtataattgatgacagtgaaattaccaaagaggatgatgcgttatggcctcctcccaaccgagagggccggcaggagcttgaaatcattattggagatgaacacatttcttttacaacatcaaaaattggttcccttattgatgtcagtcaatccaaggatccagaaggcttatgagtattttattatcctgtccaggaccctgaagtgtttggtcttcagtcttactggattacacttcaagattaaaccaatctaaactgaatattgatgtggacatgggggggtgggagtagtttttaattaccattatcaagaacattttgtgtcagggcagtatatttttataaactatatatgattatctttaataaatatgtgataaaatttaaaaaaagcaaaacaaaacttctagagaataccttcaaaaccttggtgagggaaattcttaaacagcacaaaaatcattaggcaaagatcaactttaacattgtcaaattaatcaatgacttctcttcctcaaaagacatcaaatgggacaaggtatttgtaacacatataaacaaggatttatatttagcatatatataaataatttctataaatcaatgttatatttcaataaaacaactgagatgagaaca

SEQ ID NO: 249919 - DNA, 1181 bp, Homo sapiens
ttatctgtcccagggatccgttgattgccaggtatggctttgtggtaattctagcatttgcaacccagcaatttgagccttctgtctgcctaaatgatgattttacattgtaatggttgtactaaatcctttcgcttttgctccatagccgctgttgtgacaagaaaagctgtggcaaccgaaatgagactcctcagatccagtgataattgacaggtagggaccactcttctttcactggattcttattcctcattataatgaaacacctgcccttgtgttgctcatgggcgagggttaggaatgcatgtggctgaaatttgcctgttggtcatgacttacgctgtgctgagcgattttgattcctgggaaagccatatggaatgttcttttagaggcctgttccttggattgctccggtttttgtctgattcatgctcctaaaggaatatattttttctttcctgactttctgtggctcaatcctcatgctgtgccaggaagcttcagaaataaaataataatagtttgtgatttatgaaatgtggttgggtgcttataaatatttaacttttatttgaaaaatgtttgaatcattatcacttttagctacagtagttctgttggacgtaatccatctacactttaaggttttatttatgcataaaagcagtttaaagagatctgtgaaccaagattttctactgttatttgccggatttgattgcagtatgagaccatattgtaagttgattaatttatcctgcttgtcttaatttttgtgtttttaaacagatccatattactaatctgacatgaccaagtaaatcaccgtagaacaataaatctgttttagttgttcggtgtaattttgagtcagtgtgcacgcattatgcaaagtcgcattccaaatattcattttacattttaattattgaaattcattgtatggaaacatgtatgataaaccatttgttacatagcattactcattgagagttaaatggcctggaaggtttatagatactgtcaattgtcagctaggaaaagagctagcatcttgtactagctggaaaaagagtcttgccaataagactgaccgatccctcattgaggaaaccaatggttgaacacaagtccctttttgggtttcagcaatattgatttttgacaacaacaac

SEQ ID NO: 249920 - DNA, 424 bp, Homo sapiens
agtattatatttctttgacatgtgaagcataaaatgtgaccattaactcttctcaaatgtgagctccatgtggtgaaggaccacatatcatatgtaagcaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaacttca

SEQ ID NO: 249921 - DNA, 705 bp, Homo sapiens
cctagctgtcacagaatgatagcacgcctggcagaggcccctgttgctggtagagagctgtctcccttctttccttctcctctcctcccttctccccttttttcctgcctcttctttgtggagtgttcaatgtagtctgcggggagtgggtgtgaataacgtccaaggtattgtccagagatcagcgttcttgtccacgtcctggtgaaccagtggatgcctgctgttggtgtatatgtaagggtagaattgctgggacataggatatgtgtaatatttagctttggtagttactagaaaacagtttccaaagtggttgtgctgttttgcggtcccactagtagtgtatgagagttccagttgctccacatccttgccaacactgggtattttctgtcttttcaaattttagccatttttgtgagtatggagtaataacttgttctaagtttactttgcatttctctgataagcagtgacgttgaatgccttgttataagtgtatcacccattttaatgtgctcatttgtgatgtgctaggttagttatccattgctacatattacattaccacaaacagcagcttaagaacaaacattaggaatttggcacagttaagctgggtgcctctggctcaaggactctcaggagtatgcagttcagctgtcaatagggtttgcccaggtctatcctggatttagcagt

SEQ ID NO: 249922 - DNA, 501 bp, Homo sapiens
tggtgactatcagtcctaaacatttagtccaggtgtgtgaaagcgaaactgtgccccaaacagttaaagacaccaatgactaacagaaattcttgagtttgcaggatggtaggtaagcaaagaaacaacttgctgagatgctgaaagtccctccacttgtaagacaacaaagctggctaaaataggttggaaccaatgtggccaactagagtctgtgcagtacctgcttgctgacatcacagcctgaatttccactgcgtgtttcatactcactccccccgtacctgcccatgtgatctatgaggtgtcatgaagagaactgcgcatgctggaggactttccaggcctcctctttccttccactaatcacctgctaatctcagaatcccgacaccttttctaataaaaacactgccttagcaccagcccagggagacagattcaagctggactcctgtctccgtgtcggccggcctataattacaagcttttcttttctca

SEQ ID NO: 249923 - DNA, 335 bp, Homo sapiens
ggctggtgggtgcgagcaccacagtgggagaggccacgcaattgccactcgagctgtttttaagttggctcacatgggctggggggtgcgggctgagctgcttctcattgtctttttccaatctgctgggggagaggagcctcatgtttcctgcctgccatggggtgtgtggtcctttgagttctcagtcaccgccccattgtcaccaagaaccaagctcagccagggacagtaatcccagcactctggaagcccgaggtgggaagactgcttgagtccagcagtttgatgtcagcctggacaacctagggagccctccatctctaccaaaaaaa

SEQ ID NO: 249924 - DNA, 463 bp, Homo sapiens
aatgtaagctcgctggtctcaggggccatgttttttgtttcctgctctatccctagcccctaacaacagtgcctttcacataaagagcgtttaaaatacttattgaatgaatacataaataatctcttacctggactacttcaatggcctcctgattctgcctttttctcatgcctccccatgagacacagactcagggaaatttgaatgctcttccagttgacatgtcaagaacaaaatcaaggactcgtgagaagagtgggacctccaaggccacctgtggagccaaaagaattgggactgtctgctgtagtgaccagatatggtcaggggatctggcttctagtgccagctctgctgcctgctgtgtgatctggaacaactcacttcacatctctgggaggctgctgcttctgtaaagtggtgacattaacatctcaatgacataggaaatttctaagaa

SEQ ID NO: 249925 - DNA, 333 bp, Homo sapiens
tttttttttgagggggggctcatcagctattgctagtattagtatatttcatgtgtggcccaagacaattcttcttccaatgtggcccagggaagccaaaagattggacagctctgatctagatccaccaaagaagaaaacaattacttctggtgccttctgtaagttttcattaactgaactcctactgcaggaagaaagactgcagtatgtcaacacacctagacagacttttgtcacaaaccactgtctgccctgcagatccaacagactttatctcaggccactgtatgttcttcaagtccattgaattcccctaaaaatcatttccat

SEQ ID NO: 249926 - DNA, 452 bp, Homo sapiens
atatatcttcattgagtttttaagttcacttcttaaccccaaaacataaaaaaaaaacctgaaacccagtacattggtcaataaatatttattattgaataaatattgctaccatcagattctcctctctccatatttattccaaattgattcctttgaatccttaaggaaactatgtggataaaggattgcacacactaagctgtcaggtttttctaagggctgtgctgtcctatacccacttcatagtcaaaagataaggtcgccttagaagtctgaggggaaaaaaatgtggattcagggtgaaaccctgaggcacagtaggtccagatggccttaactttgaagagaacaaagttacaccaaactgcctcttcttgctttctcccctctccccacaaaaaaaggtagaaattgctgcctccctatgaactgagacactgatctttaaa

SEQ ID NO: 249927 - DNA, 462 bp, Homo sapiens
gacaaatcaggtccccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccaaggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaa

SEQ ID NO: 249928 - DNA, 297 bp, Homo sapiens
ccctccctgcaatcaaggacaacagccagtcaaattccctatcatacagggaagaatttaccagaggaaaactagctggtcatcgagcacttttcaaagattgcagttttatggactggcagcaagtgttaacacggtcagaggagccacgtgtcatctagcatcagaagaacctttattttcactgtcgccttgacaacatgtagtatacagcctgagtcaataaaatctaccattttgttatcacttatccacctttaaccggaaaataaaccaatccgtggtaactagaaatat

SEQ ID NO: 249929 - DNA, 462 bp, Homo sapiens
cagactgcagttactatgatgtaactgcatgtaacttggataggaacttgcagtcttactgtttgaggaatgagagaactgagatcagggtgaatagcaactgaaaaatgaaggaggttatcccagaaaagagagaaccacagagaagatgccctgattctgtatataaaccctactgaaatctctggctgactatgcatgcacagaatggactcttaagcacctcaactaaggctaaaataactgaatggagaattcagctgttgcccaatgcaagggagatagaatttggtattttggttttagacgagttaattgcctgctaaaatgaaaaatcagtactctttagaggaatgaaacagaattcggaatctctacaatatatcatttgtcacgtttagaattcaatcctaagctattagacatgaaaaaaaacaaacaggaaaatgtgactcataactc

SEQ ID NO: 249930 - DNA, 295 bp, Homo sapiens
gccatgtgccaccaggcctggctaatttttaaatttttttgtacagacaggctctattctttatatctacttataattacacacattgctaatacatgaatttatttacactgaaacaaattcaaatgtaaaataaggtcaaatccttcctgaccacaacccaatcctatggccctccctggaggtaactcctgttatcagttgggtgtatccccattcagcccacataaatgcatttctgtacaaatatgcatgtcatatgtgtgtggatagaataaatggaagagaaccaact

SEQ ID NO: 249931 - DNA, 714 bp, Homo sapiens
ggctgcccgggcggtcgcggacatcatctttaggctgtggatgccttggccggggtctccagacgctgaccctccagggttggaaactactgcctgcttgccacgtcgtgccgccaattgtgctgcccgaagtagcagcctgagagcccttgaaagttgcagttatcttgtgaacagcatatttacggtctcttgggcttggtggtggttgggggagggctgttaatgctttaatttgttcaatgaaacatttaaaatgccccacaatttttataaccctgtttgcctctttttgtttttatttttattgtattttggaaaaattcactgggatccttgagtgatgatcctagcgtctcctgacccttaggtgtttcacctgaaaagcctgggtcttcaagctgaggcatttctgttctagcctggaggcgcctaggagccctgggagactttttaagcagagagatttggcatttagatctctgggttttagaggagtgggaacgcacctaaaagtggggttgccagttacaaagctgttgcagtcctgaagagacccagagtttaggtccaaaattttatttattcaacaaacactttataaagcacttactgtgtgccaggcactgttcttagcgttttgcaaaccttaactcatttaattctcctaacaaccctatgaggttggaacaattaacctaatttacagtgaag

SEQ ID NO: 249932 - DNA, 1848 bp, Homo sapiens
ggcagaaagaattcagaccagttattagttgctaaacaatttgttgttgaatgaaaagcaaaatcctggaaaaaaacaacttagagtattagggtctaacagcctgaaagtcattgtaaacttgacttgtttttctgcccctgaaattaagttagatgaattaaaacaaaaggcaaaggcagttatttaaaaaacttgtttttgctattgcatatttatttcatataacctcagatttattttgatttccatttcttggtgcctggcaccagaatttgtgcagatctatttcaaaaccacacattgtaaaatcaacactattgacagttatgggtaattgaatggcaaatggggtttccaactgggtgctccaactgggactcttaaacaaggcttgacaaattctgctttgtcaggtgtcataaaatatggttcagaacgcatctgtagtgtcaagggaaaatcacttatgccattccctgtattaccacttctgactcttgtccgtcctgaagtaggaattcacatggcttatgatggagtctttgttttaggaaacacgacacaaacgctaagactcttcagatatcatcactgaatctttaagttcaatccagttgctagatttggcctgtaacatttggctcagggattcctggtggccaaaggaaaacatcacaagagtcacattatctgtaagataggaacagactagttgttttaaagaaaacttctcttaaaactcaaagcagaaagatgtcagaatgggatttaagtaatttctgccttcagcctagggaattggcttgtatggcagttttttccgctccttttgtggtatctatatagagataggatatatgactcacttggcaaaggtcaggagtctgaacatttgggtaatgagtaccttgtcctaggaagataaactgagcacagtgtccctaggacttgcacgatcgaagaatccccttggttggggcttggacctttgccagctcatctgcaaaatcttttaagttgtcctgatcagccaaagctgctatcacctgaatcttggttgtttttactattaataatatagaaatattttgccaagaaaatcttttgtctttttgtgggacaggtttcagaaatggtccacagtctctgtagatacctctagtaattggtcgcagaactcattgcctttaatcagccctggggatcagtgggtgacagatcagtgcctttatgaaatggagttactaggaatggtgtgtcattgcctgacgtgcctccttatctgccataatggagttccttatatatttcctgcttgtcttgtatgcctttggatctagtaaggaaataaggagaggttgagaaaatacagagtaaagctttagcaggtatcttcccgttaagtgacaggcagtgatttgtgcttctttggtttttatcatcggtctaatgtgagtcattcttgtgcgtcagggttggatctttttgcctttcccttctcttctcctgttgacttgacctggtttctttagtctgagaaattggacgtatttttctttctttgaggaaagggctagtggataaagccctcccatagagagtgtaacgtgggtaatatttgggtgccctttcagggttaggtcccactttgttcaaggaatgctgtatgcatgggtagattattaataagatggtggccccagtaaatgttggtgtatgtgtgagacttggtgggaagagctgcttgctgtaaatagtggctcctctgctcagcagttttgtgaagtcagttgacttattctttaatttcatcccaccacccaacataaattttttggttcattc

SEQ ID NO: 249933 - DNA, 301 bp, Homo sapiens
cgtacgtgtttctgagcgcttggtggaaagatttaaatggggggaagagaagatgaaaagcaggaaagagttggcaaatactaaccaaccgataaaggaagagaaaggaggactgtacataacagaaattatcatcagctggtgaggaaagtggactctaccatatttaatccccaagtcgacgggcacttattcaaggcccggatgtttaatcgtttttaattttctctacaacttgtgagataaatcttaacattctcatttggctcagacattaaattcggaactggttagctctctt

SEQ ID NO: 249934 - DNA, 86 bp, Homo sapiens
acacacacacacacacacactcacactcacacatacccacacaggagagctgtgttttcataaaaattcatggcaatgtgtttaga

SEQ ID NO: 249935 - DNA, 321 bp, Homo sapiens
cattgaaaaatgaataaaatataaagaagaaaatgaatggctgtgtgctcacgtagaatattgcctagcacacagcgaaataatagttgttagtgttatttattttaagtatctgtttacttttctcatatatgtgttttttccaaaactggaatcatactttaagtagagttctattatctctgtttttgtatatatttatttgttttacatacatatgtatttatatatatataaaatgttaaattttaaaaacagatacatgtatctgtttttacagattttttaaacaaatttaacattttcttggcatatttacat

SEQ ID NO: 249936 - DNA, 623 bp, Homo sapiens
caataaaatgaaatgctacgtaacttttacaaataatattagttatctattattgcataacaaattatttaatacttaaaacagcaaacattatctcacccagtttctgagggtgaggaatctggaagaagctaagctgtctcaaggtgtctcatgaagttgcagtgaagctgtcagcagggactgtagtcatctgaaagctgcaccgtggttggaggatccacttctaagatagtttactcacatggctgttggcaagatgtctcatttctcaacgaaagcagaaggtcccagttcctcaccacagggctgcctaggttttctcatgacatgacatatagcttttcccagagctagtgatcccagagagagagcaagaaagaagctgcagtgacttttatgaccccgcctccaaagttgcatgccactacttccttatccactttatttcctattcatcagaagttactcaccaagttcagcctatattcaaggggtggggaattaggcttcacttcttgaatggaaaggatcaaataatttgtgggcatgtttcaaaattatcacaaataagacaggtctacctgtactgaagtgggaagttgtacactatgtattaaatg

SEQ ID NO: 249937 - DNA, 737 bp, Homo sapiens
tgtgtgtttgtgtgtgtttccatatatgtgtgtgtgtgtgtgtgtatatatatatatatgctggaactttgagcaatatttataaaaatattgtctgtaaaacaagtttgagaaattaattttttatatttataatgggcactgtaatggattgatttttttcttaatcttgaaatagtgaccaagatatttatatcatttttgaatttattttttaattctttaagaaaatttagaacttttcactttcatttgctaaagtcactgtagtcacattcggaaggaatatgtggctttctgttctttatggactacgtttatcagaagtccatatttattaaacatcctatttgatgtcagataacgtaaactcaagcagcttcaaagagttcagcatgttacatattattgagagagcaagtgactgaattttagttgtataagcaatattataggtaggtcagggagtcctctggatggcccctctacctctttatgtttgtatgtttatgtctttatttgttatgtcgtatgtgtttatgagcctagaaaataagtgtcccatatgtaaagtttaataattttgtaatacatttaccacgctgtctgccctattaaaattttccacaaatttgggaactaagaatgccaaattctcaagattttttggtgaatcactctcaatataatagccacttaagaaaaataaataaataaatattggaaggccattggaa

SEQ ID NO: 249938 - DNA, 684 bp, Homo sapiens
cgggggaaaaaagaagaagctgaactgtgagccatataaaaataaggtcggtaaaccacgaagagaatttttatatttataatgggcactgtaatggattgatttttttcttaatcttgaaatagtgaccaagatatttatatcatttttgaatttattttttaattctttaagaaaatttagaacttttcactttcatttgctaaagtcactgtagtcacattcggaaggaatatgtggctttctgttctttatggactacgtttatcagaagtccatatttattaaacatcctatttgatgtcagataacgtaaactcaagcagcttcaaagagttcagcatgttacatattattgagagagcaagtgactgaattttagttgtataagcaatattataggtaggtcagggagtcctctggatggcccctctacctctttatgtttgtatgtttatgtctttatttgttatgtcgtatgtgtttatgagcctagaaaataagtgtcccatatgtaaagtttaataattttgtaatacatttaccacgctgtctgccctattaaaattttccacaaatttgggaactaagaatgccaaattctcaagattttttggtgaatcactctcaatataatagccacttaagaaaaataaataaataaatattggaaggccattggaa

SEQ ID NO: 249939 - DNA, 259 bp, Homo sapiens
ccttccttcctttttctttctctttcttctctctttctcttttttctttctccttccttgcttttcttctttttcttccttttttccttccttcctttcttctttctttctttttccttttctttctcctttccttacctttcccctttcctttcccatgccctacctggtttcatactcacatcagcccaatcaggcgggtggtgccatgtcctcccccttcccctcccccgcctcctttccccctccctctcccctc

SEQ ID NO: 249940 - DNA, 471 bp, Homo sapiens
ggggagacctcataatcatggtggaaggcaaaggagaagcaaaggcatgtcttggcgggaggcaagagagcttgtgcaggggaactcccatttataaaaccatcacatctcctgagacttattcactacacgagaacagtatgggggaaccacccccgtgattcagttatctccacctggccctgccctagacacatagggattattacaattcaaggtgagatttgggtggggacacagccaaaccatatcaggtatattgacatcatgtaactctttatacaaagcacaacgtaacttttgtggaagtattgtcaaaaaattccacattagattgtataacctcaatctaatctagagaaaacaccaaacaagcccaaattaagaggtattctacagaataactgtgtcagggtcagaagagacaaagaaagaatgaggaatggaggagactaagggttggaggagacc

SEQ ID NO: 249941 - DNA, 144 bp, Homo sapiens
gagaatggtggtcgtatggagcacaggggaggagtccctgcgggtgctggctttcctggtcctcagcagagtctgccggcacaagaaggacactttccttggccccgtcctcaagcaaatgtacatcatgtatgtgaggaactg

SEQ ID NO: 249942 - DNA, 437 bp, Homo sapiens
agaagttgatagttactccagttgctttcgtgggtgatttcacattgaggctaagtgctgaatgagagaatacaagctgagagaattaaaatctgggtatcagtgcttttaagacaaaccttgttctttttatggcacttactttgtctgaaattttaaatgtctttctagaccgtgctgacacacatggaaatatccataataacattatcaaattattttattttgagattttattagaaacttctaattgtctagagaactttctactccacagacaaattaatatgctcaacatttctgaaaagacagggcaacagtgccgttctaatttttacaagaaggaatctgaggccaggttcccttagaagccaatttacattgacagtttaaagaagtggacatacaaacatatataggaccagaattaggaaaaa

SEQ ID NO: 249943 - DNA, 753 bp, Homo sapiens
gccagtttgattattttttacaaaaatcagtaataagcagccatcattagtgttaagggtgtcagaatatgaaatggaggacctgcgttcaagttgtaattttttcattaactagatgcgtgatttggaaaagttgcttaaattatctgaaatgtaatttccttatctgcaaagtgaatatgaccagaaagactgcgaggagagaatgagataatactaaggctttgaaggtataggtatcatatattaataataaggtgctaaaaacataatttaagactaaaggaaaatgtacatacaggtcccttaaccacagccatgttgtattaatattctctgctactaattagacattgcacccctcaaaggaatggtttatttctcgctgttcaatcacatcaagtgttgccatgattcttgtctcagaccccaggccccaggtattctgaactgtcacttggatttatcgaggcagcccactattattgttggatttcagtagtcatggaaattaaaagttgtcctgtttattgtggcagctggtaaacagatagcaccttttacatcatagctcttggtacttgggaattgccagagaataaaataaaagttaaaaaattcaataacatagttctctgcactatcttaacagcaagccaccagtgaagggtccaggaagccacttacatcacaacagacatccctgagcgaattggtataaaagtagctacagtcttgatagctcagctgctg

SEQ ID NO: 249944 - DNA, 476 bp, Homo sapiens
ccctattcttcatttttgtctagcaatatttgaaagcctatgacattctctgcagtatattaaatagccagtgaaaagcaaggatgaatggaatgttccaaagttatccagcaaattcatcctaagaaaataaacagtttaaataattcaagtaaagaaacattccattgccactcttttttctcattaacaagtttattttgactgcattattctaacacctattgtatcagggtcagaatatatgaaaatatactgtactgatttatatttttactataaataataaaatgtaatataaagtttgttttcctgtgttgggaaactcattttgggagttattttaatgaatgatgtactcttacatcctcttaatttagaaaccaaacaagtacaatcacctcagaagttgtgtcaatatgtttgttttaaagttaaaaaaacaaaaactttgttaagctatgcttgttttaaaa

SEQ ID NO: 249945 - DNA, 742 bp, Homo sapiens
tctgaatatgatgtcttgtttattgccagccaggcacccatggtatatcaatgctgaccagagtccactgagccttagaagtaacgatattttaattaataatgatattatggcaataatacttctatcgttcatacactgaaggtgataatattccaaatatgacaacttttcaaagacagaaggttataaccagatctggaatttccatagattttttttaagtttttttttttaaacatctacagatttaagatgacttgaattaatcaaatataattctgggcttcattgcaatgccactgtcaagaaacccattaccctaataattgtaaaaacggaagaatttcttacaaagaaattctttctctttaacataaattcttccagccttgataactcaaacttcttggggaagatgataaattggatagtcattctaaacaactgctgcaacaggatattgtggcaaaaagaaaagacaaagtatagttatcctcttttgatgatgtttactttcctgagagcctgtaatcagaagggtccagtggtctcaatggtgactagatttaaatgttcacttcttcactgttgtgataagaacttggagaacttgaaaggtatttcatatttttgttatttctcctcctggttatatattcctttcaatgaaatgtggaaattacagatgataaatttgtagaattagatgaagtagagaaaaaggtagaaagttagtcct

SEQ ID NO: 249946 - DNA, 1578 bp, Homo sapiens
  misc_feature (94)..(94): n is a, c, g, or t
  misc_feature (99)..(99): n is a, c, g, or t
  misc_feature (108)..(108): n is a, c, g, or t
  misc_feature (259)..(259): n is a, c, g, or t
  misc_feature (1123)..(1123): n is a, c, g, or t
ttctcctatctttggtgtctctcatcctatgttccttgctatgtgaatagattctctgtttcttattttaatgctcagtgtgtattcttttatnattanaaactctanaaggctaatccttccctccttaaaactggaagaattatagaaggagctatgggcacactgacacagaggcatgatggtgaggtgtctttgggaactcagactgaagggacctcagttctctccactggccactgagggaaaagtttctcanacaataccttgaagttttgactcttcatatcagctgagcatttatctgcaatggcttccctcttctttgagccaccttaacacattactctccacacattcacggctatctccttttcttcaatggggaaatcacatctggcttagagataaaaggtcctgtatataggaaaagaaattggacttaggcctgttgtggtgatgtcaattcagggagaggaaaatatgagacagaggaagataaagtcactttaggtgtcaagaaaatgaagcctgtctctactaaaaatacaaaaaattagctgggcgtggtggagggcacctgtagtcccagctactcgggaggctgagggaggagaatggcgtgaacccgggaggtggagcttgcagtgagccaagatggtgccgctgctccccagcttgggcggcagagtgagactccgtctcaaaaaaaaaaaataataataataataataataaaataataaaaaaaaaacccatgcaaccgccattacagacatagaaactttccaacatcccagaaggctccctcatatctcttcccaatcattatacctcaaagttaaccattagtttgacctctataatagaatagtttggtttggttttgaacttcatataggtggaatcatatagtatgtactcttgtgtctgacctcctttgctcaacattatttctaagtatatagatacatatagataacattatatccatgttgctgtacatagtagtagcttgtaatttaaccttttttttttttttttttgagacggggtctcattctgtactccaggctggagtgacagtgacactatcatagctcactgccacctcaaactcctngactcaaacaatcctcccacctcagcctcagctccccaagtagctaggactacaggtgcataccaccaccacacccagacaatttaaaaaatttatagagatggggtctcactatgttccccgggctgatcttgaattcctggcctcaagtgatccccctgtctctcagcctctgaaagtgctgggatgacaagtgtgagccatagcacccaccctttatcatgtaattattttgttacttccctcttgttcactctctctacatatatctggttgtatgtcttaagtcttatactactagaaattaggagttaggttgatcagtatatacaaagtttcagttatatgagaggaataagttttggtgttctgttgtgtaacatgatgactatagttaataatattaaacatatgaactgggggggaacaaatcagtctataacaattcccaatta

SEQ ID NO: 249947 - DNA, 1443 bp, Homo sapiens
  misc_feature (988)..(988): n is a, c, g, or t
atccagtagaaattatatttatttaaatgaattacccatgcacaggtttcattcagtgtaataaaatatgggcttcagaaacaaaaaccagaactgaaagaaaattggttttgtaggtagaaaaatgtgatttaaaaatgcagatatgccatttattttgagggtgtatagctcacccctgtaatcccagcactttcggaggctgagacgggtggaacacttgagcccaggagtttgagaccagcctgggcaatatggtgaaaccccgtatctactaaaaatacaaaaaattagctgggtgtggtggtgcacctgtaatcccagcactttgggaggctgacatgggcggatcacgaggtcaggagattgagaccatcctggctaacatggtgaaacctgtctctactaaaaatacaaaaaattagctgggcgtggtggagggcacctgtagtcccagctactcgggaggctgagggaggagaatggcgtgaacccgggaggtggagcttgcagtgagccaagatggtgccgctgctccccagcttgggcggcagagtgagactccgtctcaaaaaaaaaaaataataataataataataataaaataataaaaaaaaaacccatgcaaccgccattacagacatagaaactttccaacatcccagaaggctccctcatatctcttcccaatcattatacctcaaagttaaccattagtttgacctctataatagaatagtttggtttggttttgaacttcatataggtggaatcatatagtatgtactcttgtgtctgacctcctttgctcaacattatttctaagtatatagatacatatagataacattatatccatgttgctgtacatagtagtagcttgtaatttaaccttttttttttttttttttgagacggggtctcattctgtactccaggctggagtgacagtgacactatcatagctcactgccacctcaaactcctngactcaaacaatcctcccacctcagcctcagctccccaagtagctaggactacaggtgcataccaccaccacacccagacaatttaaaaaatttatagagatggggtctcactatgttccccgggctgatcttgaattcctggcctcaagtgatccccctgtctctcagcctctgaaagtgctgggatgacaagtgtgagccatagcacccaccctttatcatgtaattattttgttacttccctcttgttcactctctctacatatatctggttgtatgtcttaagtcttatactactagaaattaggagttaggttgatcagtatatacaaagtttcagttatatgagaggaataagttttggtgttctgttgtgtaacatgatgactatagttaataatattaaacatatgaactgggggggaacaaatcagtctataacaattcccaatta

SEQ ID NO: 249948 - DNA, 882 bp, Homo sapiens
  misc_feature (211)..(211): n is a, c, g, or t
cgggtttccgaaaaccaacgtggagagaaccgcagagcttaaataaaaccgtgtatgcacccaaaaaatctccggccaattacccttaaacgaagctcaggaaatccaaataaaagaggtgtaaaatctaagggaaaaaaataggggggacccgaatttccggagcacgattgtgccacgaaagactggaattaggccacgcgcggtggcntcaaccgtgcggggccactgtgggaggctgaggttggcggaactcaataggtcacgaggattgagaccatcccgctaatatgcgaaccccatctctactaaaaaacaagaaattagctgggcatggtggcaagtgcgccgtagtcccactgctcgggaggctgaggcaggagaatcgtttgaacctggagtggaggttgcagtgaactgagattgtggccccgcactctagcctgggcgacagagcgagactccttctccaaaaatagaaaaaaaaaaaagaacttgacatttaatctttgtagcactctgaaaaaaattgttgtggtatatttttaataaagatgctgatttgctgattgtcagtattcacttcccacacattggctagtaagtagtaatgctgaaaaagtctttctaacttaaaagctctaccttatctacagttagtgggtgagtaatacttaagtatacattaaaaatatttctttctgtatgtgggtaaacctggtaatttcatttaaatattcagtatatggagattccctttaaattactcacttcactgagataatgtgggtagtttgaaatgtaaggataaaatttttcctgtttcaatgcatgagtctgtaatgtcccatcataatttgtattggtttatttttaggtaaa

SEQ ID NO: 249949 - DNA, 431 bp, Homo sapiens
tgaatgctggtatcactgtggtgtataaaaatggtcctcattttccagtcctttcttttaaagatgtccttatgtagcagagctttatgtggtgagagtagtgtttgctcccctggaaggttactatttcacaatttttgtctttctttggtatttttgcttcaaaatatcaacataactcaatagtgttgatgacaataagctgttgattttaagaagatatgaattattggatttccacttttgattgatttttccatttgtgtgtattttgtaacgtcacagctccttttatccaaggaacgttgtttcaggcaacataaggaagaaataatttccctttagaactgaggggaggtgactgctgcctctaacatatacttaggaactcctatttttcatctccactagccctggtttgagattttttt

SEQ ID NO: 249950 - DNA, 449 bp, Homo sapiens
ggtagcatacacttttgatctttcacagtcaaagtggctttcggggcatctgctcttttgatgggaccctttaggtaaattctcagtacccgggcctgctttctgcagaaggaagcgttgccaggattattctagcataaagaaggtggtgagctccctgtgtttagggctgtgcaaggagaggctagggctccagcctggccccaaagagcagttaaattcggttgacaaaggggctgcctgctaggggtgggagagctgcactaaatgattttctctcggtgtggcctagttaagagggagccatgaggccacaatgctcagagctgtcccagggacaccagggacacctggtgctgggtctcagggtcaccaggagctctggggattgtgaagaggagagaggcagacccaggagcccagctgggcgctaataaataagggcactg

SEQ ID NO: 249951 - DNA, 337 bp, Homo sapiens
acactgtgtctgatattctcatctgccttggaggaaggcgagcacgtggcaatccgcaggaagtcctgcgcattatccatccctggacctctcatctacttcctgatagggattccagaaggttctgcatttggaaaagggcgggagagcagcatggctccgagccagggactgtgatggctctgactaaagaggcttgaggaagatcctggggcttcaaccccccagttccatgcagagaccacaccaatgaagcattcattactcccagcttttccagacacaagccattcttgtactgctattaaatcccaggttggggagtgaccttgacgtt

SEQ ID NO: 249952 - DNA, 280 bp, Homo sapiens
ctgcgctgtccgaagaaaccttggtccctgaagtcttattgattggtgcaggtcactgatttttttaatgaactcctgttcaatacagaatatgagtggccatctattgattcaagttcaatttcaagggatcccgtctttgcagagaaaggcccttctaaatgtttcctgttttcctttttttagtttggctttttttttttttttttttgcttttgcttcattctgtgctgtttgcttgtagttgaataaaaatagaaacctgaatgaaaaaaaaaaa

SEQ ID NO: 249953 - DNA, 622 bp, Homo sapiens
cgtgaagcacctgcaagctgagcaatctcaatgaccgtcagcagccactagacaaggagagacgcatgggacggtttctccctcagagcctccagaagggactgatcagccacaaccccttgacttcagacctctcgtctagagaataaatttatgttgctttaagccatctggtttgtggcaatgtgttagggctgccctggttatcaaatccattaggaaaggaagtttatgccatgctaaggtgtttggacttcaggccttaggtgatgcggagctgctgaacgttttgatgcaggcagataccacaatcaggtatgtttcagaaaaagaagtctggtgacagtgtaaagtagggctttcccttcagtgtgccaggaaaaaaaaagttatgagtgtctcaagtatgagccagtgtatgggatcaagttacatcttagaaacgtggttactctcagctggccgcttccagccccaagcagccacagccatttgccccggtgtactgtacaaatactatctttttactgtgtgggtcctgacatggaaaacactggaaagcattggtataggacaaatggaaagatcctggagatcacagaacagggaatttcattagtcc

SEQ ID NO: 249954 - DNA, 507 bp, Homo sapiens
aatgcaaaatagcaaggagtaattaggaagtcttattattgaccttttttttttcagaaaaaaaatgtactaaagaattgataaaaataaatattttaaagttttaattacattgacaatatgtgcctttaaaaaaaaaagggactttattattcctacttcaagaacaatattgaagcatcttcatttttggaaggactgtggatgattatgaatgacaggcttactgaatatcctcttgtaattaatacagtaaaacgcttccatctttatccagaggtgagtcataatttgagacaaataatatttgtagagtgatcctttttatcagatataaatagtaagcacaatcttgttaaaaagaaagggaggggacctttcaggtttattaattgtgtgtatccttataggtgagcagaatatcataagttcttctcttaaaatttaaagaccccagaaactgttctcgcatgaactcaaagaatgaaccttagtgtgtaaataatg

SEQ ID NO: 249955 - DNA, 363 bp, Homo sapiens
tccctgagctgaggaggtggagctggcagtctgggaaagccaagacacctagaggtagcagggcacaataccagagaggatagcactacacagagaattgtaggatatgcagagggtcccattcaagtcttcagctgagagctgatgcgcgcacgcgggcatgcgtgtttgtgtgtacaaatcaaggccagagaaaaccacctgaaaagataagagggaaccatcttcaaagttcatacagggccagttcctcttcctaccagccagagtagaaaacctcataattcagggggtatcaagtagaacactcagagatggtttgcctcggtagtggggcaaaataagccctaaactctgctcttg

SEQ ID NO: 249956 - DNA, 1567 bp, Homo sapiens
gtgaaacatgcctgtttcccctttgctttctgccatgattataagtttcctgaggccttcccagccatgcttcccgtacagccttcggaactatggaacgttagcagctggggacctttctgccaccacaaaagcctagattatcctgatggacgatggaagacacatggctgttgttccagctgacatcaagccaaccactggacaagataggaaagctctcctagaacacgaaggcccgaatgaactggcccagagcagagaaactgctcagccaaactgccaagctgtgattaacaaaggcttcatcttaatccaccagattttggggtggtttgttacacagcgaatgctaactgatacagtcattatcattaggtctttcttgagctgatcatacttcccagcatagaatacgccaatgtcctgctccttattcctggctgccagcattgtaagagctgagtggaaggctggggttttcagcactcaatatgcactagacaatccaaaagatctacaaaaactttacatctacaagccaaggcactgaatctcagccccagaaagagactgtgaccttccttcctcatcaggatcccaagaagccgtagaacaagaggctaagaggttcgaaggacactggaaaggcttcatgctgctgtaggttgtggatggacaagctttgtgtctggagctgctgtagtgggccactcagttagttcacccaggctcccacattctccatgctctgtttcaggaaacaaccagaactgtggacagtcttaccaaagacactaacatcatcaccagagaattaaagaaatccagtgagtggcccacaacaattggctggcataggacatgatcctagcttcccacagggcacttgggattgtgcagtcagaagtgattgatgtgcatatgtttccacagacctctctgatgtctatgccgtcaccaaaaatattcagactgcaaaccaggaaatgcattgaattgccaccattgtccttatacttccgtttaaggacactccaggcccaacgtctcaaggccttttaggctagcttccttcaaacctcaaatcttggttgctgtctaatttaacctttaacccttttaccatttgccctgagaacacttgccggcagcacttccagctgcagcgtttacccaaagatacctctgccaggaaagaccttgcttttattattacttttgcatttctctagcatattgacattggaaacaaaagacatcattctatatatagcattctggttttagtggtggtagttccatttacaaaatatagtaattcttgatcactgaaaatgtcagagcctagaaaacggagcattcctatgcgtgatgttaacatcattaaacagttgttggccaaagactcatgtgatgaatccaatttttctaaaataaatagctcagatgattcagatgattctgatattaggtctgtttagaaataaaacttcaaaaacagtttttatattttacttccacattgaaaatcagtcagatttgctttggcctcaaagaatgtgtt

SEQ ID NO: 249957 - DNA, 1594 bp, Homo sapiens
gtgaaacatgcctgtttcccctttgctttctgccatgattataagtttcctgaggccttcccagccatgcttcccgtacagccttcggaactgtttgaccacatgatttgctttggcagatggaacgttagcagctggggacctttctgccaccacaaaagcctagattatcctgatggacgatggaagacacatggctgttgttccagctgacatcaagccaaccactggacaagataggaaagctctcctagaacacgaaggcccgaatgaactggcccagagcagagaaactgctcagccaaactgccaagctgtgattaacaaaggcttcatcttaatccaccagattttggggtggtttgttacacagcgaatgctaactgatacagtcattatcattaggtctttcttgagctgatcatacttcccagcatagaatacgccaatgtcctgctccttattcctggctgccagcattgtaagagctgagtggaaggctggggttttcagcactcaatatgcactagacaatccaaaagatctacaaaaactttacatctacaagccaaggcactgaatctcagccccagaaagagactgtgaccttccttcctcatcaggatcccaagaagccgtagaacaagaggctaagaggttcgaaggacactggaaaggcttcatgctgctgtaggttgtggatggacaagctttgtgtctggagctgctgtagtgggccactcagttagttcacccaggctcccacattctccatgctctgtttcaggaaacaaccagaactgtggacagtcttaccaaagacactaacatcatcaccagagaattaaagaaatccagtgagtggcccacaacaattggctggcataggacatgatcctagcttcccacagggcacttgggattgtgcagtcagaagtgattgatgtgcatatgtttccacagacctctctgatgtctatgccgtcaccaaaaatattcagactgcaaaccaggaaatgcattgaattgccaccattgtccttatacttccgtttaaggacactccaggcccaacgtctcaaggccttttaggctagcttccttcaaacctcaaatcttggttgctgtctaatttaacctttaacccttttaccatttgccctgagaacacttgccggcagcacttccagctgcagcgtttacccaaagatacctctgccaggaaagaccttgcttttattattacttttgcatttctctagcatattgacattggaaacaaaagacatcattctatatatagcattctggttttagtggtggtagttccatttacaaaatatagtaattcttgatcactgaaaatgtcagagcctagaaaacggagcattcctatgcgtgatgttaacatcattaaacagttgttggccaaagactcatgtgatgaatccaatttttctaaaataaatagctcagatgattcagatgattctgatattaggtctgtttagaaataaaacttcaaaaacagtttttatattttacttccacattgaaaatcagtcagatttgctttggcctcaaagaatgtgtt

SEQ ID NO: 249958 - DNA, 529 bp, Homo sapiens
ccaggagattcaggagctcattgaggcacagacacgtgctcctggtccatgtgcagaagtaagagcactgccagcaccagcggcggagccagagccagcatgggaagaggcccctccagagagagcactggagctggagggagctccagccaaggaccagaccaacgaggagctgcctgaaatcacggaggtgccggagagcattaaaagaaggctgggaagaagagttccagcagctacgcctgctcccagaggcaacctcctcctccaggcatggatgcgggtccacagctgggcatccaggctgtttgcccctaatgtgctgcccgggacaggcccttaacaggcgggcagtgggtgaggggaccaggaggtggctccaaagggtaaagcaaacaaagcttttaacgacagccgttgtgccccaggctctccatgccaccacctgccctaccatttattaatagtgttagaattacaagttgatgaaacgagattacaataaagtttgatttctgaaacttcaaaa

SEQ ID NO: 249959 - DNA, 336 bp, Homo sapiens
gtgatggtgggcacctgtaatcccagctactcaggagctgaggcagaagaatctcttgaacctgggaggtggaggttgcagtgtgccaagatcgcgccattgcattccagcctgggcaacagagcaagtctccatttcaaacaaacaaacaaacaaacaaacaaacaaacaaaaaaaggaatgcaccaatatgggttccttagttgtaacaaatgttccatccaaagtgagatgctagcgataggggaaactgagggcagggtacacaggaactctctctactatctttgagcttttctgtagacctaaagctaatctaaaatgaaaggtttattt

SEQ ID NO: 249960 - DNA, 116 bp, Homo sapiens
cccagtaggtggaagctgtagtgagccaagatcacgccactgcactgcagcctcggtggtggtgtgggagggggtggttaaggaagccctgactgataggtgcctggcagctagat

SEQ ID NO: 249961 - DNA, 617 bp, Homo sapiens
gaaaaactggttcatgctgggagtctgtgtggttaatgatagaagatctttttagttggacaatctgcattctgatccaggctcctcctcttcttagctgaatggttttgggcacattctttaatgtctcttagcctcactaaggtcattaataaaatatgggtactcatacatgaccccattctaggaaaatggcaaccattgtcattatgtacacattcagtctctggtgacatctaccatcttctccacctcatcgaatagcactatcgtccccccaagtgcttcacccaaaactagaagccttccaggattcctttgactccttcatccctcataaccaatatgacaggaaatcatattgactctgcctcctgaaaatatctaacatttttccatttctctatatcagatgctgccatcaccctagtctaaaccaccactatcatcttcttgcctgggtttctgtgatgacttctaaacagttcttcctgatccactttatttccttcagtctattcttcacacagtatctagtcatcttttaaaaatgtaatttagatcacatctcttcctgcttgaaaccacccaatggtttcacatcatccacagaataa

SEQ ID NO: 249962 - DNA, 347 bp, Homo sapiens
cagtgcagtactagtgtaaagacagacatacagactgatggaatacaatagaaatcccagaagtaaatccttgcataaatgattaaatgatattcagtaagtatgtcaataccattcagtgaggaaagggcagtcttttcaacaaatgatattgttaaaatctgggtatccacatgcaaaaaattgaagttggagccttaccttacatagtacagaaaatgaactcctggcctcaagcaatcctcctgactcatcttcccaaatgctgggattacacacatgagccactgagcccagccagaatccaggttttcatgtgagatctcatttctaactgttggaattaa

SEQ ID NO: 249963 - DNA, 454 bp, Homo sapiens
cactcccactcgggttcatctcctttaatgttgtttacagaagtggggcaggtgtcataatttatttcctcttaagaacttgtcagagacgtaagaagctaacccactagttctgctgtttaatcttgcagatttttatgtgtttcgaatttttattatgaacagtccccccagtgctgtacccctttggcaggaagagcaagagtaagagatgttcccctatttccatcaatcagccaaatatttataagttaattagtaatgcaaggcagcatgtcagtattaggtgaaaaaaacatgtaattgtaaagaactataaaatctaagggctggctggctacggtggctcacacctgtaattccagcactttgggagcccgaggtgggtggatcacttgaggtcaggagtttgagaccagcctggccaacatggtgaaacctcttctctactaaa

SEQ ID NO: 249964 - DNA, 523 bp, Homo sapiens
gtcatcattttatgcctccctccaagatacacacatagagctgatcactccatgcaccccaaatttagcagaatgcacagactctgaagccagacacctgggttcaaatctctgaacatccactaccatctaagagaacttgaacacatcttgagccctctctgtgcctcggcgtccttagcagggaatcagggacaataataatattgcctacttcatatattaagtgaacacgtatgtataaagtgctttggtcaggtgcgatggctcacatctgtaatcccagcactttgggagaccaaggcgggtggatcacttgaggccagactggccagcatggtgaaatcccatctctacaaaaaatgcaaaacttagacgggcgtggtggcacacgcctgtaatcccagctactcaggaggcttaggcatgagaatcacttgaactgggaggcagaggttgccgtgatctgagatcgcaccgctgcactccagcctgggcgacagaatgagactcttgtctcagg

SEQ ID NO: 249965 - DNA, 430 bp, Homo sapiens
acttgcctctaagacacctaataaagatgaggaaggctccagcctgaagcgtgggtgaggtgtccagctgcccaaaggcgacagtttattctccattccatgcaaatcttgaattgagatgcaagtttatcctaaattattaggagaactgataatgggctaccaagaaaaaatacatacatgcaatatccaatttccaaactggctttgatggagtctcgctctgtcatccaggctggagtgcaatggcgccatctctgcttactgcaacctctgcttcccgggttcaagcgaatctgcttcccgagttcaagcgattctcctgcctcagcctcgtgaatattttaacacgttaatatttaagaatgtttcctcctggttgattcccactaaaatgcatgtgtccttccattaaaagagcccaagcact

SEQ ID NO: 249966 - DNA, 295 bp, Homo sapiens
acttgcctctaagacacctaataaagatgaggaaggctccagcctgaagcgtgggtgaggtgtccagctgcccaaaggcgacaggtcttacggataccaagtcccatgcctgccagcttgcacctgttaagtcatgtgatacttaggaaatgtacacatcaccccagtgcagaggcctttatccacttcccttcattttgcctggattgttgctgtgagtgagaaataaatgacatgaaatgatcatgtatatcactgtcttcagaggatggttagttccttgctctggattgtt

SEQ ID NO: 249967 - DNA, 242 bp, Homo sapiens
gtcaacaatgaatccttatttttggtggactttaaggaattatacaaatattgcctcattgatgctttcagaccatttgtgaagtgaatgagaataggtattattattattaaacccattttacagatgaggaagcggatggaagcacattcttcggggccttctttgttctctagtcctagtctgcacaaaggaagcactggatagacgctgtgtgcacattgaccgttctggcaacttgg

SEQ ID NO: 249968 - DNA, 382 bp, Homo sapiens
ttcagatggagtctcactgtgtcgcccaggctggagtgcagtggcatgatctcggctcactgcaaccgccacctcctgagttcaagcgattcttctgcctcagcctcccgagcagctgggactacaggcgcgccaccacaccaggctaatttttgtagttttcgtagagaggggtgtcaccatattggccaggctggtctcgaactcctgatgtcgtgatctgcccgcctcggcctcccaaagtgctgggattacaggtgcagccaccgtgtctggctgctccattgtaatcttacgggaccaccatgtatatgcaatccttggttgactgaaatgtccttaaggggtgcatgattgtgtaataaaataatgtgactcctta

SEQ ID NO: 249969 - DNA, 463 bp, Homo sapiens
ctctaggacccgggcgcagaaagctccagctgagccgggagcgttttgtaggccagaagcttgaggtgctcaaaaaactgaaggaccgggcgtccaagggcgcagggatctacccagagagcttccgggggccgcgcctgggacaatttgagcagcaatataaagtacattgcattaagttataacctaaagtataaaacagcccagagcccgtgctgctataaatacgtgattaaataaatgagggagaagggataatcttccttgcagaggaattctaataatacctcatccagaggggtgtggtaatccgtccacacccaccctgagtgtggcctatgcctggggacgacctttccaagagtacagtgtggaaagagggctgtagagccactccacgtgaaaatcaaagtgattagtcactgcacttgcccttgacatgtgattaaaaaaaaaaccgtga

SEQ ID NO: 249970 - DNA, 462 bp, Homo sapiens
ccaaaaatgatatctaattttgtttcctttctatgaaaattggtattcagacatattccaatgtttgtagctatttacaatgcattcttgctgtattggccattcatatcttttttattattaattgttttctttttaaaatcagttcataaggcttttcaaaaattcttacagaggctggggatggtggcttgcacctgtaatcccagtgctttgggaggccaaggtgggagaattgcttgagcacaggaattcgattgtagcctgggcaagatggcaagacccctgtctttacaaaacattaaaaaatcagcatggcatcatggtgtgtgtctttagtcccagctacttcagaggctgaggccacagtatcccttgagtccagtaattcgaagtggcagtgagctatgatcctgccactgcacttcagcctaggtgacaaaatgagaccctgtctctaaa

SEQ ID NO: 249971 - DNA, 437 bp, Homo sapiens
  misc_feature (48)..(48): n is a, c, g, or t
gtctacacagagaaactgaaatctggttagtcaagaaggaaaaaacanccaagtgcctggcattaagaggattttttttttaagctcagcctatggacaacaaaagcatggactgtatttctcagcatcttttgcagcttattgttgaaagtccagtgagctacctcaggcttttctctgtggaatgactgttgcagagaactgcacctcagaagaatggagtttaaaactgtgatgacattctacctcattgaagaaatcctccagtgccaagggtggatctctaaagaaggattcaatccaggatcacatcttatatttacaataacatgccttttttctccttcagtctggaaccgtgtctcagtctatctttgttctttatgacattgacatattttaaagaataaaagccaattcttttatgcaccatctct

SEQ ID NO: 249972 - DNA, 407 bp, Homo sapiens
  misc_feature (48)..(48): n is a, c, g, or t
gtctacacagagaaactgaaatctggttagtcaagaaggaaaaaacanccaagtgcctggcattaagaggattttttttttaagctcagcctatggacaacaaaagcatggactgtatttctcagcatcttttgcaggatgaggaaactggagcccaggtagccattttggacctgaaggtggaagtcaagctagggagagcaaacaacacgtgtgtggatccctgatgatcaggtcatcctaatcctgaactgctttcctctggtctctttaacaggagagaccagaggaaaaccatgagagagaggtaattttctatcccacttaagccactattgtactttggactttcttgtcatgtacagccaagcctaattataactaataaaacatgcaattgaaagaca

SEQ ID NO: 249973 - DNA, 1664 bp, Homo sapiens
ctgaggcgggtggtacagcctggagcatccagccgctggagctgcgagggaccctggacccctcccacgccgaggtttatgcagagcctgaggccagaaaacctagggactttctgccccaagaagctgaggcacctcctactcccatctgaacaagagggggatctggaagaagccatacagcagctcatcaggacactatagaaagaagcagctcaaagcaattggctgacagccaattcccccttctttcagaaggaaagaaggaagaagcaaacccccccctaccaaagatgacactcaacaccgagcaggaagcaaagacccctctgcaccggcgagccagcaccccactgcccctgtccccacggggccaccagcctggccgcctgagcacagtgccttccactcaatcccagcatccccggctgggccaatcagcctccctcaaccctcccacccagaaaccttcacctgccccagatgattggtcttctgaatccagcgactctgaaggctcctgggaggctctctaccgtgtggtgctacttggagatcctggagtggggaagaccagcttggccagcctctttgcagggaagcaagagagggacctccatgaacagctgggagaagatgtatatgagaggaccctcacggtggatggagaagacaccacactggtggtcgtggacacctgggaggccgagaaactggataaaagctggagccaggagtcatgcctgcaggggggcagtgcctatgtcatcgtatactccatcgcagaccgaggcagctttgagagtgcctctgagctccgcatccagctgcggcgcacacatcaggcagaccatgtgcccatcatcctcgtgggcaacaaggcagacttggcccgctgccgagaagtctctgtggaagagggccgcgcctgcgctgtggtgttcgactgtaaattcatcgagacatccgccacgctgcagcacaatgtggccgagctcttcgagggcgtggtgcgccaactgcgcttgcgccgccgggacagtgcggccaaggaacccccagcaccccgacggccggccagcctagcccagcgcgctcgtcgcttcctggcacgcctgacagcccgcagcgcacgccgccgggcactcaaggcccgctccaagtcctgccacaatctggccgtgctctgaagccccccgcccttctgagagttggcgggtcactgaggtgcattctgggctccagggacgccactgcggggcaaaggcgccgttacctggagtctgcatcatgggtcttgcttgcctgctgccctgatggcctgagcatcccccagatccaagcctgggggatcccgggaaagcgatggacagacagacgatggggccgaagccccaagctgggcacaaagtagttttttacgtggtgggtgtctttttgtaaaaaaatcttccttgtccctgggctctggccaaccctcagaaaccctcacaataaaccagaccagaaggatgtcccatctgaatgcccagacctctccatctcggctcttccaggcgtctccacctactgccctcccatctacacttgactgtagactggtctggcctgctggcctgggcgtcagggcgcatcaataaagtacttggaccagttttgtgctc

SEQ ID NO: 249974 - DNA, 400 bp, Homo sapiens
aaattactgttggccacctggccttcatacagaggtgaaattaactgttggctaagtaatttgattcccctgtatgccatgtcaaaccagtggagatgtatttgtttaggttatacattgttctttcaaactttaaaaaaaatgaaagcactcttgagagggctgttatttcaagtctgaatctttgtgtgtgtgaattagttgatcacatcttttcttttggggcagtcaacaaaggacaaatgaagataagcaatcacaattctgctctggactgtggaaagctggactaggccagaaacagtggagggatagtgacctctggtggttactggtatggaggtaggggctgcaaattggtatggctcaaacatgagcagttggggacacacctaagggt

SEQ ID NO: 249975 - DNA, 437 bp, Homo sapiens
tcccccagtctccacctctatcttcctgccctgggaatcactccacattcacccagaagaattgttgcctgtgggacagccttgaccaatgggagattgaagctgatgagtaaatatttccccctttggcccctgagggacagttctgagatgcttgacacaggcccttcagcgctggtggccaactcagcagtgcatccttgatctggcttttgcttcttcctttgttccgcccctgcccctcactcctgctctctgggattgaattcctaagacagctccctgcttggggtctttgtctcaggctctgctttagggggaatccaggctaagacagtttccaagcacccatgattgcaaataatccactgttttgataaattcggccaattttttttttttggtgtgcaaataaagttctcattcccttgccttca

SEQ ID NO: 249976 - DNA, 422 bp, Homo sapiens
gaaaaggggctccaatgggaccggcaaggactgaccaaggtcaacggttaaagggctcatacctcaagggcaaccaccctggtggcccagagcctctgatcttccagacgcttcaagggatgatgcttcttcctcagagcagggctcaagctcgtgccgaattcggcacgagggagcaagagagacagggagaggaggacagcgagctgtcagacagggcagtgctattatgcagcagttggttgcttgggattggatttcgagagtactctgcagttttggatgccttgaggcacctcagagtgtaagggctggccaagtcatggcttgcaggtcccagggtgccttaggaggtggcatgagagagggtaaagcaaagtgggcattgcagcattctgggccaaaacgaaatgaactatagc

SEQ ID NO: 249977 - DNA, 617 bp, Homo sapiens
atcacgtgagttcattcatatatgtttatctctttggggatggggggacaacttcactgtggacttaattctactggagatgagtgaccccattttaagacaacaggatcacaaattattatcacatatcagcagggcagacaatagctacgacctggggctgaaagcaggtaactccatttatcctgtaaacattgtcttgattatggtgccagttgctgtgagggatttcctttccaccacctgtttttcacaaggtttgagtctgaactgctaacattctactgatttctgggtgaagggactgactgcaccatcctaccctgtcagagcacttgccccagtacttccactttaagagttttccaccttgtccagaactacagtccattaatcccctcattttctctcttaagagaataaacaggccaggcgcggtggctcacgcctgtaatcccagcactttgggaggctgaggcgggtggatcatctgaggtcaggagttcgagatcaacctgagcaacatggtgaaaccccatctctgctggaaatgcaaacattagctgagcgtgggggcgggatcctgtagtcccagctacttgggaggcttaggcact

SEQ ID NO: 249978 - DNA, 508 bp, Homo sapiens
aacaaaacaaaaaaaaaccgtgattgtttccattaagccatcagagcgtgtctcagatatcttgttatacagtgaagaagagaatacctattttttttgatgatgtttgatgtcatagtaatcagtgctggtttaactcctgtttagttcctgccaaatacattgcatgggctgaagtgtcagtagccatactgttctcatgtttcttggtcctaggatcagattcttctacattattttttagtttcccagagacatggtgatccctaaacttatgaaggtttcatcctaagccattcaggcttttctctttgtatagattaaaccgaaaaccgcatatgagcctgttcatctgctggtggattcccaccacagactcagactcaaacaaacaaacaaataatgtgaccgtttagttagtttccaaaaacattcacatacaatattgcatgaataagtaagtaagtgttacagaaagctgccaaaaaataaaaaggtttttaatatg

SEQ ID NO: 249979 - DNA, 322 bp, Homo sapiens
cacattaaaatatttttcagaacaaaaatcttgccattgtttacccatgttttgatctgaagtcataggattttagggttggatgggtttcagacccattcctctctctcgcccaaccccaccccaccagttttcagaacagagaccaacaacagagagatgagaggaatccccaaaatcacccagcctaggtcacggccaaattgggtctagaatccagatgtcccgatttctgcttgctgagagataaaggtttttttcagtcaagggcaatatcagtcattccgtgacatgtttggcttttgggagtttggccaggaaa

SEQ ID NO: 249980 - DNA, 365 bp, Homo sapiens
tacaaatgatttcatcttgctacacgtgtccacaccaaagctagaattatttggtgggtgtttccttattcctgctttttttgccctccgtcctttcttctttgactcttttatgaacccccagtaactcacagggaacacaggaaaaatggaaccttaaaagttttgttttagaaaaactaaacactattaaaaaattaattaaacattgaaacagttctctcttttggatacagttaactatccattttcttacttctttcacagaaataaaggaataaaagcattatccttggaagtctgctgaataaatctggtggaatcagttaaagtaaaatgtccacatgttacaagtgctgctatgc

SEQ ID NO: 249981 - DNA, 215 bp, Homo sapiens
gaaaataaagttaaacataaagaaaaaataacctgtaatctccagagatggcctctgttaatattttgatgtaagctcttccagaccttttagtgcctttttataaatacattcacttaaacattgatttaaaaaatactctcaaattgctgtcttataacctgcattttaaatttaacgatctagtgtgaactttttttgaccaataaatctaa

SEQ ID NO: 249982 - DNA, 1184 bp, Homo sapiens
tccctttaatgagttcttgttttcctgactgcagctctcttcattctgccaaccttttccaactccatgatgatcctgcaggtttcagggggcccctggacagtggctctgacagcattactgatggtgctgctcatatctgtggtccagagcagggccactccagagaattccgtctaccaggaacggcaggaatgctatgcgttcaatgggactcagcgcgttgtggacgggctcatctacaaccgggaggaatacgtgcattttgacagcgcagtgggggagttcctagcagtgatggagctggggcggcccataggcgagtacttcaatagccagaaggactttatggaacggaagcgagccgaggtggacaaggtgtgcagacacaagtacgagctgatggagccactcatccggcagcgccgaggagacgtaaccataactgctgttagggggtgttggacgacgattctttctggctacttcctgctgaaaaggggcgtcgtgtcggggggctgcagttggggctcctcctgaggttgatctaaggcttcttggaagaatggcatgtccatgtgtggctttgtttgcagcaccatttgaagtttgattgcttctaggcaaaaagagataaattttacaagaaggtttaaaatatagggttaccatatgagtattaagattaccacctatagactgtaactatggcagtagagtttgatacctgttacaccaatggattgtaatactggtttgtctccactagatgtcgctgtacattaccagaaacgttaatataaaagcatcatttcctttgagaaaacatgtttcccccttgacttgctattagggcataatttttggtttaggccattctttataacttatgatatgattgggagaaaaacgttattgggtggctaaaataactttggtgttaatcttggcaattcctttcctttaattattaaatttcttaattattaaattctttcatgactttcacagaccctcttacaatgtactcaactttctgacttgtcttaaacaaccagtcatttccttttaggacaagaatttactatacaagatcctttcttatataaaatccctttatttgtaaccttctttccatagcttagagtgcaccatttaccaatcttcaataaaaaagtcctatc

SEQ ID NO: 249983 - DNA, 418 bp, Homo sapiens
agagtttaaagccagagcacagttgtacttaaggcacgtcctgcaccggcagcttggggggatggtgcctcactgctccacctcctccagtgtggcttggcccaaagggctcttacctcctcccagccccatgcccattcatgtgtgtgcatgtaactgccatcctatccccagggcagtgcctcttctgtacacgatggttatatatggccatatgctgtgataggccctcttacaagaattttcgcagcatgtttaattaggccaggcctttcctgcaaccagcctgtgtcccaggatctcactattgattactgcctcatacagagcacctgggatttggagccagctggtgggaggaatctctggggtcctgtgcctctcccaaagtcaaaataaagagagggtgcccagagca

SEQ ID NO: 249984 - DNA, 474 bp, Homo sapiens
acaagaaggtagataggtttttgcttttgaaggatatggaggaaggggaaaggtaaagatatcactctgacctagagtaatcctcaacccatggtgtagcctctggtcatctcccatctaaagcagtatcaaagggcaagttcagttctaaggccaatgaggggaatcaagcttaagacagccaacgcaaagaagaatgtgcctggagcatggaccagtctcgtaactggcaccttaataccaagccacttgagtctgggctacctgtgtaagttggctttttctctctttgcagaaggaaatagattatacgtttggccccattttttttacccctctctgtccacatgctttgagtatattttgcagttcctttcacaaaaaacagagtgtactttcctttcccttgactttgagcttgaccaatgagatgtcgacgcggccgcgaatttagtagtagtagtaggcggccgc

SEQ ID NO: 249985 - DNA, 461 bp, Homo sapiens
agactctgtctcaagaaaaaaaaaaaaaaatcacatacctttttttcatgttatttgaaacttggtatgaatatcgtgatttaaagcatatcaaagcaattcatcaaagtcagtattgttttcagactatgccccctcttttcctgtttgctcttgagaatctctgatctagatcacctcattttacaggagaaaactgagaactagatgagacttactcatggccacatagcttgcgagtgcctaggctgagactcagtcctcatgctcagagtagcaggaaattcccctgcactctctgctgtcaggtaatcccagatcatggaattgggacaaatgagcattgtttctgagccgaagctcccctgccgctggagatttccatttgtctgtctggtactgaagaaacacagggaacaggaacaaggggtggtggggccagctggccctggcatccctct

SEQ ID NO: 249986 - DNA, 398 bp, Homo sapiens
ccatctctagaagatggaaaagacaaggaagcagagtcatccctagagggatccagagggaacatggccctgctgacaacttaatttcagtcgagtgaaacttatttgggacttctgacttcagaactgtaaaattataaatttgtcttgtcttaaaccactaaatagatttgttacagagaaaataggaaactaattcaccgtccaacagcacattttgttcaatctgatatcattttggttaaaaatgtttttcacaggaaaaaatactgggagaatatacattgaaggatgtataatatttattactgggtaagattttgctcatgtcgttttctagattatctataataaatgtatttttctacaacaaataaatttgtaaagaaggaagtgaa

SEQ ID NO: 249987 - DNA, 337 bp, Homo sapiens
gccaaatgacgaggaggaagacatagtagaagcagtgccagaactgatgttagataatctcacagaagcgttctgattattcaagactgtttttgatggcttttatgacatgcactggacccttctatgataggagcattgaaactaaagcaagtggggcaagggttggtacagtatagaaacatttttagagaaatgaaaaagcaaaaagatagaaattacaatgtatttacataaagttacactgagtgtgccagcctcccctgcctcttctttcatctcttctaccccaagactagaccactgcattttaaatgtattacatgctgattgtaaa

SEQ ID NO: 249988 - DNA, 375 bp, Homo sapiens
cacatataaggagtggaaagctgcgaggttctgctgttgcacaaatggcctccccacagagcacagactgccacatccccttctgttccaaggtgttaggtttttaaaacctagcggtgattgtgacattgttttttttcctccccctatgttgtttatcttgtcagacttaggcgcaagggctgaactccctgcgcagtaccatcccctgggcttggtaggtttggagaaggcaagtggggcaggtgaagttgtgagctggttgcttcaggaactgcagtcttcctggtggctcaggatcgacttgtgttttgttttgggggtactgaccttgttaagccatgtctttagatattgagagccaataggcggcat

SEQ ID NO: 249989 - DNA, 365 bp, Homo sapiens
cttggtcagacattattctgggtgtttctgtgagggtactttgggatgagattaacatcgaaatctgtagactgagtaaagcagattgccttccctagtgtcgatgggcctcattcaatcagctgaaggcctgaatggaacaaatactctgaccctcccctgagtctttctgaaggaagtcagaccctcctgcctgatttccttcaaactaggatagttgctttttcctgcctgcaagacttaaacagaaacattggctcttcctgggtctccagcttgccgactctccctgcagaccttgggacttaaccagcttctgtaattgcatgagccaagtccttataataaatctcttataatagaat

SEQ ID NO: 249990 - DNA, 875 bp, Homo sapiens
tgctccatggagttagacagatgttggtgcaaaattcttacaccgcctgcccattcctaaatgtgcgaacttaggcaagttacttattttgtctttattttggcacccccatgtgtgaactgagaataagaatacttagcaggattgttttgaaaaatagtaatatataatattataataagatgattaatattaaaaatagccctcatttggataactatttttggcaccaactcccaggcaacttttcacagcgtgaatagttagccctctttgaacaagttactaagtaccagccactttaaatacataatctcatttaatcctaacaaattactagtatcattcctattttgcagatgaaaaacaggccaagacaggttcagttgacaagaaattgcacagatctaaatgcagactggacttactgtgaatcccaaattttccctcaccatgttattttgtccaaaatgaaactaaaatgcttggcatagatctagacttttgtaggcactcagtaaatattatttccactctgaagaaaacgattcatgtttcatttcgcttctcatcagaggtaccacgaacagaatatcacccttttatgataaatcactcaaattgcagacttttgatccctaaagttcaagagtgaaaaggtataaatatgaagaaatttcatgttaggtcacgggatgggaaaagatgcttatgtcaggatttaccatttctagtgaccagcacctagcagattgctggtttattagatttatttattattttcattgtttccttcagatgactcctatttatctgattgtagagtaacctctgagctttattagctagaattttattttccacagtgtagtcca

SEQ ID NO: 249991 - DNA, 749 bp, Homo sapiens
ttctctatgtgctcaaatgaatctgacttactttataagaagaagggcttggcattctgatggagtcctggaaatagattcttggagacacagctatgtattggtcttcctacatttgtctctgtgattgtggattatgatgcaggtggactttgctcctttcccctgtgctatgcagcaaagtgaccttgaacaagctgccagccctactggatcatgattactcatattttgaggagaggactgaagtaacatgatctctgaagttcattttagccttaagatccagtgaaaagttagcattaatcctaggaaaatagttagagataaggatggtggagtgcagttattttaagtgctggaaaaattgtagctctctggaggaattgaatcttctgaaattattcactttgtaatacaggggagcttaaaaggtccacccttccatctttctacatatacttaaaggcagttaaattgctgctaaaaatgtgaaatggaggtgtgaacatttctagaggcaattaagtagttctgcattttactggtaaattctatcattcttaaaaaaagagagaggtttatataaaaatggagaaaaaggaaattgcatgtgcagatgtaaaataccatctgtgcttctggattctttccatgctccacaccttcgttgaaagaaattgttgattgaaagctcagattttgctggctagttataaaagcttcctgtgttgcttatcatgcatttt

SEQ ID NO: 249992 - DNA, 579 bp, Homo sapiens
gcgtggaactctgcgcgagctgaatctcctgctgcaggacgagccccgaccccgagcccgatcccctccgcggtcccagcctctttgtccgatcgcattttccatctcctctgccaggaatgctctcccaaccagagcaaatccagatgtcccctcggcgactgtgggcaccctccccagctgtggagccttcgcacgccttcctcagagtccgtggttgtaaaatttgttttgctctaaagtatttgactgtctccctcactagatcctgagggttttagtgagtgcctcagtgtgagcacatgcaggcactgctaggcgcctgtagttgattcttagttaatacaagtgaataatcacaactagaccttaaattgcagggactatgtgacaggcactttttaaaatgctttatacgtgttgatttaagtgtaatcgtcacaagaaccctgcgaggaagataggacagcaagtgccctgttcctgtttgtaaacgtgcccgacactctgcaacaacacctacaacagaaccgtgctagttttgggggttcgcaataaaagtttctgtttgaacggatc

SEQ ID NO: 249993 - DNA, 383 bp, Homo sapiens
cagactaaatatatgtaattcttgtatctctttccagatgattcctttttattcatctttttgtctatacatgtcaatatgactttttattactttagctttattgaatattttattctataaatatgttaaaggaaaatgtaaaagaattttttataatcttagggtgagatgaaaaggctttctttagcaagacatgaaacttagaagccataatggaacataataacatatttaactattaaaaatgtaaactcttctgaatggcaaaagacaccatgatcagagttaaaacacaagcaataaacaggaagaaaacgtatgacaaaggattaataccagataaagtgctcctgtagagtaggaaaaagcaatattaaaaa

SEQ ID NO: 249994 - DNA, 713 bp, Homo sapiens
gttgacaagttaggcctgatatatcttgctgtgccaaggaaataggaagattactgggatcatatcagaaagatacagtaaccaaattgaaggggctacctctgacctcagataaaaaaatttgagcattaaaaaatactaattcaatagatcaaattataccaagtatatataactccatgagttcataatgattttttaaaaataaaaatttattagtctccactggatattgttaatgaacccattcattacccttataattaattcattactcttattaatagaaagtgtcaaacacttatctcacctttcctgtatgagatatattccaagataacccaataactgatgatagaaagtttttgtagaactcagctaataaatatggaaggaataatagaaaactcagcattttactacctattccattggatttaggtaattgtcattaatggggaactttaaaatagagggatcgggatgacactgcttaaatttagtggtcaatgttagtatcaataaaagtggtcaaccagtcattatacacctcttgatgtgattcaacaagaagtatactgcacccaccacctgaaacctattcttgtcatccagacccccgaaaactgaacctaaacctagtcatctctaggtctaaactaatagtttaaggaaaatataggaaatgggggcaggagtaaagcaaaaaaaaa

SEQ ID NO: 249995 - DNA, 317 bp, Homo sapiens
tggtaacacagtaaaaatagaggacaggtaagatgcctctgtaaacacggactgctgtgattttggtgactagtagggggcagaaactcgaaagtagctccagggacgctcacctcttgtgctcctatcccactgtccatctcccatctgctctgggctctcagtgtggagtggagctgatagtggtctccaccaccaaggctctgcctcttgcttgagcccctgagcacctactcttggcactctgtgtgctttgcccacttaatcctcacgacagctctttgaggcaggtattattatccctattttatagatga

SEQ ID NO: 249996 - DNA, 178 bp, Homo sapiens
tctttggtggcctcccgaacaagcaggtgtggatggggagatggactgccttggagagagctacatgagttccagctccaccagcccccagagcctgagcaggtgacttcacctttctgaatctctgaacatccatttcctccactgtacaatttcattaagatacatacaagaatat

SEQ ID NO: 249997 - DNA, 678 bp, Homo sapiens
ggtattaataatagatttattttttgtaaattgaaacgtgtgttattgttagaaagtcagtttatgagataattgaggttgttttgatgactgcagcctctagtttatttctatatttttagttgggcagtatggagaaaatcctcattcatacctacattgcatatgataacagttaaaatctttattgtaatacatgcttgcattttacaaattcaaatattacaggagtatactgcataaaagataaagttctccataattcctactgccctctaaaataaccactaacaacctttttaacaacatgccttgcattcttctagcttgaaagaatagtaaatcaaagcagactcaccaacagatgaacattctgtagcataaatataatcaaagagctaaaattattagtaataatagataatacaataggatgtcatttattgttccaactgatttatgctatgaaaagggcaatctgagcaggaatgtcttagtctttcctgacatttaatttaccatcataacattcgtagacttgtacagctgtagcatcttttcaatgcagaaataattctttatgatgagtgacacatttcttagaagttaaaatttgtgtacggagatggcagaagaatctgtctaggcctgcctcaaactgggttactgtagcaaaaa

SEQ ID NO: 249998 - DNA, 555 bp, Homo sapiens
tccagcctgggcaacaagatcgaagctccgtctcaaaaaaaaaaattttaggcttttaatagtgacaaatagaaagttccatctgagaacaaaaatcagccaagggaagaaacacacagggcagagtctgggaaagataaccagaggcagagcttctgttgtcctttccatgtagagtcatggatgaattactttcctggcatagatgtgtaacaatacagagtatttctagccaaagaagctcaccagaaccctggtgcccagagtttttactggggttcaatcacatcctgctcccgtagtgacctctagttcccagctcttctggaagcagaactgacagcacatggcccaagcccctatcataagtcacattgtccagtggctaaagcgccaggcaaacaaagacactcctatcaggcatgatattgcacaggtctataggtcacctcctagtaacccagggcaatgccctctcttctggggtaaaattaattcctcacaacacaaggcaccgtccacaaatttagtaacatatttctgaagattctggtg

SEQ ID NO: 249999 - DNA, 328 bp, Homo sapiens
cctactgagaggcaggtggttgtccccttgttcaaaaaagtgctgcggccaggcacggtgtcttatgcccataaacccagcactttgggaggctgaggcgggctgaacacctgaggtcaggagttcaagacagcctggcgatcatggcgaaaccccgtctctactaaaaatacaaaaaattagccatgcatggtggtgggtacctgtaatcccagctacttgggaatctgaggcaggagaattgcttgaacccgggaggtggaggtcgcagtgagcagagatcgcaccattgcactccagcctgggccacagtgtgagacactctctc

SEQ ID NO: 250000 - DNA, 775 bp, Homo sapiens
tcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaagtgggcttctctcattcattaaaagaaaatgcgacatctttctaagattctctgtgggaaaatgactgtcaataaaatgcgggtttctgggca

SEQ ID NO: 250001 - DNA, 376 bp, Homo sapiens
tcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaacca

SEQ ID NO: 250002 - DNA, 512 bp, Homo sapiens
tcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtagaacttgagcgtccgatttctacacatgtagacctgttggattcaacagtgatcgcaattctggacagccaactggaattaccaggatgtccaaacgtatgc

SEQ ID NO: 250003 - DNA, 312 bp, Homo sapiens
ccacagtggtgtaggatgtggataatgaggaggctgtgcaggtgttggggacaggtggtatttaggaatgctctatattttctttctttctttttttaggacggagtctcaaaaaaaaaaaaccaaaaaaaaacccctccttttccaaaaaaaagggcattcagcaaatccggaacactacaaaacagagggttttttttaaaaataaaattccaacaatacaatctgctaagtttgggaaataggccctcctcaaagaaagacctgaggccggcgggtttaatcccatgctggtttctaaagggcagggag

SEQ ID NO: 250004 - DNA, 427 bp, Homo sapiens
tatgtaggcaaacaattgttgttgttatacaaacagaaatgtggttaaaaagagaaatctgaacgcccaaaaaattccagcataatacaaatcgagttgttttcaaatagagggggtgtttcttttttttaaatacaggtttaaattccagccctctattatcacataccccatttcatatttgttgctttttgatgaatacatagtatttcttcatatggacatactgtaatttttttaatgaattttctattcttaaataattttgagtttttactctattattttcataatcagaaaaaaggtaagaaatatccacctggaaatatgtgatagtttttcttatgttcttgacattgtgctcactagaaaacattgctttttgagttgaatgaggaagaaattggttaactcctaaattataggt

SEQ ID NO: 250005 - DNA, 1019 bp, Homo sapiens
attggcagtttttcttgttttcagacctggaataatgcctttggctcaatttaaaaatagaatctgtaatgttagtggaaattaaacatcctgaatagagtatggcatgtaagccacactaagccagggtttttaaaaacgagactaacaggctgggtgcagtggctcatgcctgtaatcccaacactttggcaggccaaggcaggaggaccaagctggacaatatagtgagatcccatctctaaaaacaattttaaaaaaaattaggtgtggtggcatgtgcctatagtcccagctactcaggaggctgaagtgggagaatcacttgagcctagaagttttagaccagcctgggcaacatagtgagaccttgtttcttacagaaaattaattagccagtcatggtggcatgctcctatagtcccagctactagggaagctgaggttgttgtaaccatgcgagttatagagaaacgccacactttgagacaaattaaagagtcctttattagccagcgacccagagacagctcacgcccaaaattctctcagccccgaggaaggggctagttttgtttttataccatggtctaaatagggaggggggattttagctgaagcaatttttacagaagcagaactggcagaaagttaaaaaaattaattggttacaaatgcagttacaaaaaaataaacagttccaggtaccggggcttaaactatcacaaagagataaatgtaggggttttgggtgccatgcactgcgcgtgcccccaggagctgctggtgcaactcgcctcagcatctcatcaacaggtgcattcctggacgtgctttgagtcagttttacactagctatgcctggagggaggtgaaagggtttacaagtgaagaagctaaaatggagtctgtccggctctctctctgctaggagagagtcactcgggttaaaacaaggtaggatatcacaaggtgggatgatcacttgagcccaggagttcaaggttgctgtgagctag

SEQ ID NO: 250006 - DNA, 222 bp, Homo sapiens
actgaggttgaaggttgtgagagcttcatttctttgcatgagcagctggaaacctggattttgaggaaaccccctgggatgtttaagatagttcaggccgggcatggtggttcatgcctgtaatcctagcactttgagaggaagaggtgggagaatccgttgagcccaggagtttgagatcagcctgggcaacatagtgataccctgtctctataaaaaaaa

SEQ ID NO: 250007 - DNA, 781 bp, Homo sapiens
ttagctactcactgtacaaccacacctcaatgaatcttccgtcagcacctcaaactcaacatgtcaaaactgattgtattaactttccatgtttggagaggcagcataacctcaaagttaggagcatggagtctcggatattggttttagtcacagctctagctagctgaatgacctggagaaagtctctaaactgttctttctttgtgtgaggaaatataggtttactcttgggattcgatgagatagtggatacagcacattcaacacgatacctgcacacagtcagtaatcattaaatgttagctattatcatccataattgcccccaaaacttccaatttttcctgtctggtaatgataccattatccacttgaaccctcttcttcacgccatctcagctaaagagttagcaaaaactgtatattctacctttttttttttcctcaccctgtcacccaggctggagtgtggtggtgctatcactgcttaccgcagcctcaaactcctgggctctggtgatccacctacctcagcctcccaagtagctgggattacaggcatgtgccaccatgcccagctaattgttttattttttgtagagacacggttttgtcatgttgtccaggctggtctctaactcctagactcatgtgatccgctcccctaggcctcccaaagggctgggattggggtatgggccatggtgcccctcctattctacctttttattttctctcagattatgattcattcaacatacacttatgtgacatctac

SEQ ID NO: 250008 - DNA, 430 bp, Homo sapiens
aaaatttatgatctttcctgtttgcaggaaatctggaaagtattggcactgattaggaaagccttttttattataatacatccatcactgtatgggaaagcaggaaaggatctgccaatgaaacgaaatagttttctggaaataaataacatctacagacaattgaaactattgactatagaatgacgcagttgtttcaagattccataggtaatctggaatggaggcatggaggtggaagttctggactcttcttctcaatgtctagctaacctggtcagaggcttgccagaaggggccccgataaaaggaagctacacccaagatatgagacaagaatatgggacagttagctttgatctctgaatgtgttgtgtattggtttcagtgcccatctcatagaaataaaatactgctttattctgcaaaa

SEQ ID NO: 250009 - DNA, 536 bp, Homo sapiens
ttatccattgctgagtatacaatttatttttagtaagctcatgagataaatggccaaacattaaaaaacggagtgagggagtcagggacagacaggagacagttgaaagaaagaaaaatacatttcagtctcctagagttagaaggaattctagaaggttttgtttaagataacaaaagtgtaggaattccttatgctgtggctgggggcatcctggagagatgctgctgcctggaggcccaggccccttcctgtcctggctcatcatcaggctcagaggaactcgagaccttagggaaagaggagcaatagaggggaaatattagcataggttccaaaaatgaaaaggaactaaataatcatgaaactacatatagatattttatataaatgtaattattataaaattataatagtatatttctaatataattatgacagtattataattatttatataattataacagtattataattatttatataattatatatcactttggtatatataatgtatatatataactaaattt

SEQ ID NO: 250010 - DNA, 423 bp, Homo sapiens
atgacaggtgagctcactgcttatgtaggtagaacaagagccaagtgaggcagtaaagtgttagccaaccagtggcttgtcttcctgctctgtcttttgtgagcctcaattttgtttagcttttcccaattccgagtgaagctcttcttcccatgctcacagcattccataccagttttcttggatgactctatcctgggggacccccacttaaccagccatagttctgtccccttattgttatttttgtttgtttgataagagagaatttgtactgaatcaacacctcagacaaatcccacctagagtggttccaaggaaaatggtgagagaaatagtgaatacaattcagtaaagagaaaagacagaaagaagaagaagaagaagaagaagaagaagaagaagaagaagaagaagaagaag

SEQ ID NO: 250011 - DNA, 440 bp, Homo sapiens
ctggcctgggcactggattttacatctgagtctccaccttcctagctaggctccttagttacttcacagaacttgaacttatttagaacttaaaacgtggctatggatgctgcatgtaatgattttgagagaataggtttgttaatatatgtgaaagagccctggataattcctggaaatggagcaggcctttgataaaaacctgttttcttttcctttttcaccttcccttttctaagatatgtaaatcccctcatctatgaaatgggaagctatctccttgggtggttggagaatcagaagacacatgtagctgggcacggtcggcccacacctgtaatcccaacactttgggagactgagatgggaggatcacttgagcccaggaatttgagatcagcctgagcaacataggaagaccccgtcgctacaaaaaaaat

SEQ ID NO: 250012 - DNA, 358 bp, Homo sapiens
atgttgggatactgggaaatgttcttttgttttctggagggttaccatgatttccaaaccctagtccttccctggcaccctgcctccaccacacagacacacacacatatatacacattgctgttccagaatatctaggaggtcatagagttgtttttgtttttggctattactgctgctattacttgtttatcaaaagaggatatgaagccaggcacagtggcatgtgcctatagtccccagctactgaggcgggaggatcgcttgaactcgggggttcaagactggagtgagttatgattgcacctgtaagtagccactgcactccagtctgggcaacaggggaaactttgtctta

SEQ ID NO: 250013 - DNA, 707 bp, Homo sapiens
gggagatcaggcgcaagtcttttggacttaaggattcttaagattgtattgcctgtcacaaaaatatacttgtgcaacaccatatgagcctcaggatcacactgatttgtgagggaggcagacccttcttggtcagtttgtaagtctgctccttcatgtcatcagatgtcagcttcagccaagtgggaaccttgcagtgacagggcagagccgattgagacaggcccttcccaggagtgcacatgcgactcatgatggtggcagtcaggcggtccagtgactacgtcttgaatatgttatataataatgcttttcaaactctaatgtgcacatgaatcacctggggatcttttaaaaatggtttctgattcagtggatctgagggtggagcctgagattctacatttctaatgagcttccaaatagatcatgcccatgttgttggttcacagaccagaattggagtaaagaatgtcttggattagtaattcagttagatgacctttaatgcacactttaaccttgggagtctgtaaatataccaggttggagtggatgagctagtataaagaaaactaaagctgggcgtggtggctcatgcttgtaatcccggcgctttgtggggccgaggtgggaggatctctttaggtcaggagtttgagaacagcctggcaatgagactctgtctcaaataaaataaaataata

SEQ ID NO: 250014 - DNA, 757 bp, Homo sapiens
ccagattagattccacttctccctgttcttacagtgccgttagtgctgaaaggggaacgtgccttgttcatttggttctgcacagggtccagcccagtgcttggcacaaacgtggtctcggcagtgctgcatccctggcttgacctggaggtagcaattccttcaagccatttgctcatcttacattggttcgtgggccatggaatggtgtcgagagctttctgcctatcttccaaggaggtttaggtcctgccaagagctcacagatcctatttcttgccttatctctggcatttatttcttccttaaccagcctagcttcagtgctccagaaaagtgccctgcccttccacaccaggatccctagcgactcccgaatgatgctttcttggactctgttcacatggcctcagcccttctgcaccctgctgcacgaaacctggtgccaggccaggccaggccagccggatccctgcttactccttaccctgacatcccgctggtggagagggatggaggtaactgcaagtgaaagaccagttagaggaccgcatctggaagctgtgccaaattttaaatactgtatatttaaatatatatttttatattatatactatatatatagcattatgagccaccaaacccaaagaactataatgaagagccaaacaaaacaaagtggctcaggttctaggggacgtcctagggtggagaaagaggcctggaaggtgggcagccccttccatcgagggtggg

SEQ ID NO: 250015 - DNA, 754 bp, Homo sapiens
attccatattatgcaaatgaataagccctgaagagtcaaactgaaaaaaaaatgaaattaactgtgaaagatattattacccattcagcaagaggaaaatgtagacagagttaacccttccttttcatacattttcttgggaagataagtgccagggatgatggtccgtgtcccagatgtaaagaagctaggcacggtttgcagccagttcccccatcctccttctgtgctcacttttttgtttcatgctctcttaccttttggccacccagtcccctcaactagtccttgtccttcccttccaaaaccaatctcagagaaagattttatgaacacagttttactaatatataagtaactgagcatacttaatgtgttacttttctgaagcatcagcatgttaataggagacaaagccaaagaagtaaaaccctaaagataaaaacaatagaatttcgcacactggtaacctggtgataggagaccatttctgaatggagagagggctcgtgataaataaacacaaccctaggcagagaatataggcaaatggattacagtatttaaatcaaagtagtattccttttgccgtacattggagttgatcacataaacctctatagcaagatggtatgttatttaacatttaaacaaagcttccagggaaagccatttggtttgtggttagggatttttgttattcagtagcaatgaacctgaaattctatattatctttgcatgttgaattttaga

SEQ ID NO: 250016 - DNA, 809 bp, Homo sapiens
attccatattatgcaaatgaataagccctgaagagtcaaactgaaaaaaaaatgaaattaactgtgaaagatattattacccattcagcaagaggaaaatgtagacagagttaacccttccttttcatacattttcttgggaagataagtgccagggatgatggtccgtgtcccagatgtaaagaagctaggcacggtttgcagccagttcccccatcctccttctgtgctcacttttttgtttcatgctctcttaccttttggccacccagtcccctcaactagtccttgtccttcccttccaaaaccaatctcagagaaagattttatgaacacagttttactaatatataagtaactgagcatacttaatgtgttacttttctgaagcatcagcatgttaataggagacaaagccaaagaagtaaaaccctaaagataaaaacaatagaatttcgcacactggtaacctggtgataggagaccatttctgaatggagagagggctcgtgataaataaacacaaccctaggcagagaatataggcaaatggattacagtatttaaatcaaagtagtattaaaatacaaagagaagattatttttaataatacatttgtcagtgagcatttcccgccttttgccgtacattggagttgatcacataaacctctatagcaagatggtatgttatttaacatttaaacaaagcttccagggaaagccatttggtttgtggttagggatttttgttattcagtagcaatgaacctgaaattctatattatctttgcatgttgaattttaga

SEQ ID NO: 250017 - DNA, 199 bp, Homo sapiens
attttttgcagagatcgggtttcaccatgttgcccaggctggtctcaaacttctggacttaagtgatccaccctccttggtcttccaaagtgctgggattacaagcatgagccactgtgcccatcctaaacatttttttcacataatttggctgttatcacccctagtattggtgctttaaaaatgtatactgattacg

SEQ ID NO: 250018 - DNA, 936 bp, Homo sapiens
gggtcagggctgccctgggaagggcagcgacgctgggttggtaggagcatagactgcagggcacctgcctgagtgtagagtccctgggcctctaattctgtaaaatcgcggtaatagcatccgcttctctgagctgttagaggtgtaacaggtaaacccatgtaaggtgcttaggacagggctggtgctggctaagtgccgttaatatcgtcagcatcattacctgcgttattgtagcactgatcgccatgtcagctgccttcagggtctggcaggtaaagtagaggggccaggtagagatcctgctgacctggcaagcacatgttccctccagtcggggcgttgaccgctcagcagcaggtctagtgtcacccagtctttctagttctcaggagaagttgagggtctggatttttagaggatagctcttgtttcctttacttttttttttgagacagagtctcactgtgtcactcaggctggagtgcagtggcacaatctcggctcactgcacctcctcctcctgggttcaagtgattctcccgccgcagcctcccaagtagctgggattacaggcatgcgccaccacacctggctaatttttgtatttctagtagagacggggtttcactgtgttggccaggctggtcttgaactcctgacctcatgatccacccacctttgcctcccaaagtgctgggattacaggcgtgagccaccgcgcctggcccttgttttcttaataatgacaacaaatttttattttataaaaacgcaattcaaaaattagccgggtgtggttgtgcacatctgtaatcccagctattcaggaggctgaggcaggagaattgcttgaacccaggaggcagaggttgcagtgagcccagctattgcaccactgcactccagcctgggcgacagagagagactgtctca

SEQ ID NO: 250019 - DNA, 393 bp, Homo sapiens
ctggtccctggtgccaaaaaggttggggactgctgccctaggggacctttttctcaaactgcttcacacaacactccaagaacatgatgggaactgggaggaaagcgggttccatgagtaggtaagtttgggaaatgctgcagcctgcactttcctggagcttcatcacgtattaaaggctctgataaggccccagagaaagaagctaatttccttgtttaaggtggagttccgcaagctacaggccaaatgcagcccctacgggtggagcaaggaacggtttttacactttgtaatcgttggggaaaaaaagaacaatcttttgtggcacttgaaaaatatatgacattcacacctcagcgacagtaaatacagcttcactggcacacagcc

SEQ ID NO: 250020 - DNA, 423 bp, Homo sapiens
cccaggctgaagaggtagaagttggcagaagttaaaagcaatgtctccacaatggagaagtgacatgctaaaggaacctggcatccagacatttcctaacccccaatccctccttacatatgacctgctcttagaggagtacagcgtggtggttaggagtgtggactcggcagccagaaatcctgggatctgttgcttgttagctgtgggccttaagctaagaacttaacctctctgtgcctcagttgctccatctgttcaaatgaagataatgataatgaagatgatatcacctgctgtgtaggattgttatgaaaaatcaagaattaatatttgtaaatcacttacagggtctggcacataataagtgctgtgtgggtgtttgttaaataaaataatatacaatgacataggcattgtggt

SEQ ID NO: 250021 - DNA, 463 bp, Homo sapiens
tctagacagtactatgggtagtatctgtggggaggttctcagaaacatgtcgcatgctcttttagaaccttaaagtattcctagtctcctctacttccagcccttggctcttgggcctcagtctttttacttttgcggctgtgtttctctgaaggcttggcattagtagattgaaaagaataaccatctagggaaatgtgaattcagtttctttctgacattctgctctctacaaggggatattatgtacacataaacctacttccaaaataatgaagtgaggcctaattccttactcttcagagagcccactgtggaagtgtcactgaccttgtgtatgggctgcccttcatggctctgggagtcattataaagggcagcatttggcgtggtgcgtcctaagccagtgtttctcggctctgttccttagacatgtgttagtgttaatagatgttcttggaaa

SEQ ID NO: 250022 - DNA, 385 bp, Homo sapiens
gcctgttatatactaggcattatcatatttcttgattcttttaaatttcattgattttaatatctaaaacttccctattaggtacctttttcagatgaagcaaactaaaatttagaaaagttaagcaatttccccaaggtcatgttagtatatatctgggagaataacaatttgaattcacatctttccgactaagccaggctgaacccttaatgacctttctcaactatcagctcacctctccccataatgcatattttacagctcaaaaaggagaggaaggaaaaacctttaaacccattgctagaaagggtgtattacgtacaaggcagaatggcaagcacaggagaaatcattaaagaatgtcataaaagaccaaaaaaaa

SEQ ID NO: 250023 - DNA, 524 bp, Homo sapiens
tccctctgcccctcccttcagtggaggggagactttgaaatcaggtgcttggggtgggggcgctgctcccagtgggggtgtgaggaacctggaggatgaatccctgtcccccgccctccccctactctattcttccttaccctgcccctttccactccaaaacctcaagcctctggttcacatctgagtgacctttccaaagcaactgttctcagggggtccttgggagccgggaggctgtgaccttaacccacttctttggacagtgccttcctggcactccacccccacctgccacctcctgagaggaacatttcggctggtcttggcaaaaacatcagtctatgatccaggcagcctggtacagtaccagctctgccactgacaccactgtgaccttgggaagccatttacacatatgggtctcagtttctccatatgtaaaatgacttttgtttagctttcctgattttcaaacctttttttcaaacagtgaatcctcttgtttaaattgtaaatcatgt

SEQ ID NO: 250024 - DNA, 444 bp, Homo sapiens
gttccccatgtgtgaggcacatttggactcatttaatcctcacaacacccatatgggatttaaccatttaacagataggaaatgacagcatacagaggtgaggggacctgcccggggtcactcagctcacaaggagcagggcttggcgtccagttcatgcaggctatggcctccctttaaccaccatgcaggctctgatgcacgcccatgtccatggtcacactgactccttcctgctactccatgagatgacccagctgatatcactgcccccactttacacatgaggaagctgaggccagggagaggaggcaacttttccacagtcacacagcttgccaggggctcaccaggaatcaacccaggccctagccgtcccagaccattcctctttctgactcagccactgcccttcaactcaaagttttctctcccaggagaaaa

SEQ ID NO: 250025 - DNA, 594 bp, Homo sapiens
ggccgatcactgtactctagcctggaagacgagtgagaccccatctcaggaaatacgaaaataaaaaagagatgtcatatcatgcagtgttaatgagataagctgtgtgaacttccagaaggctttaacatccttcaaagaaatagaaaacacactcctaaaatttatatgggaaccatcaacaagacttagaatagtcagctatcctgagcaaaaggaatcaaactggaggaatcatattacctgacttccaattgattcaacagagctacagtacccgaaacagcatgatactggcataagaagagaaacataggaacagtaatagacaacccagaaaacaaataaagatttaatccaaaacagatcagaaagtacattaaatgcaaataatctaaatactttcatgtaaagagttagattcatatcaaaacagaaccgtatggcatgcttcttacaagagacacactttatatgtaaggattagtaaggcagaacataaaataatgaaaaaaaaatgcagtgtatgaaacaaccacaaaaagcaagtgttgctaagctaatgtcagacagaagagaataaggcaagaagca

SEQ ID NO: 250026 - DNA, 818 bp, Homo sapiens
gctcagagtagcagcaagagccagaaggaaagatgcaacacatttttaaacaaccaatctcatgaagacttagacattattgtgaggacagctaagccattaatgacaatttcacccccatgatccaatcacctcccaccagaccgcatctccaacattggagattacaattcaacataagatttaggggggacaacatctaaactttattacttaggatttacttcttttggggagggggtcctcagtttcttcatttctaaatcagagataataaaaactatcaaaaatatgtgttgttgtaatcaaaatagtaaaccaacataccccacaaaaatgattacatatagtaagacaaatagtgggtaattttctaactttcaaactcttctagcaccagatcctatggatatgtgattctgttaggataaaagagacacaaagatgtagtgtattcagcccatctgggttctgattttagttctgttgagaacaatttgtaagacattgttcagttgtactggccaccaaagctctaagaacttcctagctgtgtgaagaagctcaacgagatcaggggttagcaaatttttctttaaatggccaaagagtagagttcaggctttgaagagccacagggtgtgtgtagcaaatactcaactccatgattttagtgaggaagcagtcttagacaatacataaacaaattatcttgtgcttgtgatctaataaaattgtatttatgggcactgaaatttgagtttcacatttcaacttgtcattaaataatatccttctttcgacatttttcaaccttt

SEQ ID NO: 250027 - DNA, 392 bp, Homo sapiens
tttgtttgtttgttttggagatggagtttcgctctcgtcacccaggctggatcgttggcttgaacatttcttctgcatttttccataactttcccaagcagaatatcctgccctagctgtgttctccaagacctatgttctatcaataatctggctggccaaaacctcaacaaagtccctttgctcccacctcctctgcacaagtcttcagacttctccctaaaactggcagacatagaaacacatctgttgttaattcaacatgtacaagtgagaggtcacactctattccctgtacccaggaaagatagagggtgtaaattctagcttccaattagctccagcgaatacaatctctctgggactctacctatcccagaaaaaaaatcaga

SEQ ID NO: 250028 - DNA, 337 bp, Homo sapiens
ataattattttgtaagttgggtgatgggtaacaggattcattatactattattttggtttatatttgaaatttttcattatactaagtttaaaaaattaatacttgctcctctgtgcttccaaacaccaaaatacatgtgatcccatgaaatcccaagcacgctgtattggtgtcatttacaagcctgcctttctaccgagttagtgagtttcctacaggccgggatggtttcccattatttgctgcttttttgtatttcttccaggatctgactttgaagcctggcaaatagatgttaattgaataagttatttaagtaaaatggggagaggaaaa

SEQ ID NO: 250029 - DNA, 291 bp, Homo sapiens
aaatttagaagagatggataaattcctggaaatatacaaccctcctagattaaatcatgaagaaatagaaactgaacaaaccaataacagcgagattaaaagagtaatttttaaaactgcctacaaaaagaaagtccaggaccaaatgaattcacagataaattctatcagactttcaaagaaaaatcagtaccaaccttaccgaaactattcccaaaaaaatacagaaagaggggatcttccctaaagatcattctatgaagccattatcaccctaattccaaaaccagg

SEQ ID NO: 250030 - DNA, 350 bp, Homo sapiens
cagcatagttgatgttttaattctacagtaaaagtctcattaactattctttagcatgaatgagtcttctgaatagtaggtcaattttagaagtttaaacattttaaaagcttctgtaggatttgtgctggttgaataagttgattgtaaaaatgttcactgaaagtttgttcaactgaaaggaaatagacatctttaaattggtgtatttgtgtgagtgctaaaaatttgtgcatatcagcttgttttccctggggtatgaataaggtatatgtgtggatgttgagcttgattaggaggaatgattacatgggcaagacaatctttccccatagtatcctgcaaccaaa

SEQ ID NO: 250031 - DNA, 190 bp, Homo sapiens
tagttaacaaatcagttaacgtattctctgtcaaaattgtctttatacaaaaaaaaaaagtaacagctacttaaaaaattaaaaaggaaacatcaggccaggcgcggtggttcacgctggtaatcctagcactttgggaggccgaggcaggcggatcacaaagtcagtagttcaagaccagcctagtcaa

SEQ ID NO: 250032 - DNA, 423 bp, Homo sapiens
attccgcctcagagccgtcgccttacgttcccttaaacttaatttttccatcagcagtgtggatctgcttatgatagttcctacctcataaggctgttgtgagccttaaaaattaaagcatttggcacataacgcttcacaaatgctaacttgtatttacattttcacgtaaaaagattgtgatgcgcaagttctttgaagtcttggttccatgcaaaaagctgttcacagaggttgagaaaggttaggaattggtttaagttcgcggagagatagggagttgctgctgagacgcaagcaatttcatagtaccgattccctaattgcacctcgtccccagtattcatcggctcttccaggaggtggcagtcttgtccaaggtatagcaagaaaaactcagtgcaataaagtacatgcatcaag

SEQ ID NO: 250033 - DNA, 502 bp, Homo sapiens
gatcgtaattcctggggtcctaaaatacagctgttacagttacacaaccaccaacttttcatagaccttaatgattcccaaaatgctggcacgttggttgtctcaattagtcctctctacaaccctgtcaggaaggtattctatttgtcaccattttatagaggagggaacaaaaggtcaggaaagttaaataatttccccaagatagcccagctttcagtgatggatctgggagataagcccacctcccatgctcgttgtaaagtagtgctttccccgccttctcatgagatgtcttacaggggaaagtcattcttaagttaaaaacaacagcagcagcaaggcccgtacagcatgctcaggtagaaaatcacctcctagaaggagtccaacttcgggttccttcatgtagtggctcagtttgtttacctccttgcccacatttaccttcaaaaatttatcttgtaaacaaatgaaaaaaagcagaaagggctctttcaaa

SEQ ID NO: 250034 - DNA, 501 bp, Homo sapiens
aaattgggtaaagtattataaacagtagtaggaaaaaaatatactacatgagggatcattgcagtagagaaaaacactttttagttatcttctgcccataatgtacccataaagtgtacccataatgacagaacaatttgggcaaatgtgcttgtactccaggagtcctgaaggcatagttcaatgtgaccctttgagaaatctatgattctttgcagtcttcatttttatcttaagaattcatgcagattttgcatctgctactccataatgtttattttagtataaaaatatttaaatttttaaaattaacatcacttatccccactgctgtataccttgatttggaaagtaaggtggtatgcacaatcacattgaattcatagtaagtgctgagcagattggtatcttatgtttgtcgaatgtttgagttgcacacacaaattaggcttctagaacctatacaggaaaatcatcacttggtcttggacattaaaaaaa

SEQ ID NO: 250035 - DNA, 321 bp, Homo sapiens
attcttgggtctccagctctactgaattctgtgagtggggtccagtcatctgcatcgttaactacctccctagagaatactgagcacctttaagaacccttctgaaccattcacagaaatcaggagagctcttgtttttatctgcctctttcttgttacagatccaagaggtcactataaattcttatcatgcctcccctaagttggaattcacagggatccagtgaattattccttcctcctttctcccaacagaggaaagctgtgtgttcaagactaacgactctagggaggtctcaaggtaaacagtctcatcagtct

SEQ ID NO: 250036 - DNA, 339 bp, Homo sapiens
tctggcacttacacatgtattcatagagttcattctgatgctctgaacctcaagaggatgtgaaaatgacttgcctgtaattaccccaagatgaagatttattgaagcagttatgctccagcaactgccactcatttgtgctggttctactttttccccttaattgaatgtgaacatttgccacaaaaaaaaaaaaaagattctggaaatgaagttctgttagtttttagtccaataaataattttagctacgcttaatgtagcttttttaaggccttcctacgcttgaaaaaattaaagttgagcacgttaaaaccctggtcatttgtaaaataaaaa

SEQ ID NO: 250037 - DNA, 1033 bp, Homo sapiens
aggctcaggcaagggtgtatccagccctgtaacctggtcccctctaccctagaatccctggaggcctcagctctcccgccagcagtgggggactccggcagataccccctctaccagctgctgaactgtggccgtgggaatagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccgcccaccccaccccaccctccaggcccgcgaatcttggatctccggcagcatctggagggatggggccacaacccggaaaactgcccacatgtgcaggtgtctgggtgctgctgccgtggacccctggtgaagatgggcggccgcatcaagacctggaggaagcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggagttccgcaggcgcggcagttcagctggcctgagctgctgcgttctgggttgcaggtgccttgcccccgacgggatcgccggcccctaaggctctgcccggggcaggaggaagattgcaggggcgggaagaaactatttattggtgctcctgtgataccgaattaaatacggaggaaaaacaggaa

SEQ ID NO: 250038 - DNA, 1117 bp, Homo sapiens
  misc_feature (219)..(220): n is a, c, g, or t
aggctcaggcaagggtgtatccagccctgtaacctggtcccctctaccctagaatccctggaggcctcagctctcccgccagcagtgggggactccggcagataccccctctaccagctgctgaactgtggccgtgggaataggtgagacatcagagagaaggtggggagatggaagaagaggcccagccactgtaacccaccccgtctgtgttccctnnatcctagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccgcccaccccaccccaccctccaggcccgcgaatcttggatctccggcagcatctggagggatggggccacaacccggaaaactgcccacatgtgcaggtgtctgggtgctgctgccgtggacccctggtgaagatgggcggccgcatcaagacctggaggaagcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggagttccgcaggcgcggcagttcagctggcctgagctgctgcgttctgggttgcaggtgccttgcccccgacgggatcgccggcccctaaggctctgcccggggcaggaggaagattgcaggggcgggaagaaactatttattggtgctcctgtgataccgaattaaatacggaggaaaaacaggaa

SEQ ID NO: 250039 - DNA, 955 bp, Homo sapiens
taagaacacgtgggggccttcagacactctgatggctatctgagagctggtgcctggggtgggagagggggatgtcattccttgcatgctgtttggtcagcttcttccagtcatcaggaagtttggcttcctggctccagacatggctctcacagtctccttttccacccagagtctcaagccactgcctcctaggttctgaccacactgaatacctcctaccaatcttttcatgactggcactctgtacactattggctcctctacctggaaccttttccattttttttcctttattctcagcaaacagcaattccactgccagagaggtagtttcctcttttctgcaccatgcagctccctgtcaacagcttatatacagcggtttccacttgtgtctcctgtgttaagctctaagcaacttgaggacggggctcacactctagtcagtgctgtctgaaagcagcataatatgagtcaccagtgtaacacagccacataattaaagattttttaacagccacattataaatgtaaagaaaaaagtcggccgggcgcggtggctcacgcctgtaatcccagcactttgggagaccgaggcaggcggatcacgacgtcggaagatcgagaccatccttgttaacacggtgaaactccgtctctactaaaaatacaaaaaattagccaggcatggtggcggatgcctgtagtcccagctacttgggaggctgaggcaggagaatggcgtgaacccgggaggcagagcttgcagtgagctgagatagcaccactgcactccaccagcctgggcgacagagacagactctgtctcagaaaaatattatcatttaacatgtaatcaacaaagttattaacaaatattctacattcccttgttgggggtataatcttttgaaattaatgtgtattttataccttacagtgatcttgattc

SEQ ID NO: 250040 - DNA, 405 bp, Homo sapiens
ttttgggtttttctttatttcttctaaacctataaatgtgatggataatttttataagtagatataatattactaaatatataaattatttgttgaatgaattcatgaattaataaaagagtgatgaaataactaaatgaaaaataaatgcataggttttaaaccctctgatctgtgtatgatagccccttccttttattcacttctaaaaacacagatgatctcattgttccacatttcttgtgatgtttgccataacgtcagcaatggtgtgatatagaaaatagatgcctactataagttggacctgctataaaatatctcattgtcatctcataaaaatattttgaacattatatgtatattatacttctataaacaggttaaaaattatctactgctgta

SEQ ID NO: 250041 - DNA, 443 bp, Homo sapiens
ttctccaaagaaaagtggctagtttttatatcaccacttttcagggcatgctgaggctttgaacaagtcagatttgtttttcttctctgtcaagcactttctcatacattactccattgatccctttaacagccttaccagggagacacaggggaattatagtcaccattttacagatgagaaaagtaagacccttgattcagcgacttaccaaggatatgcagctagtaagctgcaaatcaagattagaaacccaggtgccctttttctgaattccattctgctgcttactgctctgaactactttatttcatgatgtctaaagaccttcacacgacatagactatacttgcacagactcttagttgcataaacccctgggtacttggtatattttaaaatgacttactattcaagtatacagttctataatgctgtactct

SEQ ID NO: 250042 - DNA, 761 bp, Homo sapiens
gcggtggctcacgcctataatcccagtactttgggaggcccaggcgggtggatcatctgaggtcaggagtttgagaccagcctgaccaacatggcgaaaccccagctctactaaaaatacaaaaattagccaggcgtggtggtgggagcctgcaatcccaactactcgggaggctgaggcaggagaagcgcttgagcccaggaggcggaggttgcagtgggccgagatcgcaccattgcactccagcctgggcaacagagtgagactccaattaaaaaaaaaaaaaaaaaaaaagactcaatattgttaagatgtcagttcttctcaacttgatctgcagattcaatgcaatcccaatccaaatccccagaagctattctgtgaatattgacaaactaaagtcaaagggtgtattgaaaggcccaaaacagccaacccaatactgaagaatgacaaagtgaaaggactgatactactactcccctttaagataacacaaaactacagtaatcaagacaatatggtattggtgaaaaatagacacagacatcaatggaacagaataaagcacaaaaacagactcaagagccagcctggtcaacatagcaagaccctgtccctataaaaaatttaaaaattaggctgggcgcggtggctcacgcctgtagtcccagcactttgggaggctgaagtgggtagatcacctggggtcaggaattcaagaccagcatgatcaatatgctgaaaccccatctctacta

SEQ ID NO: 250043 - DNA, 373 bp, Homo sapiens
atttccctaatgactaatgattttgaacatcttttcatgtgcttattgctcttttgtatgtcttgtttgaagaaatgcttgttcatattctttgtccattttcagttgtgatatttgttttttatgttattaacttatattagttctatataaattctatgtacaagtattatatcaggtatattattagcaattactttctcccgttctgtgggccttcttttcacttccttttttccttatttaaaagtatttcattctcaaataatgattgaatctatttaaggtgtataacatgatggtttgatatatgtatatattgtacgatgcttaccacaattaaattatatcaccacccatgctgtacagagcc

SEQ ID NO: 250044 - DNA, 368 bp, Homo sapiens
ctcaacctccctcccaccgcctgctgccaagggccgccaagagaaatgtgggcaaaccacacggaccaccccaggcctcccaagggcacttgggggtgatgccagccccaggaaggagtcctcaataaagatccaaggtgctaacaagaagatgtcaatccattaactccacttgaagggaagaaaaaaaatgtcaattactggtaatgtgaaacaaaagagtgggaaatcgcaaatgacagtctttttaagacggccctagggccacttccagctgaccctgtgcattaaccaagcagggagatttttttccttggctgctccctcctgcgtccctaatagcataaaataaaaagattttagataag

SEQ ID NO: 250045 - DNA, 435 bp, Homo sapiens
ggttattgtctgtcaggttggtacgtggagagtcatctcactaaatgatcacaatgttaatgaattaattaagacttcaaacaaaatcggattatgtattgctggtggaaacgtgaagtggtacaggcactgtggaaataatatgttggttcctaaaaaaattaaacataattattaaataatccagcaattctacttctgggtacatatcacaagaactaaaagcagagactcaaacaaagtatttgtacagcaatgtgtgtacatccttattcacaatagccaaaaagtagaaaagccccagtgtctatggatgaatgaatgaataaacaaacaatgatctattatgtacaatgaatttttttcaccacaggaacagatggaaatctgatacacactcaactacatgtgggtgactttgaaacatatgataat

SEQ ID NO: 250046 - DNA, 572 bp, Homo sapiens
aatctccaggtatgtgtacaccatattgatcagagttttacattaatgaagatgcaagttacttgtgcattctagtgagaggccaggttttcctgctccccttttattgtggagagtggggaaggaggaagtggtcaaggcagtggcctattttccttcccaaggtagtgtggcagaggctattcttgtctcctataacctttcaatcctccacctgtaacttaactctatctgatctcctaagcgaagcatgtggctatccattatagagatgtttcccagcctctctgcagctaggagtggccatttgactatgttctggtcaaaacatatgagtgtaaatgatgtgcaccttcacaattcttaccctttccctcttccctttggcggcaatgaagatgtatataattatactactttagttttttatatgagaaaaaaagaactgcgaacttgtttcagccattattttgggcagcagcccaacttacatcctagtgaatatagagagatagtgaacatggtctgaggcactgaggttaaggaattttctaatatggataaaaaagaaa

SEQ ID NO: 250047 - DNA, 113 bp, Homo sapiens
aattttaaaaataaaataaaaatcatgttttatgtgattcatgtttctcctaatgcaaagaagatgggtactattaataaaaatatttttaaaatgtaagggctaaggagcca

SEQ ID NO: 250048 - DNA, 1869 bp, Homo sapiens
  misc_feature (1111)..(1111): n is a, c, g, or t
  misc_feature (1147)..(1147): n is a, c, g, or t
ctcagtgttaagaggtggcgacttgctcaggcttctaaaggacaggtgtttgggagcctcttgccggaagcctgctgtgggggccctctgtccctgctcctcgccggcccccatccccaagggtgcagcagaagccaggttttccctgtccctgtccgggctgtctctgttccttctattttgctgattttcagaaaaactagatccggcacctttgtggtgcacagtccccaccagcgggaaccagtaggtgacaggctccattcaacaggacaggcaggttagggacacccctggctggcagcagccgttcctgctcctacccagccccggttactccttctgggacctcaggcaagtgacttcgcctcccctcactggtctcccctgtgaacaggggctccagctgttcttcctgcacaggccatcgagccagtaaaatgaacttggcacccagcgcatccatacggagggtcttggagaacaacttctcttcggaccttagagtttctaaggtgattctagaattccatgccggcaagtttggcaaactgcagcttcagggaatagcccctacaagactaccctcactgcagaccaagaactgcacaccagaaacaagctcaggcatccctaggaccaccctcacgtctgagcaatgggctacaggtttgggggtccttacatccaccctcaggctcattaattcacctgcatgactcagacagtttatggtgaaaggaagcaggttaaagtcattgatgaattctagagcagagtccaggagagcccagtcacggagctcccgtgtcctcaggatgcagcacaacagaatagagctgaacagggcacctttggggtccaggtgtgtctgggagcttgaccacctggctgtcagcgtggctggccctaagtctccagtccctcgcagaggtcagaactgaggcagcaaagcccctgaaaacgctggtactccagtgccagccaggacgttctgggggccgagagctcaccctgcaggccacccccggccccggccccagcgttctcgcagtggaatagtcacgtttgtctgggcagctccttcagcgttgcctgcttcctcccttgnggcagggctgcccgtgcctatgaagcatgtaaaganccaccgtgtgcaggcgttagcccggggttggctccacctagctcttccgcaggtgtcattctccatcgttgctacatcctgaggaggctggaactcagggtttcaatacatttgccatcaccatcaacgttataaccttatcaaccgtgccaggtaggaccatattgcagtctggtggatgtcacctaaaaaggaagaccggagtcccactcagtcatagcagtttatctagtccatcaccacatcagatcagcagatgtcccccagggcgaggccactcaggtttgcaggctgccattcgaccttgtcaagttccaaaagcagaggcggccttggcgtcaccctttcaggcatctggtgtagttgagctgagacgatgccctccacgccgctcttaaggtagtactgtaatgtaggattcacgtaaaattggatttcccggccgggcgcggtggctcacgcctggaatcccagcactttgagaggccgaagtgggcggatcccctgaggttgggagttaaagaccagcctgaccgacatggagaaaccccatctctactaaaaatacaaaattagctgggtgtggtggcacatgcctataatcccagctactcaggaggctgaggcaggagaattgcttgaaccagggaggcggcggttgtggtgagctgtgattgtgccattgcactccagcctggacaacaagagcgaaactccgtcgc

SEQ ID NO: 250049 - DNA, 362 bp, Homo sapiens
gcaatgacgtgggacccagagcctgagttgaaagcccagctctgccactcactagctgtgttattcacttgctgtatgtcttggtttccccatatgtccttacctgtaaatgggaaacaataacagtggggcttgttatttgcaaagaactcagtacagtacctgtgtgtctgaggattctaatgtgcaaccaaagatgcaaacccctgctgtatataatcgatcctgttgatcaaagtctaacaagttctcttttctttttttttcttgagatggagtcttgctcttgtcacccaggctggagtgcaatggtgtgatcttggctcactgcagcctgggcgaaaaagccagactctgtctca

SEQ ID NO: 250050 - DNA, 335 bp, Homo sapiens
cctgacctcaggtgatctgcttgcctcggcctcctgaagtgctgggattacagatgtgagccaccatgcccggcctcatttgaactccttaatcatcaacaagagatgaggtgtcgctatgttggccaggctgatcttgaactcctggcttcaagagatcatcctgcctcggcttcctaaagtgctgggattacagaggaaaggccatgtgaggacacatcaagaaggtggccatctgcaagccaggaagtgaggcctcaccagacgccagccctgctgactcctgatcttggactttcagcctccaggacagaaataaatttctattgtttaag

SEQ ID NO: 250051 - DNA, 482 bp, Homo sapiens
ctgtagtgaaggcatttggtgggtagaagttgagcatgactatcacttcgttctggtaagcaagggtagctaatgcatatcttgcttccttgtggctaattcagaataggagaaaaaggattctgggcagaaagagaataagaatacgtaaaaagcactattttgtaaacataccaaatttttctgatgtttcctcatcaggaaattgctggccttcaagatttaatatcttcagagaaataaaatttggcaaactggcaactatgaaagggaaaataaaaatttagttatgtcagctacatctctcacagcaaagtgtaacatctttaaaatgaagaaattagaaattaatgtaataattcagattgaattcatatgactaagtagataaaacaaatttttgctcagaaaataattctgataactagaaatgttgttaaaattctagaaatttcaaatccaactgagcgtaaaggtaaaaa

SEQ ID NO: 250052 - DNA, 581 bp, Homo sapiens
gaaaatctgtttaattatttaatgcttattaaaccctgagtgcatttatattgcacaaacacatcctctgcttaatgctctccaggagttatggaggattcaaatcaaattacactgtcctttcctcatggtataattaaggagcaatatgaaatgattagcgtacaaaattaagttagttttcagatgataaagacaatttttttctcttttgaaatcaccgttaaaacaatcagggaaactccattttttgaagaaagtagagaacatctgtgaataggaaccacaatatgaagacagaagttggatggagaaatggcagatgacatatcagagtggagagaagtcacactgtcctggagagggaagaaatggaagaagccagtggtttccttgatagaatcctaaaaaggctcaggaattagagatgtgataagctgaggaaggcagaggtgaggaaggggctggtgtggagagtgtttctaagtctgtctaaggaatatgtggatgtagagattcccaccccacaccaggcaggtaagtgagtgcccccttgtgcctttgccacagatgagaaaata

SEQ ID NO: 250053 - DNA, 880 bp, Homo sapiens
gggcaacagagcgagactccgtctcaaaaaaaaaacaaaaaaaaacaaaaaaaaatgaccattactcaacaaggtaaaatctccaatgtctggcatcctggcatcctattactaggcatataaataagcaagaaaacacagcccataataacaaccaatcaatccttattttgatccaaaccaaccccaaactgacacatattaaaatgaacagagaaagacattaacattaattttaactatatcccatatgtttacaaagttgagacatggaaaaatattagaagaaataatggccaaaaattttccaaatgtaatgaaaaatataaacccacagacctgaagctcaatgtcaagtacaagaaatacaaagaaaactgtaacaaatcacataatcaaattgctcaaaaccaatgatatagatcaaatcctgaaggcagctgggaaaatagtacatgttattttacacaggaacaaagataagaatgataccaaatttcttgccagaaatagtgcaagtgagagacaacagcagtgcaacttgatctttaaagtgctgaaggcaaaaactgcaaacctagaattttatgcccaatgaaaatatattttaagaaagttaaataaacatattttcagacacataaaagctggcagacactttgagaggctgagctgggcagatcgctcgagccccagagttcgagaccagcctgggcaacatagtgagaccctgtctctaaaaaaaaaacaaaaattaggccgggagcggtggctcacgcctgtaatcccagcactttgggaggccgaggcaggcagatcacgaggtcaggagatcgagaccatcctggctaacacggtgaaaccccgtctctactaaaaa

SEQ ID NO: 250054 - DNA, 828 bp, Homo sapiens
gggcaacagagcgagactccgtctcaaaaaaaaaacaaaaaaaaacaaaaaaaaatgaccattactcaacaaggtaaaatctccaatgtctggcatcctggcatcctattactaggcatataaataagcaagaaaacacagcccataataacaaccaatcaatccttattttgatccaaaccaaccccaaactgacacatattaaaatgaacagagaaagacattaacattaattttaactatatcccatatgtttacaaagttgagacatggaaaaatattagaagaaataatggccaaaaattttccaaatgtaatgaaaaatataaacccacagacctgaagctcaatgtcaagtacaagaaatacaaagaaaactgtaacaaatcacataatcaaattgctcaaaaccaatgatatagatcaaatcctgaaggcagctgggaaaatagtacatgttattttacacaggaacaaagataagaatgataccaaataaaggatttaaatcccaaacagatcaggaaagtacattaaatgcaaattatctaaatactttcatgtaaaaggagttagattcataatcaaaacagaacccgttattggcatgcttcttacaagagacacacttgatatgtaaggattagtaaggcagaacattaaataatgaataaaaaatgcagtgtatgaaacaaccactaaaaagcaagtgttgctaagctaatgtcaaacagaagagaataaggcaagaagcattattagatatgaaggaaacatttaataatgataaaggcttgtattcattagaagagtttattcaacagattt

SEQ ID NO: 250055 - DNA, 458 bp, Homo sapiens
gggggtctgtgtgagagggtcgtgatcaattgagcaagcagagggtatgtgactgggggctgcatgcacctgcactggtaattagaacggaacaggacagggatattcacagtgcttttccatacaatgtctgtaatctatagataacataaccgattaggtcaggggtcagtctttaactactaggcccagggtgtggcgccgggctgtcttcctgtgggtgtcatttctgccttttagttttcacttttttttttctttggaggcagaaattgggcataagacaatatgaggggtggcctcctcccttagttacggtatagtagtagaaatttagactatgaaaagtacttaatatttagaggcttgtcatatattttgtgctttatttcttaattctatgttatgtatatgtattttaaatatataatttacttctcattgatatatcttatttt

SEQ ID NO: 250056 - DNA, 240 bp, Homo sapiens
gttctgggcaaatgaacagtagttctcaaactttttgactcgtgtgctcttcatgttttgtattctcatctctgattgcatatccttacccgccagtaagatgtggccaagccttctacagtctgtaccacaaagataaaagtgtagggaatatactttttcaaaccatacatgctactccgataaccctcctccacagagaatcacttaactgagagcaattagtcatctttctcacta

SEQ ID NO: 250057 - DNA, 478 bp, Homo sapiens
aataagactcaaatgtccattcttcctcatgactctcaaaaggctacaggtgactcctatgtttacctgcttattaaaatatatatatatataaaatctggcattttttaaaacagtaaagaagactttattcacgactattgcagtaggggttaacttcactgcaatagaggagagagatgaggctcaagcccaaatacaagaaaaagtgaggatttgcaaccaaagagcagagtgaggaggttaatgaatgtaaaatatttaaaaggagaaatcacaggtagaaggattcttgctaaactggcctaacatgattctccctttaaaacaggtcaagaacttatacatcaaaggtaaggatgaagaatttgatcagatagcaagggtggagggtactcttgctaaactgacttagtggggttcttgttaaagtggaatctgccaggacagacatggaaggccaaagccaaagccattt

SEQ ID NO: 250058 - DNA, 351 bp, Homo sapiens
taaggctaggagtttgagaccaatctgggcaagatagcaagaccttgcctctacgagaaatttaaaaaattagccagggtatgtgccacactgccttgcctgggcactgatacctgaacgctgagtttgggcccgtggagatgaaccctttaactaaggtgaagctgatcaatgagctgaatgagcgagaggtccagcttggggtggccgataaggtgtcctggcactccgagtacaaggacagtgcctggatcttcctgggagggcttccttatgagctgactgaaggggacatcatctgtgtgttctcacagtatggggagattgttaacattaatctcatgtgggaca

SEQ ID NO: 250059 - DNA, 347 bp, Homo sapiens
tatatttggacagtgctttaatgctgccggttgtaaaggcattgtcttggtattagaaattgctggaaggcagccatagtcccaaatagcaaaaataagctggtttctcaagttgttacttaggcattaccctagtcacattagaatgcttgaacaacttgcaagaaattataagaaaagtgcaaaagtaatcaagtcttcagggaagcatgccaaggtgcagatgaaaagaaggccttctctgctgactgccccaccacccatagcttaggacatctgctgatagatgccataaacctggaaatggttacccccatgggctgtgtgttttggaaagcactctatta

SEQ ID NO: 250060 - DNA, 636 bp, Homo sapiens
tttacccattcttttttttttttgagttggaatcttgctctgtcacccacattggagtgcagcggtgcaatctcggctcattgcaccctcggcctcctgggttcaagtgattatcctgcctcagcctcctgagtagctaggaccataggtgcgcaacaatgcacttggccgagttttgtatttttagtagagatggggtttcaccgtgttggccaggctgctctcaaattcctgacctcaggtgatttgcctgccttgggctttcagagtcctgggattacaggcatgagccactgcgcccagccttatatttacccattcttgaatgaaagagattgattcaagcccaatgtttgtcattaaaccatttagttatttgtgattaaatgtctcttgttagatcttaagctagtatttggatgatgtgtaaaagtattagcctgattttggattgtggtaattcaggtagcatcagctctgctgaactataatctcctactgtttataccgtgcttaaggaggataattttttcctgaataacttgaggcattttatatttcttcctgtgttagaaacagtgcatataggcaataatagatactggggaccactagagggaggaggaagaggagtgg

SEQ ID NO: 250061 - DNA, 399 bp, Homo sapiens
ttggggcttgcaccctctgaagcaatggcctgagctgtacattggccccttttagccacagctgggaagcagggttccaagtcccaagactgctggctcacaaaaccatttttccccctaggcctccaggcttgtgatgggagaggctgctgtgagtacctctgacatgccctggagacattttccccactgtattggcaattaacacttggctcctcattatttatgcaaatttttgcagctggcttatctttctcctcagaaaatggatttttctttgctattgtatcatcagactgcaaattttctgaaattttatgctctgcttcccttttaaatataagttgcaattccaaagcatgtatttgtgaatgaataaaattgaatgtttttacaagc

SEQ ID NO: 250062 - DNA, 351 bp, Homo sapiens
cagttagagccacgtgcacttaagaaatgggatgcaggttgccttatcaattaaagaatgttcaatgcaggccgggccctgtggctcacgcctgtaatcccagcactttgggaggccgaggcgggtggatcacaaggtcaggagttcgagaccagcctgagcaacatggtgaaaccccgtctctactaaaaatacaaaaaattagccgggcatagtggtgggtgcctggaatcccagctactcaggaggctgaggcaggagaatcgctagaacctaagaggcagagattgcagtgagcagagatcacgccactgcactccagcctgggcgaaagagtaagactccgtctca

SEQ ID NO: 250063 - DNA, 643 bp, Homo sapiens
ccaagtccggcgtttaaaccgcggccagtgaattgaatcgactcacatagggcgaatgggtaccgggaccacctcgtccaggagaactagtacatagtttttttaagaatagacaaattaatcagtaagtcagaatgataaaataaaaaaagaaaatctgagcagacacatataacttgtaattatattgaatcaaaaacttcccaatgaagaaaagccaggaccatatacatgacttcactgaagaattctaccaaacactgaaagaattaataccaatccccctcaaatgcttccaacaaactgaaaagggaacattttcaaactctttatgaagccagcattatgctgatatcaaagccaaagacaccataagaaaaaaactatagaccaatattccttatgcatattgatgaaaaattctcaacaaaatactaccaatccaaacgcaacagtaaattaaaaggattataccacatgaccaggtggtatttatccctgggatttgagcaaggttcaacatatattaataaaaccaatccatgtgctacaccacatcaacaaaaccaaggataaaaatcgtatgagggatctcaattgatgcagaaaaagcatttaacaaaatccaacacctattcatgat

SEQ ID NO: 250064 - DNA, 205 bp, Homo sapiens
tacacttttaacaggcatttttatagcaacattgttttgtttttgtgtttgagacagagtctagctctgttgcccaggctggagtgtagtggtgcaatcacagctcactgtagcttcgacctcctgggctcaagggatcctcccacctcagcctcctgagtagctggggcccacaagtgcatgccactatacctggctaattttt

SEQ ID NO: 250065 - DNA, 262 bp, Homo sapiens
tgctcccctcccccttcttttccttcttaacagctggcccgaagaacctaaacttagcaagggcgaggtgtaggaaactagatagtgcattctacagttggataggaaatactgggctcaatgtgtttaaggttaagattaattcctcacttcctccgaatctattttaaaaacagagcaaaggatggcatatgctttcttctaacaaaatgacagatgatcaaaggataaacatgatctgcatgtaaaaccctctgactac

SEQ ID NO: 250066 - DNA, 395 bp, Homo sapiens
acttgagatgtttgatacaggcatgcaatgcataataatcacatcatgaaaatcacattccctcaagcatttattctttgtattactaacaatgcaattatacaattttagttactttaaaatgcacaattactgactgtagtcaccctgttgtgctatcaaatactaggtcttattcattctttctgattactttttgtacccattaaccgttacccagccaactttaattttttaaaattagaggtaatgcaaaagtatctaataactcaaaatttacagaatttcctgagttaagaaaaaaattcaaaagtgatgcttgccttttcgctttcctaaagatgtcatttgaaaacaagtcttctgttttgataaagttaaattaatccatttca

SEQ ID NO: 250067 - DNA, 404 bp, Homo sapiens
ctgtaaaattttgagctagctctgcccctttctgtactagatacaatcctggatgtagagaatcagagacttgaggttaagacctagctctggcaccaacttggacaagtcacatcacctatctccacctatctccttcactgtgaaatgagaggattggactaaatgatatctaaatctcccctggcctccattgtttctgctttgtggatgccgttttatggattgagaaatcaaagtctattgatgaaaatgattgcaatgtgcagattcacttggaacacagaaagactcagagagctggtcagtaccaaaggaggttggagtgctttgccttgaatgcaagaaataacgatgtgcaatgtcatggagaactttaaaacaataatagatacaagaaaaag

SEQ ID NO: 250068 - DNA, 652 bp, Homo sapiens
taagtcaaggccacatcctctttgtgccatcagggaactgtgttatcagtcaacttacatacttattgtggcccattgttccatttcaggtgacatggaggattttgtgagtcaagttaattgagcaaactgggaaatgggttgttcttacacaggatgtcatccataactaagacctcactgtaagctggaggaaaagtttattacatttgagagaaaattatatgttctttgaaactgtatgcagttgtagtgatttccttgagacatgcaaaaaatgtactaggtattcattttgactaagctcactgtataacttcatttttgaaaacaagagttaaaaaccagacaaacacatcagtatgaccacagtgttttcctttaattttagttcactgggcagattttcttgacaaagttagtctttatgaagagtgctaaaataagcaaacccttcccttctgatctcataatattggaataatcttttataatctttaaatatttttctagttcagtgtaaatcttaaaatgacactcaggcattgaatagaatttgaatcatgcctttatttgctgctgaaaattgcctttagatttctgtgtatgttaaggaaatattgcctcccacccaccatcaccagtatttatg

SEQ ID NO: 250069 - DNA, 285 bp, Homo sapiens
gcccaggaggtcaaggctgcagtaagatgtgatcgtaccactgtcctccagcctgcatgacagagcaggaccctgtctccaaaaaaaaaagtgtgtctgtgtgtgtgttagaaacatttttctaattttatttaactccttacaagcctatggaaacctggcaatgtaattgtcttttactgtgtatatttgttttaagttctccttctaagaattcctatctagatttattttttcatgttgttatttttttcttttttactttttatttggatataattatta

SEQ ID NO: 250070 - DNA, 136 bp, Homo sapiens
cttacatgattttgtacatccaaggtaaattcagaaactatttattgttgagggtaaattgaacaccttcggttttaaccttgtaatctgtacttcccagagcctctcaggagcacctacaatgggagagaggaga

SEQ ID NO: 250071 - DNA, 411 bp, Homo sapiens
ggagtcttactctatcgcccaggctggagtgcagtggcatgatctccactcactgcaacctctgccgccaaggttcaagcaattctcctgcctctgcctcccgagtactgcataataaatacatgattacatggttcagacttgttaagaaggcagttatagatgagcgaaagattcaaacatcaggaaagaaatcagagaatgatacagatggaaagttgctaaatactgacaaatggtatcccttggcaggagggctgtgggtgacttgtttacttcactgatcttttctgattttgtttctaaatttcctataagcttaaagagtcaaaagaaacatcaggaaacaaagttgcttatgcattataatcaagagttttttaaaagatgactacgtaagtactgaacaac

SEQ ID NO: 250072 - DNA, 392 bp, Homo sapiens
ccttgcatccttcaatccaatcaagttgacactcggtattaaccatcataccctcttaagtggatctccctcctttgtctctgttatcacatttataatagataattcacatttgggatccacattttttagacatagattaagatagtgtgatgtacttgactaagaaatgcaccaagctaacatagcttctaaaagtgagtctatgatcatgagactttcttctcacagccatttcgtaaatgactggcaaatgaagtctccaaattatatcatcactgtagggatgccacagaagtaaagataactactccagtaaatatggtgggaatatggtgtttccctatattcttcatctaaggattatattgctctaataaataggtcttaat

SEQ ID NO: 250073 - DNA, 433 bp, Homo sapiens
tttatcagttctattttggaaataaactttcaagtatggcagctatggaaggtgttgaaggcattccagtgctatttgtggcctggaatcaaccagatgtgtttaggcttggcactggctttaagttccaaacactggttagaaactgcctggaatgccaaaggaaatacagcattccctagctgaagagtattttaacactcaacaagtggctgacatcttatggaaaactttagagggaaaacactatttggaatcagttcagcctccatgatatacaccctcctaatttgtattttctaatggtttcttctctgatttttattcttagactcctatgactgataagacagtcttgacatcctctttcctctgtttcttccactccctcctaacttggcagtttgctcccatttaagacctaagatcccct

SEQ ID NO: 250074 - DNA, 644 bp, Homo sapiens
ttagctaaattaaccacccgttaccgtccaagccttcctgtggacattgcaagctttcagtagactccagagttccaaaagagttctaagacaaattctgcccatgcacttgttaattagttggggagatggattcctggcgctttccatctgccatttaccagagtactccagaatcattttcaaacacgtttctttctgtcaagaaatcaagtcttggccaggcatggtggctcacgtctgtaatcccagcactttgggatgccgaggcatgcggatcgcctgaggtcgggagttggagaccagcctgaccaacacggagaaaccccatctctactaacaatacaaaattagctgggtatggtggtgcatgcctgtaatcctagctactcgggatgctgaggcaggagaactgcttgaacctgggaggtggaggttgtggtgagctgagattgcaccactgtactccagcctgggcaacaagagcgaaactccatctaaaaaaaaaaaagaaaaggaaagaaatcaagtcttgaggcatcatcattgttatatcatgtgcaggtgtctagcctggatgccacccagctatgccaaatgcggggagaaactccctatgggcactgtggctgggtccagagctc

SEQ ID NO: 250075 - DNA, 437 bp, Homo sapiens
ataggcttgaagcagtcacttagtccctctacgttcaattttgttatctataaaatggactgaactctccaagagagcaaatgcatgcaaactctgattgttagtaactgtcaggaatcctgggttaagtaggaggcagaggccatatgcaggtaggaaataatgttatgatctgtctcttaataaagaaatatatttggcatgcccagacaggatgacatataaagctcttttcaatgtagcatgctatgacactaagcttattgatcaccaattagcaatggtttgcaacctttttccgattgacatttaaaaaacacacacatgaaatcacacaataatcaagatgtttagttccactttggaaaaactgaaagtaagtggttttagttggggaaaatatcatgaagaaactcttctgcttttttgtagaagat

SEQ ID NO: 250076 - DNA, 379 bp, Homo sapiens
gaagaagtggcaaaatgtgaaaagcaagaagcaagtattaccagagacacctatgaaaaagaaatctttctgaagaacatttttaaagtgccataatctgttcgcactgcccatacttctgaaagcagtactttcattttcaactcagaggttgagcctggtttctcaactcaagctgcatattagaatcagctgggaagcttttaagaaatcccaacagccaggccacaaaccagaccaactaatgcagaacctctgagggtagaacacagctcatggcccatagtgttggtgaggccaacactatagctgcaagcacttacttcatttaagaagtttatcgagagctttataaataaattctgttctccatctacta

SEQ ID NO: 250077 - DNA, 400 bp, Homo sapiens
catctggaggtggtgatccaacaagacaaaggcatcagtgttcctgccatccatgcttaatttgctttgaatgtgctcctagcagccaaaaccaaacaaaggtacaaccattgaaatcataaaaccctgtttcccattctaatctggttagacaataccgcattcaggactagggaggctctgccaggaggcaggagagggataaaagagaattctcagagccctacccagcccacccaggctcccacccacacctgtattaggccaaaagcagcactgatggtccaaagagaaaaccaggcagcaggtcccctgcccagaaggaccatcctaacacaaacttctgcttagccgaccctgaagaaccccaccttatccctgaaagctttctcttgtgctc

SEQ ID NO: 250078 - DNA, 474 bp, Homo sapiens
gaaattattccaacccctggctgaagtgttaattataattcactgcttagcatttcagcctccacattggcattacctacaactaataggaagatagaaaattctcttttgagtagctaccaaggtacaaggtaggtgctcagtgtctcaacatttatgagaagttgtcaaagcgaccgaactgagagcattcaactgaaggaccaatttgcatgcaatttgagtcttaaaggtacaataattttaaatagagggagtcagtattttaaacagtagcccatctatggttcaggtaccaaatgcaacaggagagtgagcccatctgactcatgttagtctgaggaaatgtaactggaaagaataatacttatagcattacttttttaaagaattggccaggtgcataaggccattataaaaggcattagtgcaaagaaaaatactgaaaaaaaggaaactttcttaaataacaaa

SEQ ID NO: 250079 - DNA, 499 bp, Homo sapiens
agataaggaaactgaggtttagcttagttaaataacttgcccaaagtcacagagtaagtgatagaaatggatgaaagtcaaacccccacaatctaactcagagcctataccatgttattccatgcaatattttattttattttatttttcttagttcaaaaactacttagagtaaactcacagtgaagataaattcctgatggcagactagagtacaggaaagcaaaaggagccctcccactaaaacatatatcgcacaaaggaagtagagagaagtgcagtttaaggtcaagagatggaagatatcataatatgctgccaggctgcctttgtgtaaattctataaagaaattatttttcaaatattcaataaaaagcaagtgttatttaaagacatggccaggtagaatgacaaatggcataccatttcaatttttctcaggcacgcaagttttagctgaataaacataaaagaaatcaatctacatggtgcaaatgt

SEQ ID NO: 250080 - DNA, 425 bp, Homo sapiens
aggtggtatctatttttcctctattgaatcttggttggtcgtttgatttgcttttaccagtagaatgaggcagaaattacttctgagagtaagttttcagaggtcttgtaacttcctttttcactctcttaggaaggctcagctaccatataaagcaatctagactgtcatgctggtgaggctagatggaaataaataccctgaaggttggtagaatgcaaaactacaaggagagaaaagctctgaaggataagagcctatgaggaaagagaggtttcagcactccagccatcctagctatagggtcagatatatgaagtaataatgatactccaccctcaatagggagcagagaaaacccatcctaattaagcttcttcaaattcctgatccataagataaaataaaatggctgttgtattaag

SEQ ID NO: 250081 - DNA, 508 bp, Homo sapiens
tgccattttcaaagccgaggtggcgaggtgtcaggctgcagattcggacggtcattctccaaggctggatttgcaggtcaccacccggtacctatagacagagggtccagcaggctggttagcagacaccgctccagttctaagacgccagcagtgggatccacgtttaaggtggatgcggctgaaatgggaattatccccccacaggctttgctgtacagttctaagaagccagcagtgggatccacatttgttaaggtggatgcggctgaaatgggaattatccctccataggctttgctgtaaatgaccaggtcctttagaatgtacaacctctcagtgctgctgcaagctgggagctggatttctttctgtcttctttttaaaatccgttccttgtgttttcctaaatagccctttaaagagaaatgcaaccccagggctgctgaatgccagggaagactcccccaccccgcagctttgaactcagcaaaccaaaaaaaaaaaa

SEQ ID NO: 250082 - DNA, 827 bp, Homo sapiens
gggttcgaaggatctatctaaagaggagaacaaatttcttctggataattctactggaaacagagtggaacaagggatgaaggcagagaggaaggggaagaaaattaagatacaaagggaaaagttcgtcatcatcatcatcattagacatgtctcaactgggtttcagatcagctaaagagagatatactgtatcagcttacagtgaggagtgagtctgatcaaatcttttcctcttggcgtatggctgagctttggacccagaaaggatggttgccccttcctagaatagacacatccagttgagtgttcaaggggagcatggaccccagatgtccaaaagggacatgagggaggaacatgagccacttccctgcgcagctcctaggtgtacctgaatgtcatcgatgtcactaataaatgcagtaatatatccaggaatgctatgtatatcagatacgggagtgtctgtcatcttcttttaagaggtactgactttttggaaatacaaaacaatagtcttatcagtgtgtctatgaaaaaaaaccaaatgtagccacctacctgcacatcccagaggcctttggaggacatgtgagaaagggggctgacaggagcttcaagtgtaggagaagaggaaactatcctccttccctcctcatagtcatcgaacaaggaggactcaaaacaatagttcacttgtctgtcacttctcaccttcctcagtggttccagccctcattgcagaatctagggtagaacaattgttgggacagctgcttgtgaaaaggagaggcagttctaaataaaagcagtttactcaacac

SEQ ID NO: 250083 - DNA, 426 bp, Homo sapiens
attaatcacactccctcccatgcagtttcaaacatgtcttccaactgtcttaatattatttttacaaatcaaatatttgtcttttaaataaatgtatagaattccttttgctctgtgaaggactcatttactctcattgtccaaattagtatcaatctcattatggttatggcatacttatgtcccttggttcatcagaaagataaatagatatatgcattttagaaagaatagatttaggtggatgtgtataaatggtatatttacatttactatttgtgatgtgatgactaatctacatcacaaatggacaagttcacacatcaaagagggaagaataaacaactcaccttgaagacaatggcctaaagtaaaaatatcttaactaaatgttttcgactgtaaataagtggtataaattctgta

SEQ ID NO: 250084 - DNA, 377 bp, Homo sapiens
atgatatttaattgtgataataataatctaagctgttgagggcttactttatgctaggaactgtgctaagcagtttacatgaggtggctactgccattcctgttttgcagatgagagaactgataatcaaagattaagaaactttcccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagc

SEQ ID NO: 250085 - DNA, 336 bp, Homo sapiens
ttttccttgaggtgataagctcactttattcattttaaagaaaatgtctgccagatgtccacgtctgaaattccatagtttaccagtcatcctaaaagtaccaacagggttccaggaaagaagcagaatgctttatatgtggatttaatgttactccacctctgtaacattaaaaaaaaaaaaattagccaggcatggtcacgagtgcttgtagtcccagctacttgagaggctgaggtgggaggatagcttgagcccaggagtttgaggctgtagggagccatgatcatgccaccgcactctaacctgggtgtcacaacaagatcttgtcgctta

SEQ ID NO: 250086 - DNA, 755 bp, Homo sapiens
acagccctccactgccccctcacaatatcaaatagccaggtgacagttcttttcctgtgtggtacaagaccctacatttgttatcttgcaggcaatacaagagggcctctgaccaggggaccctagacagaacaggagcagggaatactggatggaaaagaaaggattctgaatgttgagtcttcagcctttcttctcattgtacagttttggtagccaggcttatatttatatccccaggggtcagaatggaagattcttctctggggaatctgactgccaaattgtaaggacccaaagataatgatattggaggtttcctgtgtaaattatctagcaagattgccatacacagaaacacaaagttgacaagctccgcctatgagcacagaacctctgattaattattttatgccttattttaaaatttgagcacaggacagtttgtcaggcatcttcagaaaacctcatgagagagcaaaacaaacagaaaaatcaattatgacaattattcacagttaaaagctaaaagatggttttatctatgagactagaacaaatttctatttaaagacttagaataagagcttttggaagtaacatgataatagaaatagaaaaaaagcaaaagaaaggttaaaagaaatgtaacatttccaaagggtaaaacaaaaaagagttggaagataggagaagaaaagtaagaaaagtagacataacccaagaggttcaaattccaaattacaggagttcag

SEQ ID NO: 250087 - DNA, 732 bp, Homo sapiens
agggagaagagaaagaagaggccgggggcccccagaatagagaaaggggggagagtattgtggagagagaaccaaagtgggaggggagaaaaaaggggtttgtacaggggttttaagaaagggaacgggaaatttgatgaacaaaaaagtttgaaaagggaagtaaagcctttgttcaaatggacatttgggaaccgaggataaattatatccccaggggtcagaatggaagattcttctctggggaatctgactgccaaattgtaaggacccaaagataatgatattggaggtttcctgtgtaaattatctagcaagattgccatacacagaaacacaaagttgacaagctccgcctatgagcacagaacctctgattaattattttatgccttattttaaaatttgagcacaggacagtttgtcaggcatcttcagaaaacctcatgagagagcaaaacaaacagaaaaatcaattatgacaattattcacagttaaaagctaaaagatggttttatctatgagactagaacaaatttctatttaaagacttagaataagagcttttggaagtaacatgataatagaaatagaaaaaaagcaaaagaaaggttaaaagaaatgtaacatttccaaagggtaaaacaaaaaagagttggaagataggagaagaaaagtaagaaaagtagacataacccaagaggttcaaattccaaattacaggagttcag

SEQ ID NO: 250088 - DNA, 689 bp, Homo sapiens
agagacaggtgatacaacatctctgagattctcaacatgtttggtaaaaataattaaactgcttttaatgtatatgtcatgattaatgttatctataatgagtgtattagggatacattaatattcacaaagactatatagctattaactaattgttctgtggcttatagacataattttggatgattcgttctttttttgccactaataaatatacaaaaacctttcatgttttaaaatgaataaaaagttataattctgaagaggtcctttatttaaatgaaacacactaaaaccattgaattttaatatttatattatgaaatgatctgccactgttttttgtaagtgtacctgctattatgactatattttcaagttaaagattcatgacgtttttgtgagaaaatattttaaaaacttgttaattttttcagattaactacaaaaaatctattgtaaaaatttataaaatactaataattaagtctctttattttcatgtcagtgctcttaaaatataggttgtttcaaagacagtagcaataaaaatgtcaattcagaattccttcagggatgaccctaagtctaacaggtatatcctttgaaacaagaaaaatatctagcaccttgggaaatgaaaatagtacatttttattttctcttaataaaattaactcagattgtca

SEQ ID NO: 250089 - DNA, 654 bp, Homo sapiens
  misc_feature (17)..(17): n is a, c, g, or t
ctctggcgaagcttcantagactacttctccataatattcatccctgtagcattgttcgttacatggtccatcatagaattctcactgtgatatataaacccacaccctcatcactcttcaaccgcattggcctccttgctgttccacaccagatgagctcctgctacagatcctgtacacttgctgttccctctacctggaatgcttcatttctcacctccttccagttttcctcagatgacaccctttcagtgggccctttcctgactactctatttaaaattgtagcaccctccccatatacatacatatacacacatacacacacacactcactgacacacatttacagcactctctcttgccccttatgtttttattcagttttatcagcttataatatatagttgtctctcagtatccatggggactcccatggatactaaaatccccagatactcaagtctgttatataaaatggtatagtaattgcacataacctacacatatcctcctgtatacttaaagtcatctctggattacttataatacctaatatgaggtgaatactatgtaaatagttgttatactgtaatggttttaagttttacaatttttattatttccgcagggttttccaagtacggccgtcg

SEQ ID NO: 250090 - DNA, 537 bp, Homo sapiens
ctccttgctgttccacaccagatgagctcctgctacagatcctgtacacttgctgttccctctacctggaatgcttcatttctcacctccttccagttttcctcagatgacaccctttcagtgggccctttcctgactactctatttaaaattgtagcaccctccccatatacatacatatacacacatacacacacacactcactgacacacatttacagcactctctcttgccccttatgtttttattcagttttatcagcttataatatatagttgtctctcagtatccatggggactcccatggatactaaaatccccagatactcaagtctgttatataaaatggtatagtaattgcacataacctacacatatcctcctgtatacttaaagtcatctctggattacttataatacctaatatgaggtgaatactatgtaaatagttgttatactgtaatggttttaagttttacaatttttattatttttaaaaaatatttttgatctacagttgattggttgaatctatg

SEQ ID NO: 250091 - DNA, 336 bp, Homo sapiens
ctcccccctgccaggctgcctggagcagggctcggcccctgacaccccgcctcccccacaggctgcctggagcagggctctgctggaatcacggaaggaacacacaccctttttgagactatcagaattgcaaagcctggccagttggtgcaagtgtttatccgcctgccatcaccatcgggtggggtggtctgtgacaggctcagcaggtgttggtaaaaggacccttggccagaaatgcaaaggggacagagcaggaactcctcacaatcataacagcagtgagctgtttcttgttctctgtgggaaaatgcttggagcctaagtcttgtacga

SEQ ID NO: 250092 - DNA, 376 bp, Homo sapiens
gaatttgaattgggcacgaacgtttttagggtgatgtgctaatgcaggtcctcttagaaataaaaatgcagccaggcgaagtggctcatgcctgtaatccgagcactttgggaggccaaggtgggcaggatcacctgagttcggggttcgaaaccagcctgaccaacatggagaaacccatctctacaaaaaatacaaaattagccgggcatggtggcccatgcctgtaatcccagatactcaggaggcagaggcaggagaatcacttgaacacaggagacggagtttgcagtgagccaagatctcgccagtgcactccagcctgggcaacaagagtgagactctgtctcaaaaaaataaataaataagaaaaata

SEQ ID NO: 250093 - DNA, 501 bp, Homo sapiens
aggtctccaacctgcaataaatgaaacatctgatccccttgaatccaaataactttttctttgattttcttttacttctatttcttcgtcctttgttctacagcccgagtcaaatttccctttagaaattgaaagaatgtgtgtgggtttttcctgctttttttttttttttaaccaagctctagtgcaaccgctggttcatggactagaatattaagatccaattcaatggcagactgtctccagcaatgttgtatttttatttttttttgccgtcatcccccccacccacttgtgagcaatggttgtacaaattagcctctgtgtactagtcaccgaagctggcttcccaattaaccccaggcttgagagaaaataagactaaagattcttcccctcctgaaagaactaagttatccatgcacaaaagcctacatgttggcacctggctatggagttgggcatttaattgcctttgtaatgactcagtccatctgcatg

SEQ ID NO: 250094 - DNA, 459 bp, Homo sapiens
caagagttaaaaataaaacaaaaacccagcagagtcttgaaagcattgggaggggtgaggatcaaaggcatagggttaatcttacaaaaagaaaaaaagaaaagaaacccctcttcttctgagtcaagagggaaggactgattttttttttttaatgtatgtcagcatggaggatgtgatacctcatacaattgtgagacccatagagataatatatacatgaacaatggccaatacagactacagaggaggatgcaaacaaagttagcagttagttttatcatttgtattatatcacatagcaggtgttctatcatatcatttgattaatcttcaaacctaatgtgatgtaatattatttatcccatgcttaaatgaaaaaactgaagttgagacaggttcagaaatttccagtcatgcatcttaggtaaaagatgtgggattcatgcctaaatctgc

SEQ ID NO: 250095 - DNA, 461 bp, Homo sapiens
acagaaaggtgggttggtgggggaggagggagaggaaatcgggagatacgcgtcagaggatacaagtagtggatatgtacgatgaacaagtctagggatctaatatacaacatgaaggctatagttaataaaattgtattaggtactttgttaaataagtagattttaggtgctctggtcacacacaaaaaacagtatatgtgatgagtaatatgttaacttgcttcactatattaccattttactgtctctatatatgtacgtgtgtgcacatgcatatacatacacacatgcatgcacacacacacacacacacatacacacatatatatctcccataacatcatgttgtaaacctcaggtatgcacaataaaatttatttttaaaatgttttaaattgagctttaatattaggtcttataccacacccttcccccccgccccccaccacacacacaca

SEQ ID NO: 250096 - DNA, 538 bp, Homo sapiens
cattcatttcacttcagtgatctcttttctctatgggtaactgaagtatcccacccccggagctggagctgggttccacttgccatccttgccacagagtctatggtttgggccttttcacctctccacagatctacagatccaagtccagttcgtaatgcacaagaggtgctgctttacctgtacagctctctacgctcctccattgcctcttaactactcatgcattcatgcagaggaaacgctcttttttaccaactcatactggagagtatgtcatcatgccaaactaatgtgctgaaaactgccctcaagagatgacctaagtaagccaaataccttcttttataggaaaagatcttaagtccatagagtttgggtggcttgtagctaagccagaaatatagcccaaatcatcattccatccctataggacaagcttgctgaagaacacagtcagccttctgtatcagcaggttctgcatccatggattcaatcaaccatggattgagaataataaaaaaatcccgtaacaat

SEQ ID NO: 250097 - DNA, 582 bp, Homo sapiens
cagaatccttagaatttcctgtatacaagatctgcaagtaaatactattacttctttctttccaatctgcatccagttgattttgttttcttgtctaatttctgggctaacactttaactgtaatgttaaataaaagtggagatagtggatttcttggtcttgttcctgatcataggggggaaaacattcaatcttttcccattaagtacgatggtaaccaagagtttttcacagatgtcctttatcgcgttggggaagctttcttttcctagtttgttgaatgtttttaccatgaatgtgtgtggatgtggacttttgtcaaatactttttttttaatggtgtggagatagtcatgtggtttttgtcctttattcttctgatatggtgtattatgttaattggttttgtaatgttaaattaatcttgcattaccgaaataaatcctacttggtcattgtgtataatatttgtacacattgctagatgggatgtgctaataatttgttaaggatttttcatttcacgaaatatcatatttttctttcttatgatgcctttttctggtttaggaatcagaatg

SEQ ID NO: 250098 - DNA, 469 bp, Homo sapiens
tggtaatttggggttatatcatgtgcattatgaatgaacatagagactggattctgttatgttcttctgaagattattggttttttgtatagcagaaatttaactaaacttgctccaaactcttatctcccctgggcaacaactggaattgaaagctttgtttagtcctttcagatttagctatgttgcttatagtttgccttgtataatatatgtctaggtctggaatcagctagggatttgggcagtttgtatataaaagtttgtcccagaagggagagtaccacactctctgcagcactttcccttctgggacaaacttcacttttccagctgctatgaactccactcccaaactatatcctttcatttctttaccagagagactgcaagttttcagtcaagttttagttgccctgtgtgacagcagcaaagcttgccctctgtcaaaaagctgtttaaaaaaaaa

SEQ ID NO: 250099 - DNA, 305 bp, Homo sapiens
caaaaccctgactgaaaaaaagacttctacaagcagtcagcaaacaggttatttcccacacatatctcacatttttatttacattatgagccagttaggttaattacacttttcagtgactcaaatgcaagtaaaagattctgaactcagcactaataatgtcaaaccctacataaaaggcactaattggccaggcgcggtggctcacgcctgtaatcctagcactttgggaggctgaagcgggtggatcacctgaggtcaggagtttgagaccagcctggccaacttggtgaaaccccatctct

SEQ ID NO: 250100 - DNA, 334 bp, Homo sapiens
gaatgtgatcctacatcataaaaccaaaacaccccttcagggtgctgtgtagagtacgatccgagacacagtcatccttgtgctaaggtcagcctgtttgcagcagcaaaacccagatctgtggtgatgtcaactgcatgaatcctgccattgggtaattttaaagaccttgtgtaacttcgaagaccttgcgtactactcctaatgtgaggatgaagttattctgttccaactccagtgctagaatcataatgttgcttcttatggaaagtacaatttaagaactgtgtcttaggttaaataaacagaatctaggatacctttatagactatc

SEQ ID NO: 250101 - DNA, 211 bp, Homo sapiens
gttcgaactatagagcaacctgcatataaagtcgttcagccaagagcatgggcagaatgaagccctgctgagcatttgtgcagcttctcaagttctttacagcaacctcacataaaacgaaaaacaaaaggcatggtttgttcatgagaaaaatctcaaaatgcaataaaatgtgtttttataacctagtttactttacttctcgtggcat

SEQ ID NO: 250102 - DNA, 218 bp, Homo sapiens
gcagttctcagccatgacagatgggagtttcggcccaattgaccagtattccttactgataagagacactgaccatggagtggttctggtgagatgacatgaccctcgtgaaggggcctgaagcttcattgtgtttatgtatgtttctctcttcaaaaatattcatgacttctcctgtagcttgataaatatgtatatttacacactgctcctcatag

SEQ ID NO: 250103 - DNA, 336 bp, Homo sapiens
agcgttcttttggtattgggagtgccagttgtctttgtttcatgaactacttctccgtaatagcatgcagccatcttcaagaggtgagaatttcacttagcgacttaaacagaagtgttatctcaagataatataatatctggagggagaggcaccagagctcactctctctgctgcagcacagaggaaaggccatacaaacacacagggagaaagccaccatctgcgagcagaggagtggggcctcaccagaaaccaaccctgctggcaccttgatcctggaattccagcctcagaactcggataaaataaatttatgtgatttattacaccaag

SEQ ID NO: 250104 - DNA, 302 bp, Homo sapiens
tgtggttgcagtagtgttttggatatatgcattccaagtttaggagcaagacgagttattctttgttaatgggaaagtccttaggagccctggactggttggttcttaggtcttgtggacgttgtctagttgggaatgatacagataaataggtgagatagatggtatcatttagaaagaattgataacactgtaaaggtcagtgaactggagaaacaaggacctggttttaaaatcctgcttgaaaccaccacataacacttttttaccttcacttataaaacagtaatgatacttattta

SEQ ID NO: 250105 - DNA, 516 bp, Homo sapiens
gtgtatttcagattttttaaaacagcttttccggagaaaagggagggatcacacctcacaataatcaccactgatcaatttcattacattattattattcaacttcctacatatcaccataagtatgtatattttccttaagtttacactgtcacatttaaactttactagaacaagctgggaaagagagagagagcaagcgtgagcaaaccctataagaattataaaataatatatataaaggggaatttattaaatttaaaaaagaattataaaaggacagtaatcccagtaatcctcccactgtgtctttggttaatactgtattcagacatgaaatattttgtctcttttgttggaaacaaaagcaagtaataataatggaaagtagctcttttaatatatcaaaataagtataccagttccaaaaataggatatctgcattctcagcaactatgatcttttccagcagacttaaaataattagttctcactaaacattgatcggaattttc

SEQ ID NO: 250106 - DNA, 764 bp, Homo sapiens
attgcttgaggccacgagttcaagaccagactggccaacatgacaaaaccccatctctgctacaagtacaaaaattagctgggtgtagtggtgtgtgcctgtagtcccagctgctaaggagactgagacaggagaattgctttaacctgggaggcggaggttgcagtgagccgagatggcaccactgtgctctacctgggtgacagagcaagactctgtctcaaaaagcaaaacaaaacaaaagccaagatcttgatgaaaaaatagtgatgagaaacattgaccggacaatcatgaaggctctgcaccttaattgggcttgggtaaattttaaaatccaagtctcaattataaaatgaggaagtaaaacaaaaagttctaaattttgctttttaaataattgagtcattctctgtatctttaaaacactaaagtagctttgtcttcattttcattctcatttgagaggttgtagaactaccttttaaaagttaataaggttataaaacctatgaaagtgaggggtcagcaagtgttggtcctgctatttttgtaagtaatattttattgaaatacagccatatccattcatttccagttgtctgtgactactttcatattactggagcagggttgagtactcgtagtagagatcacatgggccgcaaagctcaaaatatttactacctggcctttatataggcttagaaaatagagccttgacaaaattttatactttaatagtgtggtttttccttctgtta

SEQ ID NO: 250107 - DNA, 241 bp, Homo sapiens
ctcctcaccatcactatttctcttgctctgtttaatttcctccctcatcctcatcactttctgaagccagataaatgtttcttttgtttacagctggttgatgatgagtctttcccactagaagataaacaatatgatccccaaaaatcccctttctaacactacatccctaaaagctaaaggaaaacctgaaaacagccattcagcaaaattaggaataaaaaccaatacaacccccaaa

SEQ ID NO: 250108 - DNA, 409 bp, Homo sapiens
atttttaaaataaaaagttttaaaataaatgaagaaaacccctaaagtcataaatttgctttggaaacagtgtgaactcattacatgatttccttcttaaaaaaaaatacagtttgcctttctgttaaagctctagaaacagttacccaatccagtagcaagaagcattccctggcaccaatcgtaaggtccacgtcccaccacagtgaaccagggttcctatcaaaagacttagataccaattggaagagcctaccactggccaaagaaaagaaaatgtgagcattagtgaaaataataattaatgtggaatgaagcatatcaaatatttttaaatccagaattataaagatgctttttaagaaattaatctcagttacttttggagaatggtggtggattaactcat

SEQ ID NO: 250109 - DNA, 504 bp, Homo sapiens
cttttgtataagaaattaggaaaaaggcaatgtgtgtgtgtgtatatatatgtgttcaattgtgcacaaataaatactggaaagacaaactattgagattggtgggtaaaaataaagatgggtgggtgaaaatggagtggaagggtttgatgtaattatttgggtagttctgactttagaatcgtgttaatgttccacatgccctaaaattaaatcaatctgtatgaaaggtgcactcaatggaatataacagaaacaactgaacttaaatgtattttaaatgaataacactctttgaggggattggcaatgttaacccaggtaacttaagaatgtactattttgacactatactataaggctaaagacaatcataaagaattgtaaatacttaggagatttgttttttacattgttatgtgaggattagcaattttaaatctattatatttgtattcttggactggacaaattaataaatacattgtgggtaattggagtcag

SEQ ID NO: 250110 - DNA, 454 bp, Homo sapiens
tcaaatttattttacattccttccatactaactcttctccttgcatgtagacagacttgtggctgctttcaatgacttctgaaattaggtcattaaaagtcatacattctttggctagtaatcttgggttactcactcatgagaggccaagctttatctaggaagttcaactactcgagactgtcatgctgtaataattcaggcatgaggacaccttcctgtgtgtgcaaaacctctcatatttttcagtgtggctccggcacaaatgaggggggggctacgccaaagacatttattttacatctgctttcggtttagcatcaggggaaacaaagcaaagaagaatgacactgaagaatcaaaaaaaaaaatgagcataagacccatgaagattacagacacatacactcctaaaattaaacattaagcggaataaaaataatcccagattata

SEQ ID NO: 250111 - DNA, 549 bp, Homo sapiens
atgagaactgataactaatatagtgatggtagtaatgcaatggtggcaactaatatatagaatataaaagaaatagtatgttatgggataaaaaggtttaaaaattataggaagagttaacaagggtttccaggctactggcttaccacatggcatggaacagtgcaagacagtatataattagttgctaagtactgcaatttcaataataagcaatttaaagctcataggagtggacaataattgaagatgactctttgcagaaagtgtcaggatgtaagctggggtatcagagaaaaggtatacatcagcctataagaaacagcaattttcccaagtgtcttagaattcactttcttgtttcctgtttgtgttctggagtcaactgacacacagggaagacattttcctccccttatgaactctaaaaaagtggagtaaatggatttaaacatggtccatagcctttcccaaataaagttatatttctaattggagaaatacataaattttctatcacaggccccagtagagaaggacaggggaagg

SEQ ID NO: 250112 - DNA, 453 bp, Homo sapiens
ctcaagctccggtcatgtccctgtcttcttggctccacagggaggaaacgttggttccgagttatgattttcctcctttgtgcatgtccgggttacatgactttcagttttggctctgctatacctcctgttaccaacagaatagggtcagtttgggccagtcttgtggttacacctcagtgtcacaggatttcctctgccaaagggctgtgaagctcaggaccaaggtaatcaaaattcagctctactattggattgtcctggattgttttagcagttgacagggatcaagctctgtcccagcaaccttgatcccaacagagaactgatgctcctaggaccttcacctcagacctcagtgcatcctggtttttgtttttcttcctcctccacaacttttttattttgcaaatgttgatacattcataaaggttgaaagaataatacaatgaa

SEQ ID NO: 250113 - DNA, 603 bp, Homo sapiens
aagtctccgaagggtgctgtccctgtcaatgaaataagaagcggctagctgatgtagcgtctccagagtgaccgaagagctattggtggtggaatcacttccttcagctcgtttgctcaacttccgcttgtccacaaaaattgttagttttgggttgctgagagcataaatgtgaaaataggcaggagttacagaattacagagttcctctacattaagaataactttcaggcccatttgctttttacatcctactggtgtttaacctggagtcttttgctattttacgaagagtattgaaacatgtctctctggagtcaaatatttcatttcagacacctccctttatgatgtcaatctaagggctgagctaagggaaataaatgtgattattgttatgagggcatacagtgagatggcagcagcctgtaagccagaaacagaagcatcaccagaaactgaccatgctggtaccctaatctcagacttccagatttctgaagaacttcaaagaaacaaaagtctattgtttaagccacctagtctgtcacattttgttatggcaatgtgagctaactaatacactacctttaaaatataaaa

SEQ ID NO: 250114 - DNA, 738 bp, Homo sapiens
ataggcaggaatgattaaactggaggcagggaggctagataaaggtcattgcagtaggtgacaaagcttgaaaaagtcagtgtcagtggggttggaaaaaaggaggtggagaagaaaaacatgttgaggtcaaaccgctggggcactaaggctgactggatctgggtttgagggaaaagacttgagctaggatgactcccaggtttcctcctgactcaggtgactgcgtgaattgtgatgccaccaaataagatggagaaacagaaataagagtaaggcttgtggttttgttttgtgtgtaaatatgtgtatgtttataaataagaagggcttagagaaaaaaaattaaggaacaccaatattgaaaaagtaagcagaagactgacagctacggtcagaggggtagggaaccaagaagagatcagagtcatggatgtctaggaaaggcagagttttgagaagaataatgtaagacagaggaaccagaaccggagtcctagaggggctcttgtatgacaagagagactggaaaatagttgaggccgggagaaagaaccagcatagaatggccacttgtttgaagacatgagggaggactcaagatgctgttctcaggcttgctgatatttcagcaaaaacttattttgttctaagaaattatgggtctgattcttgtgaggcttgcaagtcctcaccgagagacattctctagtagaaaagtccagtcacggtccagag

SEQ ID NO: 250115 - DNA, 209 bp, Homo sapiens
tctcagatgccagccaggggccagtcttgcaagcagggctttctatggatggtagttttggtcctgatgctcttttctatctagactacttcagataaaatagaatatttattgacttcttttaagttactgtgctaggtactatgggtatattagagcattagcgatatatatttcctgccaacacagtgtttacttgctggaggaca

SEQ ID NO: 250116 - DNA, 713 bp, Homo sapiens
tagagagacctgataatgtttatggatttgaggaaaagaagaaagtagaaaaggaaagactgatgatgcaagggagagaaaagatgatcaacagtgctgagaaggacggttgttttagagaaggtgcaaagatggtaagggcaagggcagatataaagagtctagaacagcgttccccagccatttctaaacttatgcactcatttcatagtaatatatattatttgaacatttttttaaacatctaatggttttgcatgtaatgcaaaatgaaatgagttaaagttttaaaatgtatgcgtcattttagataagtgtatattaaagattttattacaaaattaattgaatatagtatttactaatattcatggattataataataaattctgaatgagttccatctaaaaagtgattcccatggtttaatttactttaattatgtaagaaatgaccatttatgaaacatacattaaaatgacatctattagtgtgcttagtttggcaactaaataaatattgaactgtaggttgaaatttaactgtgtctcatagtatcaaaagtagtcaaaaacagacaaaatctgcctttacaactaatgctagaaaagcttacattttgggtaaaaacatgtgatttatttttattctttgtttatttctagtgaaataaaagaggatttctggctgctattagtaaacacatctatac

SEQ ID NO: 250117 - DNA, 485 bp, Homo sapiens
ccccttattcaaagggacagagtagagacacaaatggagatgacagtgttggattttgagagcaaagacttgcacaacccttcgcctgggtcttctcatctttatttggtccacgtgatgcatttctagagccctaatgtgatgatagatgtgaatcactctcttcagctgttctcattgtgaaaaaggataatttcatagtaagggaagttgtgatgcagaaggtttttgagtgccaagtttgaagtgggaatgtgtagaggacaatgcacatccataggcagctttcaaaattacaagctattatatgatgcaacgtttggtttgaaaatcatgatcaaatttcagcagagcggtaaagagggtggtgtttgagtctatttccatggtagtacgggtaggaacctaggaatttccaaatcttgtcttgttaaatatccccaccctgagttctttatagggttcctgggttctgtgcaggaaaa

SEQ ID NO: 250118 - DNA, 415 bp, Homo sapiens
agcctgtagtatactgaagatagtgacagcattaatccaacccaaacccctaaaaactggtgtctacattgacacaatttccaaactaatggtctctgtgttagtccattttgcattgctacaaaggaatacctgaggctggataatttatagacaagaggtttattttggctcatggttctgcagattatacaagaaacatggtgccagcatttgcttctggttaggcctcaggaagcttttacttgcggcagaaggaaaggggagctgatgtgtcacatgacaagagcaggagcaagagagatgccaagttctttttatttatttatctattttatttatttatttatttactgagaatcgtgccactgcactcctgcctgggcaacagagcaagactctgtgtcaaaaaaaa

SEQ ID NO: 250119 - DNA, 1327 bp, Homo sapiens
agcttcctgagtagctgggattacaggtgcgcaccaccacacttggctaatttttctatttttagtagagacggggtttcaccatgttggccaggctggtctcaaactcctgaccttgtgatctgtccgcctcggcctcccagtgtgctgggactacaggcgtgagccccgcgcctggccccacatatcagatttttgggtatccctagcatatgtccgtcccacaagtctctgtggagactgctatggtgtgtcagtatctccatcccgtctcacaggatccttgcgtgttttgcacatacctgtgtgtgtgtttcaggtttgtcatacatcttttctgttgcggatgtggcatacacaaatggctccaggctgtgctggggggtgtcagtttcctacatctgtcaatgtatgccacagatgtatgtgtatcttgctaggatgtgctgtcactactgcacacctgtctcacaaccagcacacacaatacctgtaatgtttatttccaggctgctcatgttgtggtagcaaaaggcacactgtgtttccaggtttgtcaccaacataaacctgtccacttggaacagatcttaatcactcatttcatcaatatctagtatacaggaaatactggggaatggggggcggagtgagcggtgaacacactgaacagaatctgagatttaataagccaaatcaacaatgtgggaagttcgttttgttttttttttttgagacggagtctcgctctgtcacccaggctgcagtgcaatggcacgatctcggctcactgcaagctccgcctctcaggttcacgccattctcctgcctcagccttcccagtagctgggactacaggcgcccgccaccatgcccggctaattttttgtatttttagtagagacggggtttcaccgtggtctcgatctcctgacctcgtgatccgtccgcctcggcctcccaaagtgctgggattacaggcatgagccactgcgcccagcacaatgtgggaagctaatggacaagcagtttagcaacgttacataaatattaaagaagtaagcagtacgtataggttaataaactcaaagacacacctactaaacatcaaatatattttgtatgctgatagcaatctgtcttaaataagcagcagttgatacaattcagtactgtatataaaacatttataattttgtacacatacaatttttattttgtatgttaatcttatagttacgaaacggtctttaaattttagaaatgcaatctgaagactttatgcctttaacgaaatatctgattataaatccacatggggacagat

SEQ ID NO: 250120 - DNA, 358 bp, Homo sapiens
ttttttttttttcagatgggtgttcactcttgtcacccaggctagagtacaatggcctgatctcggctcactgcaacctctgcctgggcaacaatgagacttcatctcaaaaatcaaatcaaaacaaaacaaaattcattcattcctttattctttaatgataattagtactcattccatcaattagtgttgaggaactactgaagtagtccagagaacaaggagggtgatgtgaaccagggtactgagataagaagtggagtatttggattgagagttaaataagaaagacagtagcttgtacttggtaattaattgggtgtctggttttgccattaattgaaaggggggacaaata

SEQ ID NO: 250121 - DNA, 396 bp, Homo sapiens
gctttccctgatggcttttcgttacatctgtgtgcaattccctgtgacttaatataaaccatagcactggtaatgaatttcagtatctcaatattctctcagataaaattaacatttccccagatgcaggcatttgtcaaaattcagcaaatatacacttaagatttgcacatttcattgaatgtaaactttacacaaagctgtaaataaataccagtcatccctcggtatctgcggaaattggttttaggatccttgcttacaccaaaattcacacatacttaaagggaccctgtgggacctgcatataggaaaagctggcactctgtatacaagagttcccttcctgagaatatttgtattttcaatacgcatttggttaaaaacaaaaaaaaa

SEQ ID NO: 250122 - DNA, 399 bp, Homo sapiens
ttttcagggttaacaaagagtgagaggcagagccaataatataacataatcaccttatcttgagccaaatgcttttttctgttattccatactcctgttttgaagttgaatagtgaggctaggcacagtggctcacgcctgtgatcccaacactttaggaagctgaggtgggcaaattgcctgagcccaggagttccagaccagcctgagcaacatggaaaaaccccgtctatataaaaaaataaaaaaattagccagttgtggtggcatgtgcccatagtcccagctacttgggaggctgaagtgggaggatcacctaatcccatgaggcagaggttgcagtgagccaagatcacaccactgcactccagcctgagcaagagagtaagacccttctca

SEQ ID NO: 250123 - DNA, 642 bp, Homo sapiens
caggaggaccaggccaaccagaccttggctcgatacaggaagacggtgcatgagctggatgacgctgaggaccgggctggcatggcagagactgccctaaacaagctgcgcaccagacaccgcgtggccggcaagggcatcacctctgtggagatcatccaggtgtccaagacaggcacctcgaaaaccctttctgaggagtgaggccctccgtgtcctaggccacaactgggtaatacagatctcaactgcagtccattcagagggagaaaatatgaaaatggaaaactgggtctgtcctgagaatgtttactatgcaaaagaaagtgcaagccaggaagagacaggtggtgaagaataaagagcgctatggtggaaaatgagcttgagaatgtaaaacccgccattagaggaatgaaaatgagtggggcttctctggaacggcagtaagcatttggatgacagtaatgatggatctgtttcagttgagttcctacatggtcatgtcaaggacggaatatgtaatgtctgtgacccggctgttctctacaaagaattcctcatgttgacaatgttaatgtcccaatatagcttaaataaaagaaacattaaaaaaataaaaagctggcctcgttggcctca

SEQ ID NO: 250124 - DNA, 93 bp, Homo sapiens
ttcttgatgaactgtgaaccaccactattgcgacatgtatatatatcctccaaatttccaaaattcagattgcttatgaaaaatgcatacaca

SEQ ID NO: 250125 - DNA, 632 bp, Homo sapiens
cagtcatcattcccttataccagtactaaatgtttttaggtacctctgctggggcaatactctctaatagtgctgcacccagcttgcttcacaacctacagttctatcagattacatctacgtggactcatagctacatgctccttagtgaaggtctctagagataagagatatttggtttcctctggcctcattccttcaaatcaactgctgaaatcctagatatactcggagccccgccacatgacttcatctagtggtataattaacatgacactacagtagatgtgaattctcatcttgtagtggtttcaagataaatgaaaaggtctggaagcagtttctaaggaaactaagcaaaacctgtgagtggcttatgctcatgaaatttccaaattgcaattttcttctatttcacttcagtagctggtgtgcaagacttgtttacttctctgctgtgctgtaggttcaaacagaaactgaaacattgatttaactatgaagaactggtaggactcaatgcctggatagctttgaatgggtataaaaatttatagttacaactctgcacatatttacatattttcctcaattaatttatactttgtggcagatatatggagctgacagta

SEQ ID NO: 250126 - DNA, 767 bp, Homo sapiens
caaggtcacagaggctacacccttaacactgcagtgaggagaccccagaagctacaggaagacaggtggtcgctcttcctccatgctgctgaaagtcagatcctcaagctgccatcagtgcacaaggcagcacagaggcgctcagtaactgtggctgcaatctggcatcgctgcagcattttgaccttatacacaagttttggcatgcaacaggttgaaaattacaagcctggttcttcaccacaggttaaatccgagaagcactactagaaggggaatgagaatttgaaagaccctgagccctgggtgtcagattcaaaacaaaccaaaacctggtgacacgcagatcaccaggttgtctgggttgtctgtttatacaaaagacattctgtcaacaaaacaaattcaactcttccctgcagctcaacaatcctggtctgctgtgagacagggctttcctcagtccgtgtttgggtatcagttaatgttagtcctacaaaaacaaaattacgtccctcaagttcagcagccaaaagcagatggtggccgggtgtggtggttcacgcctgtaatcccagcactttgggaggctgaggctgatggatcgcttgaggtcaggcattcgagaccagcctggcccacatggtgaaaccccgtccctactataaatacaaaaaaaattagccaggcatgctggtgtgcgcctctaaccccagctactcaggaggttgatgcggaagaactgcttgaacccagaaggcaggggt

SEQ ID NO: 250127 - DNA, 380 bp, Homo sapiens
cagccctgtcccacctcgcccaccgggggcacccccacactctaccagccatgctgctgaaagtcagatcctcaagctgccatcagtgcacaaggcagcacagaggcgctcagtaactgtggctgcaatctggcatcgctgcagcattttgaccttatacacaagttttggcatgcaacaggttgaaaattacaagcctggttcttcaccacaggttaaatccgagaagcactactagaaggggaatgagaatttgaaagaccctgagccctgggtgtcagattcaaaacaaaccaaaacctggtgacacgcagatcaccaggttgtctgggttgtctgtttatacaaaagacattctgtcaacaaaacaaattcaactc

SEQ ID NO: 250128 - DNA, 282 bp, Homo sapiens
gctccctcctttctccatctccaattcatcatcaataatcataaacatttactgagcatctcctaggtatgagggataagaaggaagagggagaaagaaatgcaggaagcagctccgacttgcgattctgatgaggaagagctttctgaagaacagcactgaagcaatcctggcctcacagcagagagggaaaggaagggaagccaccaagctgcccagggtagggggtaggcctggtgggatcacctgggctgaatattttcaatcaggcactatgcctgc

SEQ ID NO: 250129 - DNA, 406 bp, Homo sapiens
aaaaagggtcaattactcctctaatttatttgggtacaaggtcacaacaaaatagacattcccagctatagctatcacaaatgatgttctctaaagattgctcagcaagactgttttctattttgatttcatttatgttgaattgagttcttctccaagaagtcgagttgtattgcagaaagaactggaagccgtgtgtccactgagaacaacctggcatctctccttacctaccttgctcaaggtcacctgtggaaaacggcaaacaaaacaaaaagacaccctccctgctccaagtaatcaagaaatcatgtagttctgagatacacagagaggaaactgaggccccaatacgcggtgtaatgagcccaaagccatgaggcaaattaggaggccaagactaggt

SEQ ID NO: 250130 - DNA, 1101 bp, Homo sapiens
gtgtgattctgttcagcgaccgtgattctgttcagcgaccatgatgttgagcccctaattgagagtctgttaccactattaatagctactctgttcgggccctacacataacggtgtatctaaacctctctacaattttatggacagagtcttgctgtgtcgcccaagctagagtgcagtggtgtcatctgggctcattgcaacctccgcttcctggattcaagcaattctcatgccacagcctcccaagtagctgggactacaggctcataggcgaaagggacttgccttgtctcagatgagactttggactgtggacttttgggttaatgctgaaatgagttaagactttcacggactgttgggaaggaacctgtggtgataaggaagatgtgagcctggagatacagaagctaccacatgaatgttaaaaatgaagctgacgcagcaaaaggcagtgccaaggaactaaaagaaaacaaattttgattacatttttggagttcctgggtcaagcagttcatgacactgaggcttttccgctacatgaataagtactttttctttcccgttaaagtgggtttgtgctggcttctctatcactcacaacaactggatactaactgaggcaacacttcctacctcttacacacattacacccataaaacagaaacaacatctaaaattagatttcaacacagctaccaagcagaaaagttcaaatcaacaagttatggataatgttttattgaaactacatttctcctcccaatgtgagtatggtgttggccaacatgttgcgtgttgattctgcttgcctttgtgtcctacatataggatgtgtactgtgtaatgaatcgtttcttcattatttttctcagcttgcatggttgcctccctcacctccattcacagagctcactgtgacagcattcaaccttgtcttggtacaagtgtgtaatttacataatagtcgcctctgtactttcctcagtaacttaaacaaagaagaccatcactcactgtgcttgcctttcaaattagatttgatatcaaattaaagtctcattttattaagtttctgaagccaaagtctttga

SEQ ID NO: 250131 - DNA, 408 bp, Homo sapiens
gattccccgggctgtacgaattcggctttaggcacacacatggacatgcttcccaatgagccctggcccagtcaactcccagctccaggaaccccccacagccctttgctggggtgcacaccgtccagagcactgacttccccaacgagccaggtggaaatgtcccagggaggaccccggggcctgaggagcctactgaatcctcaacaaagaagggaagagaggcctaggccacagcaggcccagaattattgtgttatgctctggatcttggggaatgtgtaatccccacaccgtatctatggcaactctccattaaccagaatttggttctacaaattcctgttcccattcattctagaaaactcagagctgttggtctttttaaaaaaactcgctgaaaaaaaa

SEQ ID NO: 250132 - DNA, 566 bp, Homo sapiens
tgtgtcatcagctaatagatctgaaagtgatgccggtgtctctaggaaaggaattgatcatagccaagtgactgacattctctcggtcaggaaaagagcttgcttcacagcctttgaagtatgactgtatgtgtggtccccttgtactttggagacagaaggtactggcagcgagtgtggtggatgggcagaaggtgtagcattcggagattatttctgtatgtaattaagagactttcaagggttagccagacttttttccactcaagtgtggattatctttgctacctgtgttaaagaatatcaggttttgtttcttattgtgatttttgagtctaaatgatccaagatttttaaaatagatacataatgaaatccaggcctctgaaaaattatggcaacattcatttggagtgtggctaaaaactcatactttatccaatttggttgcctctctcagttactgcagtttatagaataattgagcttgaaccatgtgaatgctcagaatgtcaatggtggagtatttattcaagagaaatggctgaatctcgatacgaaaacga

SEQ ID NO: 250133 - DNA, 476 bp, Homo sapiens
gagagtgatcgtgagcaacccggaaccagcagtcccaacctggactgacgaactgggctctccagtcctgggccgtggggctccatgcctcgggctggcgggacaagcggcggggagcccggagcttcggagccgccgccgggcatctagccagctccgcgggagaagcccgggggcgcgtcgggagccaggggactggtgtgaactagccgcccccgcaggcggacgtttagctccggcacccgggagcactgacactgggcgataaggagttcctcggcaatcggctgtccccagtccccagtcacctccggcggacgtgaccgccggatgctatgcagctaggtgggccaggggggcctttgcattgccttccctgaccccttccttgccgcggaggagccacagtaagatgcctctgtacgactctccagaactttcttttgcaaaataaaggccaaatgttgggcattcta

SEQ ID NO: 250134 - DNA, 286 bp, Homo sapiens
ttagggtgaagtccaaatccaacgaagagtgttcttatcagagacagaaaagggggacacgcatagacacagaagaaaatgataggctaggcatgatggcttgcacctgtaatcccagtgcttcgggaggctgaggcaggaggattgctcaagcccaggagttccaggctgcagtgagctataatcaccccactgtactccagcctgggtgacagagcgagaccctgtctctgaaaaaagaaagaaggaaggaaggaaagaaaaagaaacaaagagaaagaaagac

SEQ ID NO: 250135 - DNA, 738 bp, Homo sapiens
ggccctgttaagaattcctgtattattttgtcatgctttaaggcccaggaaagacctaggcaaaactcttgatgggcttttgtggcatcccagcctttgtataaggagactgacttttaatatttaacttaacccttcagtcagtagtgaaacagtcgttatggaggcctgcattagtgagacctggcctgccacaatcctgtgttcatgtattgaaagactgtattattaagatggcagtactacccaaagcagtctacagattcactgagagccctatcaaaattccaacagcctttttgaaaaatggaaaagcttaccatcaaactcatatggaattgtaaacgccgtgaatagccaaaacaatgcggaaaaggccaaagttggaggactgacacttcccaatttcaaaacttactataaaactacagtggtctaaacagtgggctgttggcacaagtacagatgatactaacatacagatcaatagaatagaattgaggcttcagaaataaacccatacatctatggccaactgactttcaacaaatgatgctgcaataactgaatgtacacatgcaaaaaaaaagttgaacctctatgtgatattgcgatagaagaaatacatattttggtcttgtaccagtttcctggcacatagctcctaaaacccttgcaacatcccaagtccccaagctgtgagtatctttgtatgctaatgaaatgactaatgtctgg

SEQ ID NO: 250136 - DNA, 526 bp, Homo sapiens
aactccgaaattaattatccaactgtctttttgatatatccatttgaagatgtcatttggaaaagtgtcaggtgtctactcatgatcagtaaatatttactgattcagaaagagaataatatttggaaccacttagagtttattgttgggatgaaagaaaatattccagtgtaactaattgcaatagtaacttaagtgataacaacaatgtaattattttaaaggatgctgcaaaactgcttccaaaattcagggacctgtcctaataataagctcaactaaaatataatttgatagcacattaaaacaatttaaagattatatggaaaatgttcatagcaagcataatattaaatgttaaaacactaatcttatttccattaaaatctggatggatacagtgatatcctccagaatcactatcattcaattctgttttagagattctaaacaatgcaatatggaaaaataatcaagtaagcagagaaaatgttacaatgtgagatatgaataacatgtatatggc

SEQ ID NO: 250137 - DNA, 480 bp, Homo sapiens
aatggtgcaggtagatccttcacgaatgataaaggaccatcaccttgataaaggaccatcacctcctgatagtgagtgagttctcatgagatctgattccttaacaggctgtggaacctctttcctcactctgtcttcctcctgctcctgctttaggaggcatctcattttcccttggctttctgatataatgaggaggcttcctgattcctcccagaaacagaagacactatgctttcttcacagcttgcagaaccatgagtcaattacacctcttttatttacaataatacagaaaattagaactgcagagaagagctgtgaaatgtcttcaaggcctttttccctttgtgttggctattagcacagggcttctttatatgcaaatttctgaaatcttcttgaatttttccccttaaatgggatttttgttattgctacatagccaacctgctaaataaatatctgaaaaagtaaaaa

SEQ ID NO: 250138 - DNA, 400 bp, Homo sapiens
agaataaagaacccagaagtaaagccaaatatttactgccaactgatctttggcaaagcagaatgacaatggatccccatctctcataaaaaatcaactcaagatagatgaaagacttaaatctaaaacctgaaaccataaaaatcctggaagataacattggaaaaactcttctggatattggcttaggcaaagtattcctaagaccccaaaagcaagtgcagcaaaaacaaaaataaataaatgggatctatttaaattaaaaaacttctgtacagcaaaagaaataatcatcagagtaaacagaaaacccacagagtgggagaaaatattcaaaaaccatgcatctgtcaaaggactagcatccagaatctacaaggaactcaaacaaatcagcaag

SEQ ID NO: 250139 - DNA, 456 bp, Homo sapiens
atttccctcctgactctcgctgggagagttgtagactcctgggaaacacaggtctatggcctgcctaagagaggaccagcccacaccaaagaaagtgccactgcctcctcctcctcagtggatgccaccaagccccgaggaggacaaccttttccttaatctccttgaaacccaggcaaactttgacaaaaggaaaggtgtttccagtgtgttgttaactgaaccttggttgcttggcagtatgcagttcttgtctaatttaccccaaggaaatgtctgtgtgatgtatttttaatttgctgaagaaggataagtgttcaaacctttgtacatttatgctgaaattaatttttcaaagtccacataacttcagtgctgtgggatagtccttaagaacagaaattatgaccaaccataataaatgacacatttttgtgaaatgtcaaatctcataaa

SEQ ID NO: 250140 - DNA, 392 bp, Homo sapiens
aaggagataatatatagaaattggcttcaagtaaatatttgtctgtaacaccatgttgatctgatttctgcaaattgctgaggaacaactggtttatggtgcgtataaaaagattttttcaaagatcttatgcttcaagattttaaaatgtaaaaataccttctctatgccacacaacttcatttctctgtactttttttttaatgccttatgccagacttgcatttattttgggcatatatcatcagctacggaatatgcaaatgattttaattcatcctgtaagcaatgagtggaaaatgagctgtacctgatgcagcttctcaaatacaacattgaaaaagcctgaaaatgaaggcactacataagtagaatatgcataaaaaggaaaa

SEQ ID NO: 250141 - DNA, 493 bp, Homo sapiens
tgcctatcttcctccccacagaagcactccatcctggggaaaagcatgtttagctatggcagtccagcgtagggttttgcccaacaggatgtggtttctaaagcagacggaagctgcacacaaggccccaagcctggcttctgacaccagcctctggctgggtgcaagaagctcaggggcacactccacagggcctggctgcacagaggtgcgagtgcagtggctcacatctataatcccaggactttgggaggccgaggcaggagggtcacttgagcgcaggagttcgagaccagcctggacaacatagagagacgccccccccctacaaaaaattaaaattagccaagagcagtggtgcacacctatagtcccagctactcgggaagctggggcagaaggatcagttgagaacaggagttcaagactacagtgagatatactcacagcactgggtgacagatcaagaccctgtctcttaaataaaaaagaa

SEQ ID NO: 250142 - DNA, 349 bp, Homo sapiens
tctttattgctcccttgttgacgccatccagcccatggcttcttgttacactggactcttgactagtggagtcacatctccagcctggacctctctcctgagctccagacttagatacacatctcttctcagcatcttcattagatgtccaatcggcttctcagacttgctgtgtcaaaacatagcgctaactttttcctttccttaagccttgactgtgtcaacaaatggcacctccagctacccagttgcttgagctaaaaacttttggcacctttgattgttctctttctcttaccctctccccatatcctatccaatgggaataagtcctttcagttctacttca

SEQ ID NO: 250143 - DNA, 353 bp, Homo sapiens
tcttactctacccttatctccctaatttctagccttctacatcaaaagaaaccaccactattagtttttttgtgtatccttccagatatatatgtatgcatatataagccactctagatatatattcttgcccagttttcctcccaataaattatagcatattatatttctgtacctttttcactcagtagtgtatcttgagatctttccgtattgttacagagtttcctcattctttttcttcctcagctgtataatcttccagtgtatagatatatcataatttatcccccactatattagtctgttttcacgctgctgataaaggcatacctgagactgggcgatttaca

SEQ ID NO: 250144 - DNA, 413 bp, Homo sapiens
aaatgtttctgtgtcactctcagttgattgaactcaagttttcactcccatttaacaccacgtgggggccattctgacttctgcagagtgggtatgatcagatcttctgtaaaagtgtaagtgaggaggctgggcacggtggctcacatctgtaatcttagcacttggagggctgaggtggtcagatcactggaggacaggagtttgagaccagcctggccaatgtggtgaaaccctgtctgtactaaaaatacaaaaattagccaggcatgatagcacatgcctgtaatcccagctactcaggaggctgaggcaggagaatcgcttgaacctgggaggtggaggttgcagtgagctgaggttgcaccaatgcactgcactccagcctgggtgacagagcgtgactctgtctc

SEQ ID NO: 250145 - DNA, 402 bp, Homo sapiens
ttgagccattatcctcagcaaattaatgcaggaacagaaaaccaaacaccgcatgttctcacttataagtgggagctggacaataagaacacatggacacagggacgggaaccacatacactggggcctgttttgggagtgcagtggagaagagcattagggaaaagagctaatgcatgctggtcttaatacctaggtgatgggttgataggtgcagaaaaccaccatggcacacatttacctatgtaacaaacctgcacatcctgcacacgtaccctggaacttaaaaaaacaaaataaaataaagtgggtataaataccactgccgaactgcctctgggctgctattttgggtccagtgcctatggcatggccctgctctgcaaggaacagtacctgtgc

SEQ ID NO: 250146 - DNA, 434 bp, Homo sapiens
agttatttttaatctgttatttaaaaaaatttctagagcaaaatttattcatcatatactatagttcaccctcacccatggagctacattcaaacacccccagtggatgcctgaaaccacagattacactgaacctgatatacactaccttttcctatatgtacacacctaaaataaagtttaatttataaattaggcaaagtaagaaactaacaacaataactaattataaaatagaacaattataataatattttgtaatgaaatatatattaatgttgtctctcatctcaaaatatctcattgtactgcactcactcttcttgtaatgatataataaaatgcctacatggtgaggtaagtgtgtgactagtgttggcattgtaacataaatttgaaaatacagaaataaacaattctcgagttttaaattg

SEQ ID NO: 250147 - DNA, 286 bp, Homo sapiens
actaaattcgcggccgcgtcgaccattcttttgtttgtcatttttatgaaaagaatgagatatcaatttatccatgacatagagggtcacagcacacttatttctcccaggtaggttggcctggggaacattaggctcctaatgtgtggaatttcaatacaactttctgaggaaggagttcagagaacttttagtctaaggaaaattaaagttaagaagttccattatcataatcagcctcctaactgctgttacgtcgacgcggccgcgaatttagtagtagtag

SEQ ID NO: 250148 - DNA, 284 bp, Homo sapiens
gagctgggggtggggggccgatccttcaccaatgtttaagcaccatcttctagatgctgaccttgtgataatgagttctcatgagatctgcttgtaaaatggggcatgacaactttttcctttctctgtcttgctcctactcttcccgtatgagacatctccttgccccttgacattctggtatgattgggaggcttcctgagtcctgtcagatgcagaagccactatgcttccttacagcctgcagaatcattaccctattaaacctcttttctttatgatca

SEQ ID NO: 250149 - DNA, 302 bp, Homo sapiens
agcaagatcacagctaactgcaccctcagcctcccgggctcattcgatcctcccatttcagcctcctgagtagcccaggaatttgaggctgctgtgagctatgatcatacaccgcactccagcttgggtggcagagtgaggctctgtctccaacaacaacaacaacaacaataacaacaacaaaaaacagtaaaattagacttaaatatatgtaaaataataaaaataataaaaattcacttgaactatacctaacaacctaaatcgaatcacaccttaggaacatcaaacatttaaatgta

SEQ ID NO: 250150 - DNA, 417 bp, Homo sapiens
acagcattctcaccctgttaaatggaaatttagagcacccttaaattccagaataattaaaattgctatttggattgaaaaagcccttaggcaacatttattgaatattaggaaataacttttataagattagaatccattttttatagaaaccaaatttaaaagtatacatattttaatataagtgttgtggtaatacactaaccaaaattgaacacacagttttaaagctttttatatttagtagcaattgaatatatatgacatgttttacatagattaattttactatttttctttatttaaacaagagaaccaaattgaaagccgacagatactgcaaatgactgggatttttgtttctgccttatctttttgtgtttttttctgaataaaatattcagaggaaatgctttt

SEQ ID NO: 250151 - DNA, 269 bp, Homo sapiens
actatatgctttattattaggaatgtagtaataataagactatgttatctaggtcacataaaagaagatgttcaagctaatctctaaatcctattaatttctttacttacattaaaaaaaaatagtcaattggctctactattcaaactaatgtattcaaaacaatgtgccttattaaaggtatagatcaaaattcaaataacttggttcaaatacagtcagtcccagagtcattcggaagtgtcaaggaagaatgcagagctctaaga

SEQ ID NO: 250152 - DNA, 460 bp, Homo sapiens
ggatgtgtgaacatggtaattggggaagaagtgctttggagatgctgcatgttttgagcaacgggagagatgaccaggtcagttggtaaactagagctggccaccgattgctttgtgttgcccacttctagtggctgggcccaggccagggtgggtgagggcagtacatgccggtggctgcagttacccctttcccttcttgctgtgcaaacctttgagtcttcgtgtatttttctggagggaggaagtggtctcatcacagctggaatgactgtttgagcaaagttcccctgttggtctcatcctgctgacggacaggactctgggtacctgtcctgcctagcccagccccccattctactcatccccagccccattccctctgcattccccaggtaagatggggaagcttctatgataggatatttttttctttagccccaacttaccctttagaaaa

SEQ ID NO: 250153 - DNA, 480 bp, Homo sapiens
tgtcaactggctcctcaacatactcaggctggggtggcgggggtgggggaggacattttcctacagacacagtaggaacatggcctctaggcattaaattaaccagcggtttctttggcatgttcgaacaagtctagaacccaaagcgcatatgctaaggggagaggaaaattgcctacttgataaaaataagcggtatctaacctctgagctcagagcttgatttctgatgccagtttgataagactggcaaatgcacttcttggtaacaacactgaggccagtacgggagcaccgagtattcaagtctcacacatagcatgacttaagaaatgacagcagcattaggaaatgtgctaaaatttttaaaggcgtaacaaccctgtcttctggttaccctaacctgtgatctgtttatttccattttcctttttaaaaaaaaaaaatcctaaaaaaaaataaaactcacaaaatcttcaa

SEQ ID NO: 250154 - DNA, 1243 bp, Homo sapiens
gtgtgggtgagtgtgtgagggtgagggtgagctatgtgctcatccgtgcatgggggtctgaggaggggaatccgttcggagagggccagccaccaaacaggacatgttgtggcaagccacaccatgacaaagaacatgtctctgctaggaatatgtgggcatctggcccacgaaaagctctgtggttcccactttctccacaatgaagaagatgccagctcagtggcctttggcgtacgatcttttcattagaatatgggaaaggtgtagaggccccaagtacagatacgacattaaattgggtggtgcgtgtaggcgcttttgaaatttcattctaaaaaatccaaagtgcctaagttacgtgaacacagattaagtgacacaaaaagaacgcttccttcagaagtatccgccgcataatctcatctctgcctcacttacttcctatgcagtaggtcttggaaaagggatacattcgcaacgatcaatccttggattaactttttttagtcagggaagggcacggtattaattctgaaataagcttcagaaaaaaatgtaagaagcaggcatgagatagccttaatatacactagaaagcagttctatatatcttacctatttcctttaaaaatcttatgtacataaatcttgaaattgatttacatgccaaactattttatcttgaatatttccaaacataaatctgtgtgatggtcatttcatgttaaaatgtgtatcttaatgagttacaaatattcttctaaaatgaggaaaacccacagcaagacaagaaatccacttctacttctaaaaattgtgtagctgtgctaacacatgcgtctcttgtaataaatgtgatatgagttcaaaggaagacacagaacactagctataatttcaaagatcaagtttccttaaaatattacaacaggggagtagaaaatatgcacgaaggaaacatcccctagttaagtgccagacaagcactgatgttcatgtcccaccagcagaacactgtcaggaagaggagagtggcatttgatgagcctcccactgacctggctgcaagctgtcagatgccatgtcatagcatttcctctatttagatactttctaagtgcctcaagtttttcaaaggggaaaaagtagagcttgatgggggtggggtagcatttcaatctgcatgtttgaaaacatgtcttcattttcatctattgccattctatggaaacgcagccgc

SEQ ID NO: 250155 - DNA, 263 bp, Homo sapiens
agcaaattaggttcattatttacgaagtgcctacataaaaacctgagtatgagaccaagaaaaatagattctgtagttttagttaaaaaaaaaaagaattgacttgtaaatcccaactgcttgggaggctgagacacaagaattgcttgaacccaggaggcagagcaagagaactgcttgaacctgggaggcggaggttgcagtgagccgagatcgtgccactgccctccagcttggacaacagagcaagattacgtctcaaa

SEQ ID NO: 250156 - DNA, 541 bp, Homo sapiens
ttaaaatcatttttagtagatttatatttcatgctcattgcaaaatcctcagtatacctccatgtacaatatatatggcagaaaccaaaagttcccctaaaatcctatttcctaggataaaattccctattaagtatcaagtttgtcatttgagaacctttctaggtatatgtaaaatatgtctatgaaactttttacatacataggattgtactgtagtttctgttctataatctgctttcattagagagtggacaactttttgtgccaattcataaggatttacttgatccttttatcagccacataatattccataatacaaatgtatcatgctatcctatggaaagccatctgcttttttcctataacaacactgcagtgagtattcttgtacataggtttttcaatatttgcatcagtaaatttctaaaggtaatttcctgggataggaataggaatggaataggaatctccaagtcatagttgttacaaatgttttatggttatgaatttagacatttgagactttattttggaa

SEQ ID NO: 250157 - DNA, 490 bp, Homo sapiens
ctcagaaacctattgatacatgactgtgtatgtttacattatatatactgtatatgcacacatgcatatatgcatatatatgttatacatttacatatgtacatggatatcacatactttaaattcctgaagatgtcattttcattaaatacatatgcacacacactcataaacacacacagactcatatatacacacaaatctataacacatttgtgctcacatatacattcctctgtgtgtgtgtgtgtattacattactgctttttatctgtgaaatcacattctgcagtttcatttactgtgatcaactatgatctaaaaatatatgagtacttcaataagatattttgaaagaaaccacattcacataacatttatgacattataattgttctattttattagctattgttcatctcttactccatctactttataaattaagcttcataataagtgtgtatatttaataaaatatatagtatat

SEQ ID NO: 250158 - DNA, 409 bp, Homo sapiens
acactggctgttttggttttgcttttataatgcttgaataacagtaattgaaaaaaatagttatttagatagtttttgaattctctgttattacaatgctgttagtatcctgtaaataaaaatgtaggggcaggaaaaggcaatcatatatatattcttcaacctgaaatgttttccctcagagataagtttaatgcccaatttatcctaggttcttggtacctatatctcttctctttcaaattggcttctgataggccttttacattttcttagttttatttacatcgctctgtttttgtttttgtatttttgtggggtttttttttttaaactgtaaaactcaaaatcttcttaaaatgagtggaaaatcataatgcatttttttaaataaaggaagctaattaat

SEQ ID NO: 250159 - DNA, 462 bp, Homo sapiens
acttattcatttttggaccattgttgactgaaactgtggaaagcaaaactgcagattagagggattactgtattctattcatattatttcttattttaatacgtaataccattatttatgatccactaagggttgtgtgtttcactgaaagtcactttgcctttgcatttactagctacttggttatggtctttcactatctcctgatagcaccttaatcaaaggaagatatctctgaaagtacaaaatcaatgcgaaaaaaaaaagaggaggcatccgtattttatataatgagatcttaaaatctgtattgaaactcaccagaaccaatctgtaaaagggctctgaaactatgaagttagacttctgacagagcctccagaattatgtgaacttgtctcaaaacattctctaaatggctatgtacatattctgtctgaaatagtaaataactggaagtca

SEQ ID NO: 250160 - DNA, 312 bp, Homo sapiens
cagattcctcagaaggtcccgtgaccccagatcttcctggcaccagcttcaccgtcagcccacttctttggggcaggggactgcatggccctggaccccatgactgctccctgccccctgtaaaatatcccctttagacagagaagctgggtgggggcagagagaaaggaaaaataattacttcttagcctctaacctttccggcaagtgactcggtaataaataatccccacgtccctccagtgcgatccatcagcaggaactcctaattacttcagactcacttgaaaccgcttccagtcccactttcaa

SEQ ID NO: 250161 - DNA, 267 bp, Homo sapiens
ccgcgtcgacaacagcattcatctgttgccagtcagatatgaggtaatgcttgtcaaagaaactgcagcagaacaaactgtgctgctgacctaggactccttagatttgcccttcaacccgggaaccaaactcagatctacctccttattgatagtctaggatttttcagtttaaaataggtattccccgggaggcggagcttgcagtgagctgagatcgcaccactgcactccagcctgggcgacaaagcaagactcaaaaaaaaa

SEQ ID NO: 250162 - DNA, 955 bp, Homo sapiens
attacaggcatgagccactgtgcctggcctaaagtccttgttttacatggaccacggtggtggttgatcatcaagttgcttaacctcatccgagcctatagtggtccttgtttccatagcatagaaaacccttgttatcactgtctcccctttagtttgacctgaaactgtaacaaatatctttctcatgcccactcagcatccaggcatcagagacaggctccacaattaatttttcagcatactgaaaaaacacttgccagtgaacgactgtggctagggtaagaatgatgaagtgagaaggcaaagggaagacttgcttgcaccttccaaaaaagaaggtggttctttttcaaaagtagatgttggcttcggctctgagcacacttcccaggctacctgagctccatgggcagctggaaacttgccctgccccaggggctggtggatacattaccttttcaagtttcccttgtgatttcctcccttccatcaccaccagttagttctaacttgttctataatttagaacttctaccaggttccagaaatctgtggtgaggcactgagacaatggaggttagaactcaaacacatggtggcttaaataaagatcatctgatttgggtgtagtagctaagaagagttagctttggttttaaaaagtgggccaggcgcgttggctcatgcctgtagtcccagcagtttgggagatcgaggtgggtggatcacttgaggtcaggagttcaagaccagcttggcccacagggtgaaacccccgtctctactaaaaatacaaaaaattagccaggcatggtggtgcatgcctgtagtcccagctactaaggaggctgaggcaggagaatggcttgaacccaggaggtggaggttgcagtgaataaagatcgtgccactgcactccagcctgggtgacagagcaagaatctgtctcaaa

SEQ ID NO: 250163 - DNA, 727 bp, Homo sapiens
aggggtcccgaaccagaccccaagagagggttctcagatcttgtgcaagaaagaattcagggtgagtccacagcgcaaagtaaaagcaggtttattaagaaagcaaagtagtgaaagtacagctactccatagacacagtagggcgttcctgaaagagaaggaaagcatccaccctgggtacagtgcttgtttatatacaggataaaaagatcatggggggatgtgctctgctacaagcattcgttcttaattactgtattttgcaagaatcaatattattatctttaaagcaaaattaggaatgcctttgctctccatatattgggatattaggacagtcccaagtctgggtctgtttagtaaatattatcaatctgttcccttcaccggaaacatctagaggctagatgctgggaaggcagcccagcaagtcccagcctcattttccttgccctcactcaagatggagttgctctggtttgaacacctctgacaccctggctgagaaggaagtccattcagatggttggagaggtgttagaagtttattttgggtttacattttttgtgtttttttgggtagcatagttaatggacatagtacgtacttagaaacaaaccatttttccttcagactttattcctggagacatcactttaaacaacatctttccaagctcaaggcaaaattctctctgctggtgtctgtcagatgtcaacagaaaa

SEQ ID NO: 250164 - DNA, 390 bp, Homo sapiens
ggatcttgttaaaatactgactttgaataggtctggagtggggcctgagagattttgcattcctaatcagctctcaggagatgtcattgcagcagacccaggtaccagacttgatataggaaggctgtatgccacagttgcttttattttggataagcttggcggattttttttttaaataaatggaagttgggcatcttatttaagattttaattatgatgttcttcaactatgaaggtaatacttactttaaaatacaaatttttggctgggtgtggtggctcacacctgtaatcccagcactttgagaggccgaggcaggaagattgcttgaagccaagagttcaagaccagcctagtcgatgtagttagaaccccatctctacaaa

SEQ ID NO: 250165 - DNA, 380 bp, Homo sapiens
ggtcgataagaagcagcctgccctgctaggctggggtggtgggtggggggtcttccaggcataggaccaaggcaggatggagccagggtggctggagaggagtaccctggggcctgaccagctagtcaggaagtctagctaggggtcaggaagtctagctagtcaggaagctaggggtctggaagtgagggtcgcaagtaagaattttacatcgagggcacagaaaagccatggagggtttcatgcaggagagccatgtgatacagtgcttttatttatttatttatttatttttgagacggagttttgctcttattgcccaggctggagtgccatggcgagatctcggctcaccgcaacctccgtctcccgggttcaag

SEQ ID NO: 250166 - DNA, 602 bp, Homo sapiens
ttgggttgatggtggttccatttattattaagaggaatactgatgagagaataggagaggttattttgttttgtgaggaggacaatttgagaatcaagttctgtttgacctgcgtaaatttgagatgcttgttagatatccaagaaaaaaatgtaagtagtcagttggggcttggtgttcagaagagatgttcaagctagagaaataaatagaatatggaattcatcagtgagtagtatattcatcaatttcaaaaactttttgttcactttcctgcttctaagagatcagatacatcgttgtgatcattgtcagtcaggtaggagtcatggcatatttgtcatttgctattggagtgtgcacaggcagactgccagaatcagactttgcaggatggatgtcagcagcttggggaaaaaatctggagacaatattggagcattgttgtaatcctcaaaaacccaatgatttggagggagggagggcagaagcagtgattcatacttgttaatggactttcctgaagcaggagccaaaagtagttagctttacataattgagaccccagcacccttagcttttagttcttttttttttttttt

SEQ ID NO: 250167 - DNA, 265 bp, Homo sapiens
aatgggtttgaatgttatagagtaaaaaaattttgtgttatggttttagattttacagggcaatttatcattaagaaactattattcattgagttttgatatagtatcaaagtgctgggattacagaagtgagccatcatgccccgcctctcggttttattttctagtagggtacatttcaagagatgcaacccacataaacaatgcttcttcctgtcttccaataatttttaagagaataaaggggttctgagaccagaatgtt

SEQ ID NO: 250168 - DNA, 450 bp, Homo sapiens
gtagtattctcaggtggtgacttttgagcagagcactgcaccatgctgagaggacctggggcaaatgtggaccttctcaccccactgtgcagggatacaggggttgaagccatgacttagccggctggagagcagtggtttttgccccagcaacctggtcaatgtcaaggaagccgatgtgctcagatgtaggctgggcacccccttcctgaggtgtttcctgtcacccaacagacaggctgcctcccagcctccagatggaattgggattgccacctggcttaagatgcaggtcccttttgtggctgttctttagctggaaagcagtgttttgcattttgttaacatactcaggaggcctgactcctggctgtggtcactttacaaagaaagttttttccatgtaacagaaaagaaacccaatatgggagtttttgtacttcataattt

SEQ ID NO: 250169 - DNA, 899 bp, Homo sapiens
tacggaaatgagcaactaccaaagaagcaaaataaataaccaagggaaacttgttaaagggaaaataagggtagaaaagtaataaggccaggagtcaggttagcacacagatatgcatgtttagcatctcatcctcagagttactcagggtagtaccagattggcactgagcaagatcctggcactcaaagcagaacaacacaagagtcacagtctactctactccattgtggtagacactccccagaactaccttgttctcctataacacagtggggttatatgtgccccagggtacatttggctttctggagacattttttctttggcaaaactgatgggaagagatgttactggcatctggggagtaaaggccagggatgctgcttaacatcctacagtgcacaggacagcccctcaccacagagaatcttccaggccagaaagttaacagtgctgaggctgagaaactcatttataccagagcctcagttctgtttggagcaggagtgtgccacaccccaagagaaaaatcactggtctaggtccatcttggctttcccatctctttccactacatacttgtcttcccagctttccttgaactaggggagtctgccaggaggtttctggggaagttttgcttttggataaaagaaacaagggcactgaggaaaacctcttctcctcctgcctccagcttcagacacgtaagtgcagacatgacagctgaagctgggacagccagtttgggttataatggggcaaatacaaggaccaaagacaacgcagtgaggagggcagagaggaaggaaggcaagagagtgggatctggctgacattgatgatcatcattgtagcgctgttttaagcccatcatttcactcatccaacaaatg

SEQ ID NO: 250170 - DNA, 1865 bp, Homo sapiens
ggtcgcggactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagta

SEQ ID NO: 250171 - DNA, 2010 bp, Homo sapiens
ggtcgcggactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagtaatggctgattgtgtcattttttttccccatcaaaatccttgattgatttccctggcagagcccagagcaggctgtgcaagggcagggactagtgtgtggtcccacatggctggtgccctgccaggcacgttctcacttctcaagg

SEQ ID NO: 250172 - DNA, 3126 bp, Homo sapiens
ggtcgcggactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaaccgcttcgccgccgggcctcgggcaccccacgggcccctggacatggcccccttcgcccggctgcacgagtgctatggccaggagatccgggccctgcgtggcaagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagta

SEQ ID NO: 250173 - DNA, 2811 bp, Homo sapiens
ggtcgcggactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagagtttgctgaggatgatggcttccagctccatctatttccccgcaaaggacatgatctcattcctttttatggctggatagttttccatggagttgtgggcgcataggccagctgcttccaccctatgagcgtcagtttcctcatctgtgaaacggggatgtagagtggctgcaaggtccccttggggcactgggtgacctagcgtcagtggccttgtgcataacagcccttctatggggtccaggccccaggctcccctccaggccccgcgattgccaccatgaaggctgtctggagcactgaggccaccttcaggcctggacccgagccccctccaccaaccgcttcgccgccgggcctcgggcaccccacgggcccctggacatggcccccttcgcccggctgcacgagtgctatggccaggagatccgggccctgcgtggcaagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagta

SEQ ID NO: 250174 - DNA, 2590 bp, Homo sapiens
ggtcgcggactgtccggttgctcccgcctccttccgtcggatccgcgctctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagcccagatgctgcagagctgacatttgaatccagagaagagcgagctgaggctggagctgagcagagggcagggaggcaagtggtggcctgagaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcgggggtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaaccgcttcgccgccgggcctcgggcaccccacgggcccctggacatggcccccttcgcccggctgcacgagtgctatggccaggagatccgggccctgcgtggcaagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgactcttccatccatagttaagagctctcgcgggggttctctatagatctcgccccaagcc

SEQ ID NO: 250175 - DNA, 390 bp, Homo sapiens
aaagggaaaaagagagggaccaaaaaaaatagcatccatttgaaatagatggttttaatgattgtattgcaatgtcatgcacgacattgtgaatgtaattaataccactaaaaatagttaaaatggcaagttgtatgttatgtaaccattttaaatgatgtaatatgccaaaaatcacagtgtgcattttaaatgaaggaattatatggtatctgaatttatatctcaatagagctgtttttagaaggtggtatccacaagcaagcatgtgtgtgtgcacgtgtgttggagtacattcacatgcacatgtgtgtgtggcaagagtgtcagtttcctagctaatctactttgggtggaaactgtcagtgatgactaggcaaaggtggagaa

SEQ ID NO: 250176 - DNA, 1103 bp, Homo sapiens
gcaggtagcagctgctttctaggatgctcatgcccttctgacctcaccaactgagcacttcaggggtaagctgtatataagttagacccattatcctaattacatgtcttaatttaaatgatttaaaagcatataaactataagtgcaaaaacaagttgtttctcaaaaaactaagttgaattccttgaatagactcagcaaagaacaatcactaaaaagtaacaactggctgaattaggggtgtgttgggtgaggggactagaaagactagaaaaaaaaatcatgaaaacatggattctgcagtcagattccattgatattttaaagaaactgacactgggcattgtagccagcacactttgggtgtggtttatatgagaaagatgaggcagaactctacttcagcagacactcaactcaaaaagactggcaaatggacatgtatttacatactttacattcaaataaaatgtgtaagataggaatctgatttgctttgggtctctttaattggctttttcaattaacccaccagccaccataccaattgcatcagctgtaagtgctttttctactctcttatgttccattctggcaccaaatttcacgataagcactgatatgctagaacatattccagggagagggataaacatggaaaaggctctatggctcaggtagcacctggtggtgtctataagctctgatgggctgtcaggctcaaagataaacagattcagagggaagaagagggtctctgtatcttgctctttacctattcatctatgtagttttttcctttcctttccaagaattaccctttctgctcacatactagactgtaaactcaaagaaagtaaacaaaatacctgttataaatgccctatggatagacatttatcttacaaatgcctttaattttaggctgtaggtttccaaccgagcaaaatgcaattatttgtatttgactctacaggttccctagcccaacctcctctgtgcttttagcataaaacgaaggcaatggggggaggatctgtctcactgatgataccaggtgactgacacagaaagcagtatgtagtgagggcttactatgtgc

SEQ ID NO: 250177 - DNA, 769 bp, Homo sapiens
cggccctggggcggggagacagggggcggctccactccggcgctctgcggaggacagcagcgatcgccaaggctcagctggagtgcagtggcatggtggcatgatcttggctcactgcaactgctgcatcctgggctcaactgattcttctgcctcagcctcctgagtagctgggactacaggcacacactaccacgtccagctctatgatcagaagatggcataagtggggctgggcacagtggctcagtgcccagctgggattacgcctgtaataccagcactttgggaggccaaggtcctaactcctcacccttgtcacactcctggtaatgctgtaaaactttaccatggaccacagttccaaggacccccgaatgcagtcatggagttaagcctgtgaacaacccacacctcctgtcaatgctggcaatgttcagagcataacaaaagaaaccagaaagctgacatacttcctaccccaaaatattttgtcctgttgggggaagaggctcatatcccacctggatgagcactttcatgtgcatgagtcgctaggacaggatggtgagaccggagtccaggagcatctgactggcaagcaacatctgccgtgacagcacctgtattattctgttttcatgctgctgataaagacatacccaagactgggaagtaaaagaggttaaattggacttacagtcccacatggctggggaggtctcggaatcatgctgggaggtgaaaagcacttttttaatagggtgag

SEQ ID NO: 250178 - DNA, 643 bp, Homo sapiens
accttgtgatgcgtgaggaaaaaatattaccttttccccctactctttctggcacccaacaaacaagtggggtggcaaagacaccccacttgggacaactggcaaaagctctatgatcagaagatggcataagtggggctgggcacagtggctcagtgcccagctgggattacgcctgtaataccagcactttgggaggccaaggtcctaactcctcacccttgtcacactcctggtaatgctgtaaaactttaccatggaccacagttccaaggacccccgaatgcagtcatggagttaagcctgtgaacaacccacacctcctgtcaatgctggcaatgttcagagcataacaaaagaaaccagaaagctgacatacttcctaccccaaaatattttgtcctgttgggggaagaggctcatatcccacctggatgagcactttcatgtgcatgagtcgctaggacaggatggtgagaccggagtccaggagcatctgactggcaagcaacatctgccgtgacagcacctgtattattctgttttcatgctgctgcaaacacacaatgcagctgcaaacacacaatgcagctgcaaacacacaatgcagctgcaaacacacacggcaggtgcttacaagcaa

SEQ ID NO: 250179 - DNA, 511 bp, Homo sapiens
cagaaggcagatacactttcactcctcctggaagactctcagatagaagaaacatagtactagcctagacattgctacaattattacattatctctaatcaaaggaaaggagtattttagaatccgtctttccttgaaagagagatgaaagattaagggataaaaaaaaatagggcggatatgctttcacttctctggtaacttctggatacatgagataactatgatacacattcaaaaccaagtgatactacatgtacagcatcatttaattacacctacagaaagaaaagaatggtttacctaaaaaaattagtgttgccacaactggtcactcagcagaaaacaaattaggtccctcatctcacttgccaattacaaaaatattccaggccaagtgcagtggctcatgcctgtaatccaagcactttgggaggccgagctgagtggatcactaaggccaggggtttgaaaccagcctgggcaaaattgtgagacccaatctcttaaa

SEQ ID NO: 250180 - DNA, 600 bp, Homo sapiens
gaatgttatacaggagttgagatgtaactattttgctttgtaaatatcctgcctttaaaaaaaaaatcctctttggacagctccgggaagtactgaacaagttgaagttactgcttctacagcctgggaggtgtttatgatgaacctattttagcattaatgttgattataccaacttatcatcttaactttcgagtagataatattgtttgggcactaagacacatttgtacttttatactgactgttctctttgccaggaattttctttttctttagagatagggtgactctgtcacacaattactcagtgtttgcagtgactttataaaacatatttaccataaatcacaagaatcaactgtgcatacagacgactttagtacaaagaaagaaatatacacagaaaggatactgtagtggagagtaattggtagtggtaggagagagaccttttcaaaatcattttgaaaggattttagttgagacacttggaacaaacaggagaaagagcatttttgtaggcatgaggaatggctctaaaacaggaaggagcttgatatttttaaggaattgaaagaaaagcaacgtaaagaaaga

SEQ ID NO: 250181 - DNA, 333 bp, Homo sapiens
gaatgttatacaggagttgagatgtaactattttgctttgtaaatatcctgcctttaaaaagagaggaacaaacaaccaaaaatgagcaaccattgttatttacccaaagctaagctgtttcttaatagctgtactctatctcttcagtaagtaatttgccaggagaaatacaatgtttttaaggaatatttttgtcagcgtaaactgttaaacactgaatcccaacttttagctatctgaaaaatgtatacttaaataatacattatggccatttgactcaaatgtaagttcttttgggatggtttttcattttcttaaaataagtgttcag

SEQ ID NO: 250182 - DNA, 396 bp, Homo sapiens
agttcaaactatatcctattagacattatcttgttaaacagttcctgttgctccatgcttttgagatgttttttaatctctggtttcatcctgttaatttattctcttggttgtaagcgacacaaatgattgacgagttcccttgtatatttgcatcagcatcattcactgaaacattctcgaaggtagggcatatgtcagagtcctggcagatgtaggctgcttcacactgtgcctccagattgggaaaaggtggcattcctaatcaccgggggaagtaaattcatcaataaatgtggtttaggacagctgaagagctgttagaaaaaaaagggagctggggtccctccaacattccttagataaaaataaactacataacaaagaaagtctctt

SEQ ID NO: 250183 - DNA, 467 bp, Homo sapiens
aaagatgagggtgccagataattccactcactctctatttggaggtttcctgtggattattgtaaatgtgcgctaaccaatttcataccctttattattttttaaataatgtaacaggtcaccttgggctgcagggacacttggcaaccatttttacagcttttaacttttggtgcccgggccgggtgtggtgtggtggctcatgcctgcaatcccagcactttgggaggccaaggcaggtggatcacctgaggtcaagagttcgagaccagcctggccaatatggtgaaaccccgtctctactaaaaatacaaaaaattagccaggcgtggtggcgggcacctgtaatccccactacttggaaggctgaggcaggagaatcccttgaaccagggaggtggaggttgcagtgagccgagatcatgccactgcactccagcctgggcaagaagagcaaaacttcatgt

SEQ ID NO: 250184 - DNA, 584 bp, Homo sapiens
ctgactcctaagtatttacccaagagcaataaaaacttacagttacacacagaaacctgcatgccaatatttataacaacattatttcatagtcacccaaacctgaaaacaatctgaatgctcctcaaatggtaaatgcatacaaaatggggggtccataaaaacagtgagttacgagtcagcaattaaagggaacaaactatagattcatacactcaaccacatgattgaacctcagaggcactgcaccaagtaaatgaagccagactttggaggcaacattttgtatgattccatttatacgacattctgtgaaaaggcaatacagtagggatggaaaacatatcagcattttttcatggactaagtgtggagggagggttgactacccagagacaggaggaaggaacgtttggttaatgacactcttcagtgtcttcacagtggttgtgggtatataattatatacaactctcaaaccatatcaaaattgcatatgataaagagttaattcaactgtatctaactttaaataaattaaaaaatttaaaacactggatgccactatgctctcactagaattg

SEQ ID NO: 250185 - DNA, 386 bp, Homo sapiens
acgttattttaccacaatcctgggagatttacttcatgaatgcaaggatgtttcatcatatataagtcaataaatgtgattcatcaggtaaagatgattaaaagctaacatgattatcacaatagatacagaaaaggcattcaaaaaatccaatacctataaaaatattctcaacaaactaggtattaaagaaacatctcaaaatagtaaagccatctgtgacaaatctgcagctgaaatcatgctgaacaggcaaaagctggatgaactctccatatgaataaaaataagacaagaatatccactcttaacactcgtattcaacatagttctggaagtcctagctagagcaattaaacaagataaagaaataaaagagatctaaa

SEQ ID NO: 250186 - DNA, 489 bp, Homo sapiens
caatgagatttcaggaggatggacaacattttttaaattttgagacaggatctcactccgtcaccaaggctgaactgcaatggcatgatcacagctcattgcagcctcaaactctggcctgagcaatcctcccaccacagcctccccagtagctgggcccacaggcttgtgccaccatactcggctaattcattttaatttttgcagagacaggatctctctatattgcccaggctggtcttgaattcctgggcttaagcgatcccctgcctcggcctcccaaagtgctagaattataggcatgggccaccgcatcctgcctagtcagaacatgcttaaagcaggaatcttaaatagaatgcaatgtcagctgggcacggtggctcacgcctgtaatgctagcaccttgggaggccgaggcgagcagatcacttgaggctaggaattggagaccagcctggccaacatggtgaagccccatttctactg

SEQ ID NO: 250187 - DNA, 768 bp, Homo sapiens
ccagtgtgtagtcttttatccctcaccctcctccctattctttaagctgatctatttgcctacttaaattatataagtagtatcttttctatctatagtaataatttaatattgcttctgcctttatcctaatgaaaggaatatctcttcactattaaaatatgcatgcaaccctatttcccagtgtaaataaagtgactctcaattttccacttccatacctccctcaatagaggtttgtttttaaagtattgcagaagcacaagattttgagatgtatgcaaatggatgctcctttttcagtcacttattttcaaaaagaaattatcccctcctgccttgcccctgctgagcccctacatctcccagcccctaataaaaacctagcttttacctagaactttcaaccttttgtcttcacgtcagctcccacaactgtaaaaatatgagatttggccagataaatgatcaatgaggttcccttaggctctacaattctgtggttctatttcctggaaaatcatgtaattgaaagccagtgtttggtgcaatgaacatttaaggacatcatttttaaaaacagcagcccattttaacttccattgcagaaagatgtggtcttgttggatttctaattgcaaagcagctacatgtggtctacatgtcaacttttaatagcataagcatatttcggttgatagaaatgtaaccacactgtatgaaagtggctccgaaaaacctagaaaattgcatatctgaaaaaaaaaa

SEQ ID NO: 250188 - DNA, 714 bp, Homo sapiens
ccagtgtgtagtcttttatccctcaccctcctccctattctttaagctgatctatttgcctacttaaattatataagtagtatcttttctatctatagtaataatttaatattgcttctgcctttatcctaatgaaaggaatatctcttcactattaaaatatgcatgcaaccctatttcccagtgtaaataaagtgactctcaattttccacttccatacctccctcaatagaggtttgtttttaaagtattgcagaagcacaagattttgagatgtatgcaaatggatgctcctttttcagtcacttattttcaaaaagaaattatcccctcctgccttgcccctgctgagcccctacatctcccagcccctaataaaaacctagcttttacctagaactttcaaccttttgtcttcacgtcagctcccacaactgtaaaaatatgagatttggccagataaatgatcaatgaggttcccttaggctctacaattctgtggttctatttcctggaaaatcatgtaattgaaagccagtgtttggtgcaatgaacatttaaggacatcatttttatctaattgcaaagcagctacatgtggtctacatgtcaacttttaatagcataagcatatttcggttgatagaaatgtaaccacactgtatgaaagtggctccgaaaaacctagaaaattgcatatctgaaaaaaaaaa

SEQ ID NO: 250189 - DNA, 707 bp, Homo sapiens
gctcgggataagtgtcttaaaatagttattttggaataaacctcacagcattttagatgccatcagaaggttagaaaaaaaaacttccagaagcctcccattagggacagtggagggaacccaaagctgaactacccacctaggaaggggctgaggaaggaaaaactgctgcaggctgaagaagcgtccaccactgtgggactgttagaaacttctagggggtgctggttggtgggggcagcatctgctgaatggagttattaccaggtttccccctgagagctgcagtcccaacatcagaatgaagagatctaactgcttagagatttctgttaccatcttctttttgatgtgaattactcttgaaatgccggagaagggacaaatttcaaaaataaaatgaatcatacaaacattgtcagcttatttttgcgtaatggcattaaaaacaagcaaaaattctagaactctctcacatgctgttcgaaggaaagtttccctgagacttgaaggcaacagatgccacatactgaaagaaggtagacgactaccagacaaggtttgcaagggaggtggtgtgaaaaccagttccattatcttgaccctcagccatatcaagagcatataaaagttgggagattggccaggtgcggtggctcatgcctgtaatctcagcactttgggaggctgaggcaggcggatcacaa

SEQ ID NO: 250190 - DNA, 506 bp, Homo sapiens
actttatttcaggcatgtattggggaactgctcctttcttcctgaccccacaatctcattaactttgaaatgagcaaaggatgtaagcagagcaaagaacactagaataatatccaggacactgggggaaaggcctctgtatattatatatgacttcagcaaataagttaagcttcagtatcctcatgatgaggaagctaaaaataaccctctttctattcctgcaaaattgtgagagtttattgaagtgcatctcataaactataaaaaactacaaaaatgcaaacagatgcataatgaaacaattaacttgttaaaatgtaccttctaagtatagtgagtgaaatcaatgctggagagaagaggaacataattgaacttcgttattaagaaaatgcgagcatatatagcaactaaaaatttgtctgagacaggtggatgtaaaaaattaaagtttatggtagataatcaggaaagcaataatccacctatttcataccttaaaa

SEQ ID NO: 250191 - DNA, 1611 bp, Homo sapiens
gttgtcggtacaggctggcatgaccctaaggtgtcactctcagcttttgagggtgctctgttcaaagacagacaaggacttttctttccttaaatgcggtcctctgtgactttgctgttttagattttaggattaagtttaaaatgtgttgggcactgacaaggataagaaattgttcttcctgtcctctctataggcagaaaaccatcttttccaagagagagagatggcaagggtgtaacagcacagttcagagttatcagtcagcaagagtgaatgtgcatagccttcctctcagtaaagtggatccatttgaaggagaaaaaggaaacaaaagtctctgacattatattattctgtcagttactgctttctctagaagtagagaatggaccaggaaaccggtagctgctttgatattattttacctttttcctttcttgagaattatagattctgtacctgttttcatggacatgagatagcaaaatcccctcgggcacaagcatgtgagggaaaactgatttcctgctatcttcctggctagaacattcttacttagcctactcaccatgctagacattttccagtcgttctaaaaccctcttgatgaaggaatgtaagttcctggagcttggaagtaggaccttctatgggttaaaatatttagctcttacccatagtgaagagctaacgacattgatgatatggctaattataatagatataattaggtaggtaagttaaaacagacatagagaccagctgaagagtctttatttttattgatttgtaggataaggaaatatttttatatgtgctattatttctatggtaggaatgtttaacttagggaaaattaatggaaaaacaaagctttctacacttctcaagtgtcctgcttcaggcagttttacctacaacagcactgatgttgaatttcactttaagttgtcacatggtctgagttgtacaaaaagaaagaaaaattctggccgggtgtggtggctcatgcctgtaatcccagcactttgggaggtcaaggcgggtggatcacgaggtcaggagaccaagaccatcctggctaacacggccatctctactaaaaatacaaaaattagctaggcgtagtggcgggtgcctatagtcccagctactcgggaggctgaggcagaagaatggtgtgaactcaggaggcagagcttgcagtgagcagagatcacgccactgcactccagcctgggtgacagagcgagactctgtctcaagaagaaaaacagaaaaacaaagaaaaaaaattccaaaagggtgaaggaataaaagaaagaaaatgttgtaagaatgtatagaaaaatattctaaagaaaactgctagagacaaataaagtataaatatattttagagaaccgaaatagttcctaaacacgggggatattttcgggcaccacaacaggggtgattctatcaaatctcggccggaagaaaatatatatcatatatagtaagacacaaaagcgggggagcagaatgacaccccatagaggtggtacaccccacaaataggggacaacttatatatacacgtcaagtatttatgaatgtgaacacac

SEQ ID NO: 250192 - DNA, 236 bp, Homo sapiens
ccccagcacacatgctttgtttttggccagactttctgagattcagcaggaccaatcttctgtgccctaggcattcattatttttaagggttatttactgtttagacaacaattccagatgttcaagagcatggcgtttccatagcgccattatccctttgccactgtttttaggtctctatttttggtcaatgtttttcctttatacaaacatccttttaatatcattgagatcc

SEQ ID NO: 250193 - DNA, 438 bp, Homo sapiens
ggaaataaaatatatcacagagtataaagtcaaaggcaatacattcataatcaatagttattttcaatcacgctgttggttggttggtcacattccttgcctacaccagatttttgtatgatgctttatgttaataggttttatgtgaggattagaatcttcactggtgctggatccattgtaagccaccttggcacagagaagccaatctgattatctcagggacaacttggaacctcgtgtaagagttctgtttcagaaggggaacatcacacactggggcctgttgtggggttgggggaggtgggagggatagcattaggagatatacctaatgtaaatgatgagttaatgggtgcagcacaccaagatggcacatgtatacatatgtaacaaacctgcacgttgtgcacatgtaccctagaacttaaagtataa

SEQ ID NO: 250194 - DNA, 256 bp, Homo sapiens
cagggccttcagatttctccatctgtaaaacaagggtaatgatatttccttctccagctcatcagaagagctaacacgaaattctggagagcattcttggcagctgggaaagaaggtaactaataaacctgattatttttaatagcataaggacctaacaatgacaaataaatgtctggtctctcttacgacagggtaaaaacaatgtaaaggagagacatacgtatggtgtaataaatcagccaaatatcttgga

SEQ ID NO: 250195 - DNA, 148 bp, Homo sapiens
taaaaaatgtttaccccacgagaaggcaaaaaagagaatagagggagagagaatgaatgatacaccatgaacaagtgcagtttattttgtggctacaaggttggatcaatgtttgaaagtcatgagtgtaattggtcctgtcagtagg

SEQ ID NO: 250196 - DNA, 888 bp, Homo sapiens
agctacttgggaggctgaggcaggagaattgcttgaacctgggaggcggaggatgcgatgagccgtgatcacgccattgcactgcagactgggcaacaagagtaaatctctgtctcacaaaaacaaaacaaaacaaaaaaaaaacaaactgaagattttgattggaattatacttaagtaattttcaaatctggggagaagttatatctttacaaaacttattttttcaatccaataacaaggtcagcttaacatatactttttctttctccttagtaaatatttgcatttttcaggtaggccctacacacttactaatttaatttctgtgtattttatatgttcttattttacatgttgctattataaatgggacattattttatttttatagttgactattgctatatagaaaacatatatttatgtattcctttttaagtgtccaaattactttttttgattcaagtgggttttctgggtagaggaaaaagtttctctttcaaataatgatcattttacctcctctaacatttatgactagtattctttttcttatctgatagcattgcttatgacttcagaaataatagtagtggttacaaatatgtttattttatccttcacttgaataggaatgtctttaggattgttatgactgatatttgttggctgcacatagacattctttaaacaagtgtcccactgacttgtgttttgcttttgctgctttaagctagaatgtcccaggtagtacacacacaatctctctcacacacacgcaactctcataatacactcatgaaaagaaaagagttctttgagattctaatatctgggacctttgtggtagataatcaggctctatcctcagaggaaaaaaaattg

SEQ ID NO: 250197 - DNA, 365 bp, Homo sapiens
ttgaagtgattctcctgcctcagcctcccaagtagctgggttacagtcatgcgccaccatgcccaactaatttttttctatttttagtagagacaaggtttcaccatgttggttaggctggtcttgaactcctaacctcaggtggtccacctgccttggcctcccaaagtgctggaattacaggtgtgagccaccgtgccctgcccacctgtcagtcatcaccatggtaagacagctccaggggtcacgaatatccaggcactctggctctgtgtgtgtgtgtatatgtgtgtgtgtgtgcatgtgtgcatgtgtgtgtgcatgtgcatgtgcgtgtgtgtgtgtgtgtgtctgaattttgtgca

SEQ ID NO: 250198 - DNA, 309 bp, Homo sapiens
aaagtagaaccaaatacaacttgcaagggaactggatgcttctggaagagtttgataagtgttgtttgagtttataaagtaaattaccttttttactttccaggtaaaaaaatatacctttgggaggggaacaacacacactggagcctgtcggggggcggggccacaggagggagagcatcaggataaatagctaatgcatgtggtgcttaatacctcagtgatgggttgatggatgcagcaatccaccacgcacacatttccctgtgtaacaaatcctgcacggcatgcacatgtatcccggaactt

SEQ ID NO: 250199 - DNA, 487 bp, Homo sapiens
tgtaaagaaattataaaatgtcatgaaaacaaaagagaataatatgtccaagatcagcatttcccacatgacaaacagtaggcttcctgaaattccaaaccctcttcctcctattgtattgacttgctcataaacaataccaacagacaaaccaacagagaatgcatggaacagattatccgtaccttaggccgtaaattccacgcagataacgtcaagatatgggcaggttccaaaagagtttctgcctctcccaacctacagttatctgggctgaggcagccccctttttgaagctgtgtccatggaatttatgatctgatgtagggttgttctgttctactggcacttcacggttacaggagaacaaccccaggacagagcccagcagtctgcccaaacacttcaaattctatctgcaaagaactccaggccttgctcaacccactttctgggtggaatataataaaaaattttccttaattca

SEQ ID NO: 250200 - DNA, 424 bp, Homo sapiens
tgtgattcactgaggacggcagccttcccttcagcattccatccttcacccaccaccctctaacacaaaagagattaccacaagaggacttggaccctacactcatgttctgtttgctttctgggttttaggctaaagcattatttacatactcctcatgcaaatatccacttggctatttagagaacaaagcagtgcctactggaaagattttttttaagtattaataagtgaatgcattctattattttaaaaatttgtgatgtctttatccctttgtcagctccatactttgccccatacactcccatacctgtaatcaggacctcctttttgttctagcccatgaattcctaactgcactcctttcctgccatgtgcttgtgagagaaaaaaaagcaggcataaacctaatgctaataga

SEQ ID NO: 250201 - DNA, 303 bp, Homo sapiens
gaagaaagtacattcaaaattatagtgttggcacagctcaggccaaattgtatcagttgtttctagtaactatataaacagaagtatagaatcttgagtatcttataattaaagacttctaagggcctgatctgtataaatacggagactgtaagtattgagtttatatacgcttttaaaaatagaattgagctgactcacaaactttgttaaatatgtacacaaactactcacttattggcacatagctattgtttggttacaaaaataaaacattgctaatgaaataaatttctgggtata

SEQ ID NO: 250202 - DNA, 328 bp, Homo sapiens
ataaaacaattccttgtacttgtctctataatactataatcctacagttaagaaatccatcacacctttaatcccagcactttgggaggccgaggcgggcggatcaggaggtcaagagattgagaccatcctggccaatatggtgaaaccccatctctactgaaaatataaaaattagctgggagtgctgatgcacacctgtagtcccagctactcaggagactgaggcaggagaatcgcttgaacccgggaggtggaggttgcagtgagctgagatcgtgccactgcactccagcctggccacagagccagattccgtctcaaaaaa

SEQ ID NO: 250203 - DNA, 368 bp, Homo sapiens
ccccttgagtgttcaccccgctcctggagggtgggtcatccactctctgtaggaaagggcttttgaggagatcttagaaggccatagcaattgacttcaacgaagatgtggcaggcagggagttctctcttgatgtccttgcccgtggttgcacaggaaggaagtctgaacaccttcattccagcctcaggctgtctccagtctctgggtcctgagcaacccagacccagtgggtagggggcaggaaagcaggaagagccagcttctgtcctctcttccgggccctttgaagcaacttgccacttggcgttttgtgggttaacttaggtgccgtttgaatgtggtataattaaaatattaatgctttg

SEQ ID NO: 250204 - DNA, 130 bp, Homo sapiens
agttttgttcattgaagattttaattaggaaacaaagcttagcaggagaggagagccagagaagtgacagggaagctacaggttacgacagatttgtgaactcagccaagcacagtggtggcagggccta

SEQ ID NO: 250205 - DNA, 275 bp, Homo sapiens
agaattatccctttaagaaggggcttctattcttccagttcatttggagatatggcacttctcttgattatagtgtgcctagtcttctgacagctgatgttatacattgagtacattgaggtcaggaccactagctcatcttttctttttttttatttttttagacagagtcgttggaacccgggaggcagaagctgcagtaggcagaagctgcagtgagccgagattgcaccactgcattctaacctgggcggcaaagcaagactctatctcaa

SEQ ID NO: 250206 - DNA, 655 bp, Homo sapiens
ataacatgccctaagccctgtgtcaatcactgttctccagagaaacaactgataggatatgggtgcatgtgcctgtgtgtgtgtgtgtgtgtgtgtattcattttcagaaattggtttatgtgattataggggctggtcgaatgtaaaatttgtagggcaggccagcaggctgggagctaggcagacgttaatgctgcagtcttgaggcataattccttttctgaagccctaaccccctcaatgcctcagaatgtgactgtattggagatagggcctttacagagataattaggttaaaatgagaccattagcatgggctgtgatccagtctaactggtgtcttcataagaaagagagatgaggacatgcaaccagggggatgtgtgtagagaggatgaccttgtgaagagacagtaagaggatggccacctgtaagccaaggagaggggcctcagaagaaaccaaccctgttctgacactaggagcatgacaaataaattcctgttgtttaaaccacctagtctgtggtactttgttatggcatccccagaaaatgaatgtatacatatagtgattctatttttaacattttgaggaacacaccatactcttttccatagcggctgcattgttttatgtccctccaacagtgac

SEQ ID NO: 250207 - DNA, 533 bp, Homo sapiens
tgtcttccaaatgccctccactcgatttgtgtttgtgtattctgtactgggtgtcccgcacacatgtggctctgaagggaaggacccattccttgaaatcagttcaccccacagcctctgtgatgccttccctcatcttccaacttctgcatgcccgtagctctctagttacatcctggacactgggattaggtcatctgccttgattactcccagtcccattagactagatgcctgtagaaggcagggtcctggcaaaatatcaatgtattcaatttcttttatttttttgagacagggtcttgctctgtcacccaggctgtagtgcagtggtgcgatcatagctgaccgcagcctcaaactcctgggctcaacgatcctcccgcctcagcctcctgagtagttgggagtagagatgcgtcccacatcgcctggctaatttttgtatttttgtggagaggggatctcgccacgttgcccaggcttgaagccagatcaagcaattgggttcttcggatttccgaaatagaccc

SEQ ID NO: 250208 - DNA, 490 bp, Homo sapiens
cacaggtgtgaaggggcaacccaccccttcatctgaacctttgggaaaatgtcagcctctgaaaagactttcttggcttgtgacagtggtgttttgtggagggcaggaattggggctgtttctctggcttgggaagaacagtcagtgaaaggatccccaaaatgaagtaaattaaccatagcaggaggtaaccgggagaaatagaaaccctccatttgctgttacccaagaatacccaggagtatggagtcttccagtgtatctgggaagcgagtttcaatctaaaaggtccatccaggagactcccattaccatttgggttccaattatgtgacatgagaacatttcatagtgaaggtggatggcatgcagtaggtaccaaagaaatgcctctcaattatgattttttaattttttttttttttgagacagagtgttgctctgccactcaggttggagagcagtggcatgagctcagcattgtctgagc

SEQ ID NO: 250209 - DNA, 606 bp, Homo sapiens
gtgaagggcaactgggagaagattgatagattctttagagacgtagcctaactctaagatggctagttttctggagagaaatggagaaagagagagctgggaagagactttctgggttagtaagaaatctcaagcactggcctttcctttcaaaggagtcagaatttgattggattagtctgtgaagcaatttattccctagggtgatgtcaaaaacaatcgagcaaccagcttgcaatgacgaatttagcagctgggtttggtcagggaaagagacaaagagagccttcccacacccccatcatatcaaggtggacctgcccactacttctcaggggaaacagactttactgcagtattccagtcattgcagctttcacctaaaagctttcacacaattgctttgggctattcataatagccccacactgaaaatccaggcgtccttcaatgggcgaacagttaaataagttggggctcgttcagcttatggaatatgtttagcaagaaaaaggaatgaactattgatacataccacagcctgctaatctccagagaatcatgctgaatgaaaaataaaaagccaattcaaaaggaaaaaaaatg

SEQ ID NO: 250210 - DNA, 194 bp, Homo sapiens
aactaaaagctgaacaaagtgactaaaataacatctcacagttaattggataatctgttattgagttaaataaatttatctcttaatatattcccagtagaattgtgtttttttattcttaggtaatagttttgctggtaatattaaaaaagttatatcacttgccacctatagagttttctttttacctttaa

SEQ ID NO: 250211 - DNA, 367 bp, Homo sapiens
agccttgaatccagtgacagtgtccttctaagagactgaaaggaagacagatacagaggggaaggcacgcatgtgaagatgggtggagagaccaggagatgcatccacaagcccaggaacacaaggaattgctggagccaccagaagtcctaacttccagagaggcatggaatgggtctccctcagagcctccaaaaggaaccaaccctgccgagaccttgatttcagacttccggcctccagaactgtgagagaataaattcgttgtgttaagctacccagttcatggtgatttgctgtggcagtcctagagaactattatatttggctaacacacataatagatctcacaacaagcaaaaacatg

SEQ ID NO: 250212 - DNA, 526 bp, Homo sapiens
ggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactgcccagtgtggaactctgttggatggcactagacagaaatcacatccctcctacaggatttctacaaagcacgtgttcctggagcaactattatgaggaagatagagaaggcctagaaaatttggtccctgttgcctttgagacttgcaccatcaccctgcaactgagcactctgaccaaatatcaagatcaactgtgctttctgaaagatcaaattaagtctaattttaaatgggacaaaaggtagcactctttttatattcctacttaagaagatatccttcttggttctgttccattttgcacatggagtagt

SEQ ID NO: 250213 - DNA, 856 bp, Homo sapiens
ctaccactttcaggagagtggttttaggcccgtggggctgttctgttccaagcagtctgagaacatggctggtagaggctctagctgtgtgcggggcctgaaggggagtgggttctcgcccaaagagcatctgcccatttcccaccttcccttctcccaccagaagcttggctgagctgtttgggcaaaaattcaaaccccacttggctactctggcctggcttcagcttggaacccaatacctaggcttacagggcatcctgagccaggggcctctggaaattctcttcctgatggtcctttaggtttgggcacaaaatataattgcctctcccctctatgtcatttcactgtggcaggaagaaggagcatgctggtgaatctgatgatcagcaaagaagtgaatgtggctggagctggagtggaaagtggggaagaaaaggacagaagaagaaaggacaagtggctgcagaagatcatcttgggtcttgtgaaacacggtgaggactttggcctggaatctggttctgaattagaatcacacttttactgtttactgacaatggacaagccacttacttctctgagcattagtttccttgcatgtaaaattaagaaaatatactctggccaggcacggtggctcatgcctgtaatcccagcacctcggggaggccgaggtgggcggattacctgaggtcaggagttcaaaaccagcctggccaacatggtgaaaccccgtctttactaaaaatataaaaattagccaggtgtggtggcatgtgtctgtagttccagctatttgggaggctgaggcaggagaatcgctcaaacccaggaggcagaggttgcaacg

SEQ ID NO: 250214 - DNA, 272 bp, Homo sapiens
tcccgtagagcacagggagagttgagaccgagcctaaacctggcccagggatccctgctggggacgacctaactgacctagtcctcctggggtaaaggaatgtctagagggaaggatggtgagaccagccagaggttccaaaacgcatacccctcctggcagtggtctagaatcctagatcaagggttggcaggagggccacatccagccagcagcctgtttttgtgcaacccatgagctaacaatggtttttacatttttacaaggttgag

SEQ ID NO: 250215 - DNA, 411 bp, Homo sapiens
atgtgcacctcattcattgtcggggtcctgagatttggttaccatagctgggcacatggcaggatgtgcctgcgtatctagcccttcatataatggcagaccctgagactcaaacaggcttttcctggccagtggtttcaaacacgtcctggtagttcactgctggagggagcacaccctgtgcaactcaggtggtgaaggactcaaaagcttatggctaccctctccagactgcttgacttacacctttttcctattgttcttgctctacagccttttagaggaataaagcccagttgggagtctaacatgctcctgagtcttatgagtcctgtttgtgaattatcaagcataaaggtggtcttgagacatccacacatgcacacacacacatacacactcatgaaaaga

SEQ ID NO: 250216 - DNA, 475 bp, Homo sapiens
tatttctcacatatgactagttatcaatataagtttttagaagtattatcaggttagcaataaaagcaatggtatgtaatcatcagcctagaaaatattgtcaattgtaaattataaaatgtacaaacgtaggactgactgaaaatactgcaaaaaaaatcaatgtttttatcagtggagcagtaagtaattgatatatggcaaatgatataaaatctgttgtgctttcaataaaaccataatgatgtaattatattatgcactagacatagccaaagtttctcttatttttaattattgtgatagaaatttactcttgtgtaaattgctgtatacctgtgtcactgatgaggaaattctaattatcttgaatagttttaaaaatgggaatgtttctgggagaaaggaattccccaaaagagaaaaaataaattgctcttttggcagttggattagtggtgaaagagtgttataa

SEQ ID NO: 250217 - DNA, 345 bp, Homo sapiens
tacgcaattggtccttacgctggatttatctttaaaaaaatttttttttgtagagacagggtcttactttgttgcccaggctggtctcaatctactgggctcaatcagtcctcctgcctcagactctcaaaatggattcatctggccaggccagagcaagacaccgtctcaaaaaaaaaaaaaaaaaaaagggttcatttatcttgaaacgacaagcaactacctgtgtagacctcagtctacagtacatatcaagcaattcaattttttcttgtaatgtcatgagcattctctgcttcttgggaacacttccagcatcaccaatggcaccttgtatgggtttca

SEQ ID NO: 250218 - DNA, 434 bp, Homo sapiens
ttgattgtaattggttagcttccttagatattcccaggaggaagtaatggcctcagggggcctccagaaaaaaaaagatctcatgaaatttctttcgcttagtggattgagcctggggctagctcatatgatgactatgggaccttcaatttgctgaatctatccacaagcttctacactctttgggagattggttaaaagtctctcgaagacaccaagacttcaagagaagtcttgagttcttcagagaagtctggagaagactgagaatttgtaaggcagtttcattgtttttgaagggttttttaatatcccctaattttacttgtgttggtctatctgtggaaatgtgtggtatgtacacacacacaaaccatactacagacaaactcataatacgaaacattaaagttttgtttctgctgttctgaata

SEQ ID NO: 250219 - DNA, 335 bp, Homo sapiens
tgattccaagtctaaatgctctttccaacaggcaatgaagatttccagtggaagtttctgttcaaggaatacagtgtgttacacattgaacagaaccagtaagatctgcagagatttcaagaatgaaatctatagaaaattctaaacatttggcttaaaatttttctctatatttaatttacagtttgtgccattccaatgacaaggtgtgctttctaaaaacaggtgtcatagatacttcttgatattctcttcattgctgattactgttctagggtcttggtagacaataattatctgccagttcaatgaatgaataaaatatatccatgctc

SEQ ID NO: 250220 - DNA, 348 bp, Homo sapiens
ctggaagattctataccaagataaatggtatacattacaatcccatccgtgctgtgcccccagcccactgccaaccccacagggaacacagcagctgctaatcctctggaaaggtcctactgcctgcagaaacttaccactcttggtaacggtgcttagatttgtaaacggaatatctacatttccaaaaaatgatcaactcccgtcatgctcccaggagtgtcagtctgactttgcctttgaggcttcatctctctctgaacacgactgcataaaggtaaggtcatggctttggtcaacggaaaaagcaacggctgcacagaggctgatggtgtgggccggaccccc

SEQ ID NO: 250221 - DNA, 665 bp, Homo sapiens
gaagtttacatgtttgaagctgggtcttgatatacgggataagagtgttttcacaatttgtacacaaatccttggctacacctttcttcaaatggtggaacctagttcaccacctcgagtatagcctgcccttagttaccctcatttctaagaaatagaatgtggcagaaaggacaaagtgtaacttctgagactagatcaaaaagtggcatgtggcttcctcctggctttctctgggatcagtagttctgggtaaaacaagttaccctgttgtaaagacattctagcagctctctggagaggctcctgtagcaaagaagtgaactctctcagtagccagtgaggagctgagactgcctgtcaacagcctggggactgagcaatcttagaaatggattgtccagacccagtgatgccctcagatgacttgtagaccaacagtgtgcagaagggtagatttttaaaaggttaaaaaaaaaaaaaaaaaaaaagaccagccaggtgcagtggctcacatctgtactcccagcactttgggaggccgaggtgggcagatcatctgagatcaggagttccagaccagcctggccaacatggaggaagccacatgccactttttgatctagtctcagaagttacactttgtccgctctgccacattaaga

SEQ ID NO: 250222 - DNA, 528 bp, Homo sapiens
aattgtgaaaacctcttatcccgttatcaagacccagcttcaaacatgtaaacttctgtgggcaaaaattggcatgtggcttcctcctggctttctctgggatcagtagttctgggtaaaacaagttaccctgttgtaaagacattctagcagctctctggagaggctcctgtagcaaagaagtgaactctctcagtagccagtgaggagctgagactgcctgtcaacagcctggggactgagcaatcttagaaatggattgtccagacccagtgatgccctcagatgacttgtagaccaacagtgtgcagaagggtagatttttaaaaggttaaaaaaaaaaaaaaaaaaaaagaccagccaggtgcagtggctcacatctgtactcccagcactttgggaggccgaggtgggcagatcatctgagatcaggagttccagaccagcctggccaacatggaggaagccacatgccactttttgatctagtctcagaagttacactttgtccgctctgccacattaaga

SEQ ID NO: 250223 - DNA, 458 bp, Homo sapiens
aggtgctgctgtgtgcctctgtcccgccttcccgccactgtccaaacctccctgctgccagctcactttcccagccatgcaagtggggaaactgcatcacctctctgtggcccggaagacagaagcaacgacacgatctcttaaaagctactgcatgggggccggatgcgacggttcacacctctaatcccagcactttgggaggccaaggtgggggaggggggtgtgaatcacctgaggtcgggagttcgagaccagcctgaccaacatggagaaaccccatctctactaaaaatacaaaaaaaattagctgcgcatggtggcgcacacctgtaatcccagctactcgggaggctgaggcagaagaatcgctggaacccaggaggtggaggttgaggtaagccgagatcacgcaattgcactccaccttgggcaataagagcgaaactgtctccaaa

SEQ ID NO: 250224 - DNA, 531 bp, Homo sapiens
gatactcctaatgagttcagggttctctgtataattattttggaagttgaagtaacttagttgagagaaaaatgctattctgtggccagtctgtggccagataccacaccattttatgttgatgaccacccagggatcagaccagacatcagtaagaacggctcaaagcagcccatcacttctactgggggacaaccctgagcatgtacattccagtgtttctgaggcttcatgatatatgaggaaattcaagagaaggggaaagaactctagctaaaaagaccagttatgcattagattctgtaattagttaatacagctaaacatatcactggtttttccatgtttatataaaaatggtcttggttttttatgaaatgatgctttaaagtaaatctttggtttttatagtaattcataagtaaaattctgttgatggttgcttttcagagaatttcaaagatttatgtcaatcaagtaaagtctaaaactacaaatagttatttaaatacttattttgggctcactaat

SEQ ID NO: 250225 - DNA, 558 bp, Homo sapiens
taataagtttaggatgggtcagaagatttgtgcaatggagtgaatgcttgtgtgcttcccaaatttcgtatgttgaaactataatcccaatgtgatagtagttgatggaagggcctttggacagtggagccctcatgaatgggattagtgctcttaaaagaagagaccagagagctagctagctgtctttccaccatatgagggtgcaatgggaagctggcagtctgcaaccagaagaggaccctcaccagtccctcaccgttctagcaccgtgaactcagacttcagtctccagaactgtgagaaataaatttctattgtttatgtcacccagtttatagtactttgttatagaagctcaaattgactaagataatttggatattaggttatatcgcttgcaggaggtatgtaacttcttgaaacatgtaaactctctgtgttgtgttctgctgcctaaatccaccagataaatatttggtttactttgcttgggaaaactgttactcaaatgttctctgtacaaatgcaggagagtaaaattatttccccatttta

SEQ ID NO: 250226 - DNA, 305 bp, Homo sapiens
aaccttgtattctctgactattgagcaacttcgattccactggcagtctaagttcaaccaacctcagaggagccttgggccacagagaagacctgactctacagacaattctccagtgtttccaacattggctcaacccaaaactcaacttcagcagaaatgaaggtaaaactgcaggctgctttatctgaactcagcagcaagagataacataaatggaagtaatttggaagcagaaagcaaaatgcaagtgtaaggaatatttataataaaactcaaaaatgtatcaaaacataaacatgatg

SEQ ID NO: 250227 - DNA, 417 bp, Homo sapiens
gcagattgagataatacttgtaaaatgcttggggaaagcctcagattcatagtaagcactcagtaagtgtcatcatcgtcatcatcatcattaattaatatttctacttttacctgagatattatctatgtcttttcattacctaattctccaactaaatgctgctcacatgctattcaacaaagattttacctagggagtcatcgctccctaaaaattggacttatattagaaatagcagcaaggtgcagtggcaggtgcctttagtaccagctaatcactacttgagaggctgaagcaataggatagcttaagcccggagttcaaggctgcagtgaactatgattacacctgtgaatagccactgtgctccagcctgggcaacaaagtgaggcctcagtcgctaaaagaaaacag

SEQ ID NO: 250228 - DNA, 433 bp, Homo sapiens
ttaaaagatgatttgcggacagattaaggacttcagaaggagagatgacaccagacctaggtcttgcagatgcaaactcctgtcaagtgtgagaggagggggagtattatccaccagtggcagataggctgggcatctgggcagaatgataagagctgtggccctgcagccagtccctgcatttgcaccctgagtttgccatgagctgtgtgaccttagtcaagtttctcaacctctctgtgcctcagcttccttctctgaaaaatggggatcgtgttttgcacacagcccgacacacagcaaatattcaaattcctttgcaacaagcaggcattcattatctataattcctattttataacttttttgtttgatctatcccagaattcattctgaagaaattcaacagaataaatgatcattttccctgaaa

SEQ ID NO: 250229 - DNA, 239 bp, Homo sapiens
tctttggtgaggtgtctgttgttcagatcatttgatcatttttaaaatgggttgtttgttttcttattgttgagtgttaagaatccttcgtatattttgaatgtaagtcccttatcaggtatatattttgcaaataatttctctcagcctatggcttatcttttcattctcttaacagtgtcttttgcagagcacacattttaaattttaataaagtccagctaatcatcaatgttttt

SEQ ID NO: 250230 - DNA, 570 bp, Homo sapiens
gcaagcacgatgtccttcggtacgtgaatggataaataaactgtggtacatacagacagtggaataatattcagcacagaaaataaatgaattatcaattcatgaaaagacacgaatgaaacttaactgcataatgttaagtaaaagaagccagtctgaaaaagctaaatactgtgtgattccaaccatatgagattctggaaaaggcaaatatgagtaccataaaaaataattgattgtcaggagttaagaggggcaggaggtataaataggcaaaacacaggaattttagggcaatgaaatgattccgtatgattctataatgacacgtcattataaatttgtccagcgcccaggatgtattccaagggtgaaccctatgtaagctatggactttgagtgacaatgttgtggcagtgtaggtttatagattgtaacaaatgtaccactctagtgccacatgttgatagttggggtggtggaggggtgtgcatgtgtagggaaaggggatctttgggaactcattgtaccttctgctcaattttgctgtgaacctaaaattcctctaaa

SEQ ID NO: 250231 - DNA, 411 bp, Homo sapiens
cagcccaatgagagacagtcctgagacttctcatgaaactattctatctcctaaagttgctaagcctgaagttgtgaggattgggaacaactataactctcaggcattgctagagggaatgcgacatggtacagccaccagggtgggctgaataagtgttccccccaaaattcatgtccatcctgaacctaaaaatgtgaccttacttgaaaatagagtctttgcagatataattagttaaagtaagatcatacttgataagggtgggctctaaacctaatgactagtgtccttaaaggaaaaaaccggtcgctcacgcctgtaatcccagcactttgggaggccgaggcaggcaaatcaccaagtcaggagatcaagaccacggtgaaaccccgtctctactaaaaatac

SEQ ID NO: 250232 - DNA, 428 bp, Homo sapiens
aaaagaaagaaggcaagcaagcaaatgataactacatgaggcaatggatatgttaattaacctgattgtggcgaccacaatgtatatgcatatcaaaacatcaagttgtataccttaaatatgtaccattcctatttgttaattatacttcagtaaagctgaaaaaaaattttttaaatacaaatgctgttgaggatgtggagaaagtggatccctcaagtacattgttggaaagattgtaaaatgatgcagccactttgaaaaacagtttggcagctcctcaaaatgtttaccatagatctgttcttgcaaaaacttgtaccccaatgttcatagcagcatttattattcataatagccaaaaagtagaaacaatccaaatgtccatcaagtgattaatgtataaataaaatgtatgacctggtgtg

SEQ ID NO: 250233 - DNA, 367 bp, Homo sapiens
acaactcttggaactagaaaatgaagaacaaagtaagcccaaagttggtagaaggaaagaaataataaagattggagcaaaaacagattgagaagaaaggcaatagaaaagatcaatgaagctgagagtgttttttgttaaaagataaacaaaactgacaaatctttagctagactagctaagacagagaaaagactcaaataaaattacaaattaatgtggagtcattccaactgacaccacagaaatacaagggttcattcaagactgctatgagcaattatacaccaatgattggaaaacctagaagaaactgataaattcctagaaacatacaatcttcgagaccaaattatcaagaaataaa

SEQ ID NO: 250234 - DNA, 495 bp, Homo sapiens
tggtacttttttttccgtgaagcttagttgaagtatatttgaattacaataaactgcacattttaaaagtgtgcaacttgatcaattttaacatatatataaacctgtgaagccatcatcacagtcaagagaatgaacctttctatcacctccaaaaggttctttgtgcccctttgttacccattcctctctgtgtcccctaataaccacctgcctgctttttgtctttctggatgagtttacattttctagaaatttgtattgaaggaataatatagtatgtgttcctttttgcctgttttttttttttttactcagcatgatgctttttgacattcatccatgttcttgtgtgtatcaacagtgcattctttattgctgagtagtagaccattacatggatagactaattcatttattcatttacctgttgatggacatttggattgtttctagctttgggttattacaaataaagctgttataaacatttgt

SEQ ID NO: 250235 - DNA, 370 bp, Homo sapiens
aatgtgccctcaatgcagccattacattaatgctcactaaattcattcctattcatattctctacctctctttctacaaaataaaattgcttaccttcctgattaaggcaaactaaccctgatggtgtgacctttgtcagctgggcaggtggtaatgccagaacagttttaaatacctgcttacaaaagaacggttttcaccgtacatggaacaaaacaggaagaataccttggtaattttctgtgatgtatcttatatttgtttcacactgaataacaaatgtctatagtcagattcaaggataactgtcagcattaccttaaatccaaactctgtctgaaagttaaaatcataaaacacctaaaaaca

SEQ ID NO: 250236 - DNA, 583 bp, Homo sapiens
gagtttgaaccatggtcctgccacttcctgataatggcacctcagatgcagcctacatcaaggaagctgcctgctgttaggggaacaggatacctgcagaggctccggtcctgacaatgccttcagctccacctcccaccaaagacctgtgtggtgtcagcagcagccccatttgcagaacttcccagagcaggttatctgcaatggaagcagtgatgcagcacccacatgtcccagaggaagggttgtgagctaacagctcacagctggatcacgctgggggatttttttctttccccgggagaaaatgcatctaatgactgattgagatgacgaacagaagcctggccctttgcgtatctgggctgctgacccaataaaatggagcccctgtgacctgctttcagggctttcacaactggtcccgcatgacgaccctgcctgacaaccccaacttggcttcagccttcctcttgctggatgacttcagcaagtcagacactctccatgcatgtgccttctcgtttataaaacaaagacaggattattgtgagaatcaaataaaataatggatataagcatt

SEQ ID NO: 250237 - DNA, 242 bp, Homo sapiens
gctaatttttgtatttttagtagagatggggtttcaccatgttggccagcctggtgtcgaactcctgtatcctggtcatttttatatctcgaatctggctgagaggtccctgtttttcacaatttcgttttggaattggcacatggaggtctgcctcaaacccactttggtatctgatatctatcacgtggacaattcaatggaaataaggcggagacagtcctgtcttcacacagtgttgg

SEQ ID NO: 250238 - DNA, 221 bp, Homo sapiens
tttttttgcagctattgtaaaagggattcagtttttgatttgactctcagcttggtcactgttggtgtatagcagtgctactgatttgtgtacatgaattttgtaacctaagactttactgaattcatttatcaaatctagaggtcttttggtggagtctttagggttttctaggtgtacaatcatattaccagcaaaaagagatagtttgacttcctctt

SEQ ID NO: 250239 - DNA, 370 bp, Homo sapiens
atcgtgtactgtgtggtagaatcagaaatctttagtttccataacgtgtaaagtggcaaaaacaatgtcttccaaggttgatgtgacattccacatgtaaaaacatttgtcttaatatgtaactcatattatatactcaaatgttttcattccactactccctcaaatgttttctttcttttcaagtccctgtaaagttgcagctatttatgtcccctttcattttgacatttaaaaattatgtctaatgctgggtgagatggcccatgtctataatcccatcactttgggaggctgagacggcaggatcacttgaagccagcagtttgagaccagcctgggcaataaaatgagacctctgtctctacca

SEQ ID NO: 250240 - DNA, 278 bp, Homo sapiens
aaagtcctcacgtgctttactcaggctttgggcttaaggagtgtttctgatgtgggctctggagccagactgcatggctgtaagccccggcctctctgcttcacacctctgtgatcttggacaagtaccttaactttctgtttctcagtttcctcatctcagatgataataggacatgcctcacagggtggttgtgagaacctgaataacatcgtaaagcacttcaaacagtgtctggcacatcagttgttattaataataattatataagataaaat

SEQ ID NO: 250241 - DNA, 99 bp, Homo sapiens
tgacatagaggaccagtcaatttctcaaatcccagagaagaccattgacctgaaagatattgattggcctttccgatacctagtctcatgaaaaaaaag

SEQ ID NO: 250242 - DNA, 360 bp, Homo sapiens
tttagagacaaggacttgctatgttgcccagctggtcttgaactcctaccctcaagctatcctcctgccttagtctcctgagtagctgagattacaagtgcatgccacctcgcttggcacaataagaaatttaagacagtttggtaaactttactcttgtaggtgttcttcacatttatttttactcaggttagctaatgtctttatcaaaagagacatatttagtattttccagtttaaagaatttatgaactatacaaaagttaagtgtgaggaatttttttaaaaaaaaaaaacattttttagaaggttaaaatgtagcatgtactacagtaaaaactctttccagtactgatttta

SEQ ID NO: 250243 - DNA, 458 bp, Homo sapiens
ttccactggctcacatactagacaggaaggcagacatacccccttgtcactgaatatgagatagattgtggtaggtacctaacagaagtacaatccaaatgcaggggagagacagagtgagaggaaatcagttacatcaggagagagacctgagaagtcctcttttctctttaaatatgtgttagatggtttatgcattcattcagccagcctttcctgagtgtctttatgcagcaggccagcaattctcaactctggccaacggaagaattgcctcatgtttactgagtcaaaatcaactgggattggaattgagtatgtgggcggggagcacgttaaatctgtggttaagacggaaagcaggaatgatactcaatctgctaggccagcaatgggaacactaacatttaagacatttctcctgatctctgaaaacttgcaacctagcagaggatata

SEQ ID NO: 250244 - DNA, 302 bp, Homo sapiens
tcaaagaaaaaaaatccacattcaacagtgcaaccagagtcttacagcatttatatgtctcactggatctaagacaaaaaccatccacactgacctccccgctgggttctgcgtgagattaacaactgcatggacccacagagcagccacgggctctgtgtttctgagctcactcagctactccctggatactgagcaaagctgcagccagtatcaggaagttagctcagatcacacgttcacgaggtttatcagatgtagaaattatcaataaaattattccatttcataaagaaggcaag

SEQ ID NO: 250245 - DNA, 1285 bp, Homo sapiens
aatttgtcaaaaaaataccttgagatgacaggtagttggttttgttaatattatgtttgccactttaactatgttaaatgaaatgacaggtattcattaaatatctacaccatttccagataagacaaactactaaaacaaaaataaaaaagtgttccacttatctttttctctctacctgattgtttcagaatttggaaactcttattaagtatttttattttcaatctgggtgtttgcataggttcaataagaatctattctccttatgacaggacataattgggcaagtccttggcttggcttcttagcctagagaggcttttaaaggtctaatctgagatttctcaattactagatagtttttaaaaactaaagttgactgataacaaagtcagtaaagtctcttggatatcaccaaagctgtggctaaaatatattttaaaattactgtttttattatacctatataaataatcaggtcaaaattaatgaaactagatttatttttgcaaaaaagtcaactttgatttttggtaaaaatggaaaataaaaatatttttctccagaataaaaaagattatattttagtagaaaactattgtgcatccattgtcaaattctaggcctgttcattttctttgaagttttattatctccctataaaccagattgactcctgaatttttgttttttagttccactagaaactaaaactgcccttttccaaagctctgcaaactgaaactggtgactttaagcttcagaaaaatcactgcaacagagcacttatgccttaatgccaatcttaatgcctgctgctatctgggtcactcagagagtttaccagaatgtttaatgaaataaccagagacattcaaattgcaaaccagtaaagcacatcacattgcaactgctatcttcagtctaccatttaaacttgcctcaaactcacctctagaaattgtttcacctagctgccctctaaactcaaaaactaagatcataatttgctccaaatattaactttgtttttttaatagaagaatactctgaattcctttcaagcaatacaatctaaaatgagcaagttagcctcaatagcaccccaaaatagaagttcttggtatcttaacagcttaacaaggaggagcttgtgttcctactgatgtcaaaagaaatgcttaaagatctcagttggctttatggtgattctagaactgggcaatacttgccaccttaaattagaataaggtttccaatgagttacagcagaggagattgg

SEQ ID NO: 250246 - DNA, 424 bp, Homo sapiens
agaaatatgttggggttactgcacctgtaaaaagtgaaaatggccaattatcatcaatgtcaagaagaaaaattgcccttgttgccctttcactgtagtaaagtgctgcttccaacaaaccagcacacaaatgccaaccacaggtgcattccgcttgggaggatgggggagaaactagttgtttgactctgtacaagaaccaatcaccaggtttccttaaatggcacactttctttgaaatctgaagcaagaaattacctctccggacacaaccaagttcatctcgtgtcctctcaggacatacagccgggctccactagagggcagcagaaagatggagatgctcgagagaaaaggagacttaagttagttctcaccatccgtggagggtgtgaggaacccaataaaaaccgtactggtatta

SEQ ID NO: 250247 - DNA, 380 bp, Homo sapiens
ctggtggaccttctaagtaactgctagaatgattgggtaatgtatacagcttttgcttctccataaataatgtaagtattaaaaaggagattttaaactagaaggaaggaatctctggagtgagaggaaaagtttaattgtatttcagtatctatgtctatgaaaagttgatatacggtgtcactgtggtatacccaaacttgtttatacacatgtataaccagtacacagtaagtaccatgagtggcttttagtgattttatctttttaccttgtagtacagtctccctggtgtctcacaaggctagtttacttactttggccatatgcttcacatagtaggtttctggaggttttgttttttctaagatgagagagtg

SEQ ID NO: 250248 - DNA, 665 bp, Homo sapiens
  misc_feature (630)..(630): n is a, c, g, or t
  misc_feature (665)..(665): n is a, c, g, or t
actctagtagctagggttgctgggaaaatgaattatggcaagatgagaaggtgggactcaagacttgggaaactacagaggaaggtagcccaaaagatattgaatagctacacatttaaaattttttttagaaaaatttaaatttttaattatttttgacagagtaagactccgtctcaaaaaagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaaattgactttctagagtataatgatgttctagggcataatgaggaaaattttaatagattataatgatacatattggtatcattaagacaacagatttgagcanatacaattaaggtggtcttattttttgctcgtttn

SEQ ID NO: 250249 - DNA, 514 bp, Homo sapiens
cttaatctaagtgttgcagcttttgattgcctctctgcaaactgctttccagtggaatcatattgcagctgttctaaccacccagttcctgctctggacactgagtacattaaaggaagtacaaaacagttacttcccaaaaactctcaaccaacttttctttccttaaatgatggtcattctccatatggcaggagcaacatttttcttatttttctctgctggtttgaaatcagaactgaactagatattctttccaaattagaaggtacctctttcactgacaacaggaatttagaggatttggggtttagaacaatgttatttaagttcaataactggaaaatctcttgatgaagcaaaacctgcattaacatagtaatcatactttttggctgataaagaaaaataaacagctctcgaaaagaactttttccaaaaatgaaaacattctttagctttttagggtacttcatataaaataaaatgaagaaatttaaaatgacaaaaaaga

SEQ ID NO: 250250 - DNA, 527 bp, Homo sapiens
aatatcaataagatatagcgcttgcagtccttacattttagggcacctacactgcttttttagttatggatatacaaggctaatgttcagctggtacacacaagtacggctgaaccaactaatcaaatactgaaatacttcaatgcaagttggttaacagctgcaactctgagtggtatccccccatgcttctcacccctgtgccagtccttcctctcaagattccccagacctccacattttaggaactagtgggttaatacctggctaagatagagccctttggacccagctcttattagtcactcccattctacttggttggtgcctattctttactaattgttacatattttaaatgtcatccctatagaaaactatgtggtaagcaacttgaaaatagagactgtgtctcctaacactttttaaactcacccaaacatttatttactttcaagtgtatacacactgatttgggcagattttcaagcaaaattatcagatagaataaatgattctctgcatac

SEQ ID NO: 250251 - DNA, 1596 bp, Homo sapiens
atgctgtcatcttttgtggtttttgagatggagtctcactctgttgcccaggctgtagtgcagtggcacgatcttggctcactgcaactccagcctggaggacgagagtgagacttcgtcaaaaaaaaaaaaaaaaagaaatgacaaactactgatacttttttcacgaagtttagctttcaaattagaacaaaaggaccaagtgcaatcaagacagttgttacacagaatacatctgtattctgatgttggactaagaaacggtggtgaataaatcaaaataaatcaaattgtgatagtagagtagaaagtttagtaatttagtgcctttattccaattcattatacatgaacctatggttaacaacttttggaatccctccccatttggtttatctggaaaacaggaaaatcgccaactctgctatcacttttttggtcctttttggagcaaaataaagacagtcatgtaacacgtaacattttggtcaacaatcaaatgtgcatatatggtaagcctgaaagattataccactatatttttactgtaccttttctatatttagatatgtttagatacacaaatacttgccattgtgttaacattgtactcagtacagtaacacgctgtacaggtctgtgtattttctatgatgctcacatgcaatcacccaaactgcatttctcagaactctgtcattaagcaacacatgactgcacatcagctcaattttccttctttgtaatgggttataccatatgtactatttttacactaaaaacgagaagatacagaagaaaaataaacacaattttaacagccattttaactgaagtggcatttttgcatgttttcatcatttgctgtgtatctttaaatagcacaataccttagcacgttaaagaaaaaaatacctgagggtagcagcaaatccaaatgcagttaggaaaaccatggacgatctgcttgagatttcaagaattttgaatagatgtgaaaattctattggtgtacagctttatgaacaaggaattcagctttatcatcagttattagaaagctgtgcaaggaattaagttttatccatagctttatcagtggagagtggcttacagaaagaactatcagatgtgtttaaattttaacagccctaatgttttggcattgctgttatttatgcactccttatttatagctttgatagctttaattttctagtcttatcatgtgcctgacaaatgtagttatatgccttactgacatttccattaaaaactttaattttgaattattcatgcataactatggaatttgttacactgggctgaaagttgacaggatttcaaccaccatctgtaaatttttatttagattatgtatctcataatcttgttttttaaaagaacaggggaaacatttcttgtaatctgctgtttaacaaataatagttttttaaagttaggcagtttacagtgagccagatcatttttgtattgattgaaaaatacaacttttagaaacttaggtttcagtattaacgacagcatttagcttagcattacttgttgtttgaatcatttaactctaaggaagac

SEQ ID NO: 250252 - DNA, 439 bp, Homo sapiens
gcctgtgaagggcaatccttttcccgtggactgggatctatagaaatacagaaatgtgcccaggggttcatctccctaataaccatcattcacatttctcaacctccctaataaccagccaccatgtgagaaggatccacagttactgtttatgactataattaactagtacctgggactggtcagtggagttggttgcaacctgatgctaaggatgtcaaagttgtctcggcctctgttcccagccagtaagtaattccctggcctcgggccataccccctaatcttggtcagctgattatgacaggcagacagcacagtaaataacactatatattaagaaagtctgtagcaagggcctccaatgtgaaggtcaacacagtcactgtgatgcgtgtatttccattttgtaaagcatgatctctggtggtcattttta

SEQ ID NO: 250253 - DNA, 486 bp, Homo sapiens
tctgtagtcagtctggccttgtgccctgagtcccaaggcagggccagccatgctgtgggctgtccgctgcctaatcctggggacgaagccaccttccacagtgaacccggatctgccttccctgggaggggaggagaggagagcagaagcagagagtgccggtggggaagggatcagggcctcagggtcagaaaagaggcttgtggccctcggcagggagaatctgtctacccctccctcgggagatgcccaaaagaaagagatggcctgggggagcaggtcatggcgatgagggcaggggcagggatgggcagtgactgcaaatgggccatgatttcttttcaggagaggaaaacattctaaaatggactgtggggatgtaaatacactaaatgccattgaatgtatactttacatgggtgaactgtatgctatgtgacttgtatcccgataaagctgttatagtaaaaaaatccaaaagcacaa

SEQ ID NO: 250254 - DNA, 435 bp, Homo sapiens
agtccttacccgacctattttctgtccactctatctgtttttgagagaggtctcaaaaaataaaaaataaaaaataattttgttaaaaagataaaatagaaatcgtagatgaattcttggaactgggattaatcagaacatggcagattagcatccaacatggaattgctttattctcattcaaggtttccctcattcttcactctccccatgctggtcaccttgctgtttgttcctcaaacacatatgacatgcgtttctgtcttggcagtcatcctgctacctgtaatgtcagcactgctttctgttgtcccttcagtcaggtcactgttcaaatagctctctagacaggctcttccttatcattctacttaaaatagcccccaatcactctgtgtccctttagcctgcttcctcttcctgctatttcatact

SEQ ID NO: 250255 - DNA, 765 bp, Homo sapiens
caagatttctttttaaatggttcacagttaaatttaaatttctatatttagataggatagtgtttatataccaaccgcagtatccaggaaattcagtggtaaagctgacacatagcgagtttatagtctattttgtagtctgtgtatttagagaaggtttgaagcttacttagcaaaaaggattaaacattcaagcagaatttctttagcacaaatgtactatttgatttcatatatttgttgagataatagtgtgtcacattttaaagattagttctcaagaaaatgtgttaggtttatcttttaaaagaaggatgcattcaggaacagcttttatatgtaactttttatagtatttcatattggatagacttggtttggtgcaatccgtaagatttgatcaaatttggaagaagttacagacacatttttatagtgttttctgtagcatctttatttttttcagatgggcgtattttatgttgcttccaactaatcaaaataagaaattgagtttgcctgtgccaaaaaacggaactatcatttttcacattcttttattttccatgtcatttttaagtaagattatgtttctaggacttatgaattcctgtcttgctttgagaaataagggttgaacatttaaggggaactcactttattgagtattggttggaggaatttccatccagtaatttttggagatgggatcgttcgacagattatgcctcaattattctctggcggatcttcactgagctgcct

SEQ ID NO: 250256 - DNA, 538 bp, Homo sapiens
ctgaccaaaagctttcattatgaaatcatcaatatcccagataagcaaatcacaccccctaaatatatgacaattagcagataagagttttccattttcattggtaagaagtttatagactgaaaataatttgccaaaatttacctttgcattctcagtcatatctgtaggtagattaacaaagtctagtttttatttttattctttttatgtatttatatatatatattttgtagtgatggggggtgatatggtttggctgtgtccccactcaaatctcatcttgaattcccatgtgctgtgggagggaccaggtgggaggtaattgaatcatggggacaggtctttcccatgctgttctcatgatagtgaataagtctcatgagatctgatggttttataaaggggtgcttccctgcacaagctcttttctcttgcctgctgccctgtaagacatgcctttcaccttccaccatgattgtgaggcctccccagcaacgtggagttgtaagttcattaaacctctttcttttgtaaa

SEQ ID NO: 250257 - DNA, 451 bp, Homo sapiens
aatatagtaacttgggtacaaggcatgatatggtcacagcaagcactaacataaaaggctttctatgggccaggccctgttctcagcacctcatataaatgtattcatttagacctcatcgaccattctatcagataggagctgggagaagccccattttacagtggggtagactgtgacacagagaggttaagtagcttgcccagcatgtagcagatctgggattgaaatctggcagcctggggccaaacctgtgattttaaggactccactgtttgcatttgcaacagaagccagcctttacagtgaataaaggaaaagggtttgatcagaatggtctcttgcagccagggtggtagctcatgcctacaatcccagcagtttgggaggctgaggccggaggattgctggaggccaggagttccagaccagcctgggcaacatagtgaga

SEQ ID NO: 250258 - DNA, 688 bp, Homo sapiens
cagtctcactctgtcgcccaggctggagtgcagtgcgtgatctcggctcacggcaacctctgcctcccaggttcaagcaattctctgcctcagcctcctgattagctgggattatagatgaatgagtattcttatatgaattttatatatgacaaaaaaaaaaagcacagaaaggttaacttgtcccagcaactcaaccagaactcaaatatagtccctgtggctccaggttcactagtcttccccttaacagttgtagatggcatagcatagcagttaagcctgcaacttgctaggccaggcttcctggagtcaaattcttactctgtcactttttagctgtgaatctgaacaattcacttcattgtatctcagcttgctcatctgaaaaactgggagaaattgtacttattttgtatgattgctgtaagaattaaaatagtttatctgtataaagtatatagtcccatgactggcatatattaagtgctcaataaatgctagcgattattttaataatacagttgattttttcttaaaattgtgtgaaaactacactctatagccatgatttaaaaaaaaattatatgatacctagtgaaataaacggtaccatgtccttccacctaaattagcaacaaaagtcaaatcttataagtttctttctgtttcccttataaattcaata

SEQ ID NO: 250259 - DNA, 237 bp, Homo sapiens
ctccctccacccttctgtttccaggagcctcagaatggttcaggcccttgccagtcatggcacccgcctgtcactgtggctgcgtctggtaaccacagattgggggggccacgcctaaacagtgtccgtgcatttctgagaaaagctttttccaaatattacattctgcttttctacatttctcattttccatgttggcatttaaaatactcataccagagtatcagccaagggaag

SEQ ID NO: 250260 - DNA, 363 bp, Homo sapiens
tctgacaaggactcccacgtccctccccggctaacctggatcctgctcaacccaacacctgccttctctcggtccctgggttcccgcaggccttggggccccacagtcatatctgctgttcctgcagctcggcacagtcacagcaactctccaaatcatgacgctcaaaatgccacatctaaaaagaacatccgggctctgcccctaagaaagaattcatgcacctacaaagaggaaggaacggcacagccatccacctttcaactcctgagtttccatctgcacccttcaacacttattaggacttacatgaaactatgtgacatctttttatttctattaaacaaaatacagctttcttcc

SEQ ID NO: 250261 - DNA, 590 bp, Homo sapiens
gtcttgctatgttgcctgggctggtcttgaactcctgggctcaagggatcctcctgcctcagtctctcaagtctctgggattacaggaaccggtctactgcacccagctattttaaagttctacatctggacaactttaaaaggaagaggtttgggatggagaataacccacatcatacaatttaaacccctataagaagcagtagtttaagcagctttgctagagtaaatcatgatttcagactgtgtgaattttaaatttcctctgctgtataaaaccactgtaagaacaaaaatagacaacaatagactacaaaccccagaattacaaagttgtttggaattgttaacaatattgcctgttcatgctgtaattagttagtatgacggagatgttttattacatgatagcaccacacctgggtacagtgttgggaagataccaggaatcaacaaagagtacaatgacatgtcttatgggttcacatgttaggtttccagtacaatattaatatggttctgagccgcaggttgataaactattcctgggtttttaatatgaaaatgtctcagaagtggttacctttatg

SEQ ID NO: 250262 - DNA, 214 bp, Homo sapiens
ccaataaaatcaaaacaaggtagacagataaaactgaaataaagtatcaatgcaaagatacagatatacacacgaaaaaaacaacagcaagtagggaattatgacctctccaatggacaaagcaaaactccagtgacagaccctaatgaaagagtgatctgtgagccctctgaccaagaattcaaaatagcagttttaagaaaactcagtgatc

SEQ ID NO: 250263 - DNA, 433 bp, Homo sapiens
caactgaagtcatagtttccaagaacccattaacgacgttaaatgcagacttactgtattctgaaacaggacatattactggaatacctcaaatgccatacacatacaatatgattaatttaaaatccaggaatacctggaaattttattggttaaaaaaaaggaacacaagccagctgcagtggctcacacctgcaatcctagcactttgggaggccttacagatctgagccatcgtgccctgccaataacaaagttttgatgagcgtttttctctctctccttctagtgaatccagttctggaggttcagggtcataatgttgggatcctgcccagctctctccataatcctctgtgtgtattatttggaaatgcctctttttaatttattttttcaacttctattttaggtttgaggtaatccgtgaggg

SEQ ID NO: 250264 - DNA, 320 bp, Homo sapiens
caactgaagtcatagtttccaagaacccattaacgacgttaaatgcagacttactgtattctgaaacaggacatattactggaatacctcaaatgccatacacatacaatatgattaatttaaaatccaggaatacctggaaattttattggttaaaaaaaaggaacacaagccagctgcagtggctcacacctgcaatcctagcactttgggaggccgtgagccaccgcgcccggcctatgctatattcttctaacaagttttttttaaggctttaattttattagactcaaaatgccagtaactgagatcctctagag

SEQ ID NO: 250265 - DNA, 467 bp, Homo sapiens
gtgtgccacttagaggtctgtattagtctatactaccattgacagtgtcttgccattatagcgtattatttgccaaaccaataggtgcaagaaagtatcttattgccattttaatttgcatattcaaaatttaagatgtacaacaactttccatgtagttaaaatgattttttccctgagagactccttccctatttctcttatgtaagtgctttttaaaatattatgtaatatattcttcttatgtaagtgctttttaaaatattatgtaatatattcttcttatgtaagtgctttttaaaatattatgtaatatgttcttcttacgtaagtgcttttttaaatattaaggaaattaatcctttgtctctcttatgcatttcaaatatttattttcatattgcattgatttataacttaacttttgaaacacttccaataaagaaaatttaaattttgtatagtaa

SEQ ID NO: 250266 - DNA, 1077 bp, Homo sapiens
ggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcagcccaccagaactgatccaagggaatatttaatgtgccatctttttgcacatatcaacacagatatgacattgcttgctgaaagtgggaaaacccatactctcaacaactcagaatgataatgggtattatccaacaaaagaggccatattcaatgaagctcacaattgtaagcagcgagaacaaccaggaaatggtcttcccgaacggttccggctaacaacgaccaaggactttacggggagtcttccttacggtggagttccctttggttgtgttcaccaggaggatctgtcgcgtgcctaatcaatggaacgctctcccggtcctggatgtgcgctcccacagggaaaaaccccttctggggccaattcagaagcaacaagaggcgagaggtcgcaacacgaacactccccgagaacggctaacacatcggggcggcaagcacagggacggcccaggcacgctcggggcgcaaacacggggggcacagcagacaacacctgagcaaaagaaggcaa

SEQ ID NO: 250267 - DNA, 469 bp, Homo sapiens
ctggagtatgggcagctctttgtgactgctttcatgacttgaacacagctgaaaggacatcaggtaacttctgaggctaggttagaaaaatccatgaagattctatttatttatcttagggcattggacaccttaagctgccatgtgaatccacatatatagctatataaacaaattatatatatatatatatatatgtatgtgtatgtatatgtaggtgtatgtatatatatgaatacatatttaaaatatatatataaagagagaaagagagagacatttttgaggagcctcagctgttgcctccccagcccaggagataggcttacatgtgaataggccttccagatgaccccagccccacccaccatctgactgcaaacttatgagggactctaagcgagaactgcctagctgggcatatttgacttccagaatcataagtaaaataaattattatattcttgta

SEQ ID NO: 250268 - DNA, 420 bp, Homo sapiens
ccatatttaattctaatcactaaaatgtgaagtgagaagaagttttgatgtgagactttagacagttgggaaacaaaatgggctacataaatgggagaagtggaagaccctgaaaatatccatgtttcagttgaatttgaattaacaaaaaatgaaactcttaaccaggaatcagcaaaaagtttatgtaaggggctagataataaatattttaagctttgggaaaatatactctctgtcacaactttccacctctgctgttgtagcatgaaaatggccagagatgatacataagtgaaagggtttggctgaatactaataaaactttatttacacaacagctagtgggccagatttggcccaaagcccatagttctcagacccttgttcgtaatcttcaggtaataaaaagaacacaat

SEQ ID NO: 250269 - DNA, 395 bp, Homo sapiens
caccggcttgaggctgcctttcccggcgttccctcgtttattggctcactcttcctttcatttatgtccaatgtgagtcaggcatctctcctggtggctgtcttccatgtggtgacttatgtatccaggatccttctactgtgtttctcctccattgcgaagtccttcacttccagcacctgagacattttttgggtatatctacaagtggcatatatcacttctgcccacattcacctgggtagaactcaatcacattgtttcacctaactgcaagtgaggctgtggaatatagtctccctatgtgcccaagcagaagaaacaggattggtgagcatctagcccatctctaccactaacagtttatcccccctaataaatcaatacactgatga

SEQ ID NO: 250270 - DNA, 508 bp, Homo sapiens
caccggcttgaggctgcctttcccggcgttccctcgtttattggctcactcttcctttcatttatgtccaatgtgagtcaggcatctctcctggtggctgtcttccatgtggtgacttatgtatccaggatccttctactgtgtttctcctccattgcgaagtccttcacttccagcacctgagacattttttgggtatatctacaagtggcatatatcacttctgcccacattcacctgggtagaactcaatcacattgtttcacctaactgcaagtgaggctgtggaatatagtctccctatgtgcccaagcagaagaaacaggattgtgtgactctacaatgtgtgattgctcctggtgaatcaaaaggataaagctgctgattctgcaatttgataacccaaccatgctgacctcaaagtgtagtcaatccatgaagttcctcccaccacagctcatcctgaacactgcccacctgagtcatcaagaaaggtttaagtacatta

SEQ ID NO: 250271 - DNA, 436 bp, Homo sapiens
caccggcttgaggctgcctttcccggcgttccctcgtttattggctcactcttcctttcatccatccatcctttgcgcaacaatatttgatgggaagcctgccaagttttcagattactccatttgattctcacaagaacatcgtaaatggaaaagactagaattgccctgagttcacagattggtcatcgaggtcaaagaaatcaagtgacttctggaggccacacagctaataaacagcaaggcaatgacttgaacccaggtcttctggttccaggtccagagctcttttctctatattctaaacacttgcaagcaggggaaatgttatcagtcccctacactctccagtgactattctgtgtctttcctagggttttaggtgagctcaatttgatagaggtatacaacataaagtataactcaagacttcaca

SEQ ID NO: 250272 - DNA, 197 bp, Homo sapiens
atgagattatctcaggtttagggttcccctaagtttgaaagtttgacataaagagatatttagatttaaaattcgagactaggtgtgttggctcacacctgtaatcctagcactttgtgaggctgcaatgggaggatcgcttgaggccaggagttcaacaggagcctgggcaatatagtaagaccctatctctacaa

SEQ ID NO: 250273 - DNA, 608 bp, Homo sapiens
tgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaacaaacagaaaaatggct

SEQ ID NO: 250274 - DNA, 503 bp, Homo sapiens
caccccttccctccagacctgtgtgccttctgccctggctccagggccccccacaccgtgaccagggcgggatccctatggggctggccagtcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaacaaacagaaaaatggct

SEQ ID NO: 250275 - DNA, 567 bp, Homo sapiens
gactccagtttatggtgaggagaggagggggtaaaaggaaacaaagggtgaaggaaacgatggaagtagtaatgctcagcgaacagttgactatgccacctgaagtgcttatgaacccgttttggctttggaaactttcttcagacatggatgctcacctgttggtcttgatgacttgcttgactagaatgtgacagatgtgatggactgggactgccaatgctaggtcatgagaaattctaagaattctgcctggtctcttggaacactgattcagggacccctgaaccacagtaaagaagttcaatactggagaagacacatgtagatcttcaagccaacaatccaaattgagccccgtattacaactctccatgttgatgtaccaaaaaggtgtacgaagccatctgaggccctcctgatcagcccatcagtcagctgaatcctgccgagaaacctctgtcaatttcacatggtacagagaattgctgatctgagctctgcctgaactcttgactcacagaacaatgagatataattaaaagattgctgtcttaagccaaaaag

SEQ ID NO: 250276 - DNA, 444 bp, Homo sapiens
aacaactttttaaccatctctggatgatgtgacagaagcaacgtttgtagtacaggaaagaggaaaagcttccattttaaacctgatgaactttatattgtatgaagctgattcagtgtcactcgggcttctcgtagctgagataaaaacggggttttattacacatgtgtgaagaaatgaagaagagtgtgtacaaatgtttgttgactctataacaatattatgactcaggaaaaggaaaaatctttatatgccaaaaggaattcaaagctagagaaaagtgaaaaatttatcataacaatatcaaagtcacaaggtaatttcacatatactcatgaacaagctgcttcaaagagtgtacctaaacaatgcatcagaagatgacagagggattgaaaggaataaaatctgtaaaagcattaaagatagcataatcaatcaaa

SEQ ID NO: 250277 - DNA, 357 bp, Homo sapiens
ttatagttaagatgatttaaaagaaggaagagagtgttcaatgacaaaagaaggcactaagaaacagctgtttccaatcaagtataaacaacaaattgatctcttttaatttggaagaaataacattattgactgcttgtgaaactgcatttatttgtggcctaggaaaaaaacttaaatgaagatcttgaatttttaaagagtttaggtaaactgggatatttttaataaccatcctttatcttaaaacttgtttgctatatcctaggctgccagaaaattttgtttgggcagttttagaatggggagaatgtgttggttagtgagataggcagactcttcctttcccttcaactg

SEQ ID NO: 250278 - DNA, 450 bp, Homo sapiens
gcaagtgattataacccctgccaaacttgttaggaagactctttttacaatatatggcagctgatcagagctatccagctagtggtttgcctcagttttaagatcaccattttaaggaatgattaatatttattctgaatgatattcatgagcctttagtgctttctttttacaagacaaattaactctagctataaaattaataaaacactgtttttaaaaatgagagtaggtttactatttccattacagaacttatagctgaacattttggaatgatttaatcaatattactcgaggattttaggaaaataattcaggatgattttattattataaggattagaaaataacttcagttttaaattttgaagtttaagttctaagcacaaatgtcttcttgtcccctgattcttgcagtatccatggagaataaatattaaacactca

SEQ ID NO: 250279 - DNA, 812 bp, Homo sapiens
aggattttctagccatgctaagagtaagaatggacttgtggaggataggagctccaggcatagaagtctcctcaagtgttagtctaaacataaagcagcacttgcatagaagattttccacaagaaaatatggcaaaaaaacaccatatattgaggaacaacaactacaagggaacagtgagcttaataaaggtgacagagctcacatagtgctctggaatattggagttttgaccagctagagagaagagacctcattgaaaatcttgggcattcagtagagacctcagaaaagtcagactttatgagtagactttgtatattcctagaataaaggcagctccagaaaaaacctagcaaagctgaaaagcaaatctccaagcattaaaatggtgtcctagtcaattaactgccttctagaagaaaactcaacactctttacaggtgaacaacaaagttaagttgctgagctatgcaatatccacagtgtgagtcctaaatttataactttactacacataaaaaagcatttagtgtgaaccataaccaggaaaataatcagtcaataaaaatagaaccaggaatgatagaaatgatttaaatggcatgagaatttgacatattagtatcataactgcattgctggatttaagaaaacataaacatggaacgtaacagatatcatatcaagggaaagtaaaaggataaaagagtcaaatcaaattaaaggactattaaaaggtatatcttaaatgaaaaattcactggatggtctcccaatcaggttagttgtttccagggaaaaaattaac

SEQ ID NO: 250280 - DNA, 389 bp, Homo sapiens
agcacctctggctgtctgcccacccatactcatggccatggcacagatgagtgccacctgactggtggagcaggcaaacaggatagattggactgaccactgtcaggcagttcttccaaaaacaagggcaagactcagtgattgaactgagctgtagacctttaagagccatagccatctagaaagctctgttgaaggcactgtcagcctatgcccctatgatgcagggctcactggtaattgtaagcagcactttccaggaccaatgcaacactgagactgcactctccctctgtgaagggcaggtattatctcccttgtcttcctcctagaagcatagtgacttgcaccttagcagtgatcatcagagaactttgagtatgtaaaga

SEQ ID NO: 250281 - DNA, 174 bp, Homo sapiens
tgagccctggaagtcaaggctgtagtgagccgtgattgcaccactgcactccagcctgggcatcagcgtgagaccttgtctcaaagaaacaaaactcctcttaatgtcaagggaaagacccaaaaacctgacagaaaagatgggtaagagaaattaacaattcacaaaaaatat

SEQ ID NO: 250282 - DNA, 433 bp, Homo sapiens
cttccttgaatcactgtctcacagataattaggttcagaagaggagaaaaaaaaagatgacgtcaacatggagcagagtttttcttagaccttagcctagcaaggaaagagaaatgcctggtctcagtgctgggaagctgttccagccagagccccgtggctgtgaagagagctctcctgtctggagccaaacagaaagctcataggtcttgaggccagaaaagttagtaggtggcggctctggtcggtgctggaaatggaggccaggatgaactaagaagcaaactaaagatacttgtaagataaggacgtgtaggctgggtgcggtggctcacgcctgtaatcccagcacttcgggaggccaaggcgggcggatcacgaggtcaggagatcgagaccatcctggctaacacggtgaaaccccgtctctacc

SEQ ID NO: 250283 - DNA, 446 bp, Homo sapiens
cccattgcaatatagatgatttacgtagctggacaaccttaccaataggataagcattatacaaagatatatcaagtacctgcaatgtacctagcagtatgctttggatgatacaaaataacaaacattctcaatttctataaacctccctgtctagatgagaagacaaaactgatagtgaatgaaatagagattaattaagtgctaaaattaaggtaaattgatgccaagtgcagtaagaattcagagaaaagagaaatctttatggatcatattatacattactagaaaaagtaggacttgaactaggactagaataatggatgagattctattgaccagtgagaagataatgaacagttctaaatataagaaattgctcaaaccaggagtctcatgcatcttttattctaaactttccccccaacttgttaatttggcagcag

SEQ ID NO: 250284 - DNA, 724 bp, Homo sapiens
gtttcttcatgggaaaaatgggctgctgacaagtccagctctccagcctgatcttatgtgtaaatgtctttgaaccagatcccagaggagccttgaatgccaggcttggctgatcagacttcacccccagggcctaagggagccattgagggttgttgagcaaaagaacaatttgggaatgcgcagatgcaggactgggaaggagttaagagcaaaagttttagagtgagacgtgggtttgagtcttttcttcatcgcttgctgtgtgacctaggacctgtgctttgacttctctgagcctcagtttcctcatctgtaaagtgaggatgtaataatgttgtaacattcagtgatttcatgcaggtaaagggcaaagggtgtgccaggcacacagtaggcactcactaaatgctggtatacagttacgtcctcaagtcttgttaactagccctgttctttctccctcctgtcgctctggctcaggcctggctcaggtctcccctccctgcatggggccccactcttgcccttcacaggccccagatctgttttgtcctcctcctgctcacacaccttccatggctccccattgttcttgggagagagttcccactccttatcctgtcactcaaagcccagcccactgcacagacgcatggtccattccccgacccaacccaagttccagccacaaatgctggaagtatgtagaagtagctcatgt

SEQ ID NO: 250285 - DNA, 381 bp, Homo sapiens
tcacggccacaacacacagactcaccagtcactggagggcagccatggggctcacaaagggattcttccttccacaaaaggactcacaacaggcatccctaaatagctcgctgcaaggaaaacccactttgagttgggaaagtcacatttccatagagtggattagagaaatagggctttcattggaagaggtggctcagtctgagaataacagctgggaggtgtaatagtaaaaccatcccacagccacagccatagctggtctcctctgggcagcatcagcacaccctccatgggcgggtgcttgctcaggatcacacagctggtcggaggaggcaggatttgaactcggcagtctgatgcatcaacaccccatgccta

SEQ ID NO: 250286 - DNA, 416 bp, Homo sapiens
ttaatttttatttgatgaataaataaaccaagaaagaattattatttgatcaatgtgtatgttgaaggaagagagttagtagagacaagaggggaccataagaaaaaaagtgataattaatgtccaaaaacctagacacaggacaggatgacatccaaagaaaaagataataaatgtataattgacatgctgtatgattgtcattggggaaagcagagaagaatgtgtgttgtttcagattgtggtttgcacattcagaataaggaattaaagagatcttagtggtgacactatattctatatgaaattgtatggtatacaattatctgataattaaagttggagaaagcaatttgctgggcttcttaagagtcataaaaaaatttttgaataaagtatcatataccatggtttca

SEQ ID NO: 250287 - DNA, 765 bp, Homo sapiens
aaagtagaacttttatatatgtttaaaacttcaattacaaaaaaattaaatacaaatgctttaaacaaaagttttgaaatatcaaggcaaaaatggtgtgctggagtgacatggtaaagccagcaaaattttgaccatattctgaaggtcagccctgacataaatgatatgaagaaaccaactatgaaatggatgcatgagtttcccagccagtggatattacttaatttgtagtttccacatatttgggattttattaaatgaatttttatcgaacaaattacctatattatacagaagatcagcctttcaagtttagaacgatagatgtctcaatatgtttatcgtgggccaccaccaaataagaatattagattttgccctagcaaacataacatctaaatattccaaagccacttatgcatgatatatgaacagattcccaaaagcacattatatgaaaatcaagaatccagttttagcctttaatattttatgtttgatataaacatgccaaatatttaaactttctcatgcttttagtgatatgtgaagaaatgtgctactatctaaaataaaatagaaattgtcaagtctgaaaacccttctttttctattaccacctcctcaaaacacagagccttcgatcctcaatttacaactgttgctttgggaaacatctgaaagccaccctctataatttcacatttcattcttatgacaaagttagtctgcatgtggctttatcttagtatattttacaaa

SEQ ID NO: 250288 - DNA, 475 bp, Homo sapiens
aagaggaggggaaaagtattcccctcaataaggctgatgtcagaggcaatgttcgaccagtactactaaattctaatccatttaactgtgataatttctggtaaaatcatgagttttcatgacaatgtctatatccattatatgtgatctgttggaagttttggctagagaaacttaattgtgaggaaatttaaatattgtgtgatgcaagtacttactgaatttggaaaccccttgatagcattcccagcaagtgatagttcaacctttgcttttattcttccagccacagagaactcactgctttaaaaccattccattactgggtagctctgaattgttttcattgttttctcttaaactgaaatctgcttccctgtaatattaatgaatacagctaaggacataccgtgtggcatactatgagagagctccatccagggtgaggcatcaaaatcatgaacctttttaaaag

SEQ ID NO: 250289 - DNA, 852 bp, Homo sapiens
ataagcaaaatgttaacagactgaatccagcagcacatttctttaaaaagagatataccttgaccaaattgggtttatcccagaaatactgaaaatggtctaactctaggaaaacgcaaaatttgagtcaccaaattaaaggaaaaaaactatgaaatcatttcagtagattgcatttgatacaattcatacccatttataatgtaaaacttagtaaattccttaatgtggtgaaaataatcaacaaaacatctacttcaaagatgattcttactgaggaaatatgaaaaataattacttgaaatcaagaaaaagaatgcagactatcaccacttcttttcaaccttgtactgaaactcctagcaagtatagtaaatcaataaaaagaaattaggctgggcgcagtggctcacgcctgtaatcccagcattttgggaggccgaagtgggcagatcacttgaaatcaggatttcaggaccagcctggtcaacacagtgaaacctcctccctactaaaaatgcaaaaattagccaggcgtggtggtgcagccctgtaatcccagctattcaggaggctgaggcagaagaatcacttgaacccaggaggcggaggttgcagtgagccgagattgtgtcactgtactccagcctgggcgagagagcgagactccatctcaaaaaaagaaagaaataaattaatggcataagtgtaaagaagaaaaaacaaaatgtcattcagaggtgatatgattatctgtatagtaaaccccaaagactccacagttttttagaaataatatttttctcaaagtggcttcccgtaaactcaataaataaaaagttgcatttctgt

SEQ ID NO: 250290 - DNA, 282 bp, Homo sapiens
caagcaaaaacttcatagctttacctgtatttcatatttccttcctaaaggggcagatcatttgcagttcctttctacatttttttttttgagacggaatagtttcattctgttgcccaggctggagtggagtggcacagtctcggctcactgccactcccagttacttggggggctgaggtaggaggattgcttgagcctgggaggcagaggttgtaatgagccgaaatcatgccgctgtactccagcctgggagatagagcaagatcctatttaaaaaaa

SEQ ID NO: 250291 - DNA, 364 bp, Homo sapiens
ctagctgaaatgtgaaagtaatctactttaatagctttaaaccacaagttggtaaattgaaaatgagccctgtgacctggtgcggtggctcacgcctgtaatcccagcactttcggaagctgaggccggctgatcactggagcctaggagttcaagattaggctgggcaacgtggcaaaacccactgtctgtcaaaaaaagtgcaacagttagccaggtatgctggtacacacctctagtcccagttacttggggggctgaggtaggaggattgcttgagcctgggaggcagaggttgtaatgagccgaaatcatgccgctgtactccagcctgggagatagagcaagatcctatttaaaaaaa

SEQ ID NO: 250292 - DNA, 886 bp, Homo sapiens
  misc_feature (19)..(19): n is a, c, g, or t
  misc_feature (21)..(21): n is a, c, g, or t
tgtgtgaaatccggatccncnctcgaggtcgtttgtatcgataagcttgattgtgcgggggattcgatgtttctgactgaaatgcatacatgtgttaaccaaaaaacaggaatactggctgtaatggccccaaactagaagcagtactcaaaattcaaaagtagagaaaggataaataaatcacagtgtacccattctataaagcagtgagaatgaacaatatacaactacatgtaacaatatggataaggaaaccagatgagtatacatgataattccattcatatcatttaaataaaatacaaagaggcaaaactaatatatactatttggaagtcacgacttttgggggatcagtgattgaaagggagcagaaagggcctttccggggtcatgataatgttgacctttgatcggggtgtattcagtttatggaaatgcattgatctatacaccaatgataaatgtgcttttctacatgtatattttacttcagtaaagttaaaatttgaaaaaccactctgccaaattttttagtgcgaaagtggatacagtttagagcaagtgaatggctactgcagtctatgaagcaaggaaatgtctgagagtttggacttgacaagtcctggcagaggagacctgagtggatgggtgtaaggtattcctgcagaataaaaaaatctaagacattgcagtactggttgtaacagccccaaactagaaactactgctagaaactagaactactggctatgtaactaggcagcagagtaccacctcgagggaagggaagctagaggagaggaattctgttggaccttgatgctttaaagattcttctctgagcttgatcttaacaatgtggaatatatttcctttctcatga

SEQ ID NO: 250293 - DNA, 538 bp, Homo sapiens
tggctttcctccctcccccaatctatgggtcacagctaacagatctgagggcaactgctgtgctagtggccagggctgcacctgccatccccggctctgccactttagggccttctagaggcagtgtccttaggaagtagctctgaggcatgggttttctgctcctgtgcagggcagctgatgggataaggtggggaaggacggtcagtgcttgggccccagctggccagcctggcgatggggaaaccaaaccatgtcccccagcgaagggccagagtgggaacctgtcctcatgcccttcgtcctgaggagccctgaggtgggcagcaggggccaggggaagttttcaggccttcatcaaagagaacaacatcctcagctccgcacccctcatcctgtatcagcacttaccggtgtgtgactgcccttgtcagctagcatacggtgggcccacctggcccactggctgtttatgccactgatttatgatagggaatattatctttgaacccaatgaagtgttttctcccccatcaca

SEQ ID NO: 250294 - DNA, 886 bp, Homo sapiens
tggctttcctccctcccccaatctatgggtcacagctaacagatctgagggcaactgctgtgctagtggccagggctgcacctgccatccccggctctgccactttagggccttctagaggcagtgtccttaggaagtagctctgaggcatgggttttctgctcctgtgcagggcagctgatgggataaggtggggaaggacggtcagtgcttgggccccagctggccagcctggcgatggggaaaccaaaccatgtcccccagcgaagggccagagtgggaacctgtcctcatgcccttcgtcctgaggagccctgaggtgggcagcaggggccaggggaagttttcaggccttcatcaaagagaacaacatcctcagctccgcacccctcatcctgtatcagcacttaccggtgtgtgactgcccttgtcagctagcatacggtgggcccacctggcccactggctgtttatgccactgatttatgatagggaatattatctttgaacccaatgaagtgttttctcccccatcacaaaaaaaaaaattcttatttttagtagacatgtatttaccaaaaatatgtactcaattattgtattttggattttatcaatttaaaaattgtggaaatttgtttgctcttacgccaacataatattgattttgcctcttgctctgaaagcccaaaatatttaccgtctagcccgttacagaaaaagtctgctgactactgagccagacctccattacctccatccctgttggattatttaaagaaagcctcagacagtaagggcttttttaaaagaataaaatgacttggtttgcgcttggaagcaggggaagcattcagatgagcggtttctgcattaaccctgccta

SEQ ID NO: 250295 - DNA, 246 bp, Homo sapiens
caatgtatagttaagtcactaggatgaagacacaagacaaacgaaggcacaagtaaataaaccggaggtactagagttaagaagtaaagcaaagaactttccctgtgtagcacgaatcacagagagaggtatggaggagctatagttacagtctgtttcattgtcataataattgcttttaagatccagagccagtctggtgtttggaaaacaaaaagaaaataaatatattttatcacaacccaa

SEQ ID NO: 250296 - DNA, 405 bp, Homo sapiens
atatatataataaaaatttatatataaataaatacataaacaaactcaagtgtccaacagggctagataaggagcttacaagaatgaagcagttgtgatgtgattcaatagggaataggtggggccttggcaaaccaaagaacatattctgtctaaagtggatggccacaacttgctccagctgtggaaacttgggccatgtactgctagatctaaggattttcttttgagagatgctagatatatacgttttttaaaaataaaattatcctgattttaacaacattgccttattatataaaacataccttggagggtgtgggtaagacacaatgtccttgaaattatatttcactgggttaatgaaattggctccagaagaaaataattttaaacagcaaacca

SEQ ID NO: 250297 - DNA, 360 bp, Homo sapiens
cagagtaaaatcagaggacttctgtaatcattctctaacagaactcgaagtcttccagggcagccaatacttactaagagaaatcaaggtctcagagaaaccaaagaaacagcctcagggtctccgattttgaacgttatgccatagactaggtctgcacacaacaaaaacagtaactgtttcgatggcactttttccacaggtaatatcatcttatatgtttggctaagtctcaacatcccaaaaaggatcaaaagattctctaagttttgcagttcaacaactgtgcacacttttatttctcatttcaagtgttaaggatattgctctaatgactgcataaaactctctcctcatgta

SEQ ID NO: 250298 - DNA, 593 bp, Homo sapiens
gctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagagaaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacaattgttatttaaagaaccaagtatgtattgcatgaaaacattatgacctttttctcttatttaaataaactccaaggtaactggacttctaaa

SEQ ID NO: 250299 - DNA, 301 bp, Homo sapiens
gggtggagccaccacttccagttctgatcttctcattctggttgagtacctgggcttgccagtgcaccccccaggaacaccgcctagtccagggctcccacaggtctcagactgacaggagactgggtcatatgaccagcactagccaatgagctgtgagtacacgtgacacagggacaagctgggtcatgtgactggcactagccaatgagctgtgaggacgtgagcacaggtccagctaggctgggtcatatgacaagcattagccaatgagctgtgaggacacgtgagtacaggtcca

SEQ ID NO: 250300 - DNA, 302 bp, Homo sapiens
tcaaggtctccgcctcttagaaatgcttgattttcagtattgctaaacagggattgaagaaaacaaactgaacaaagaaacaaataaagcctttaacacagtgagcaaagacacagcacctacgccttccccgggccccgcaacagctccagagctgcacagctgctcccagagcctgagcatggacctgagctctggctcatggatctcaccaatgcatttcttccctctgtgtcaaaaaagcatccagaaattggattcatttacttgggacataaaataatgtatacctacagttttgt

SEQ ID NO: 250301 - DNA, 251 bp, Homo sapiens
ctgtgcaccgcgggcctgagaacagccttcctttcaccaggctccgtgcacgtctggtgtttggattccacgcctgaggaaacgtgtgggtgaccatctggctgcgcggacgcctgcagggccagggacgggccgcccctccttcccaagggcaaacagcctcgggacggcgacgggacaagctctgctaagtagtcagccacaaatttgttttctttgaaggaaataaagaacaatttttctattgtata

SEQ ID NO: 250302 - DNA, 870 bp, Homo sapiens
ctcaattcatttttcacaattacagatcaagctccttgttctgcttttctccttctcactactgtacttgactagtctttaaataaataaaacctgtcttgtattgctgctcctaaaacaacataagagtaaattgtctgtactgtttgaagcttttccataaaacaaatttctcttcataatcacactaggatatgagagttaacattattttaagactttttgagtcttcatgttcattcttttatcaattgatctttttttttgtcctatgtggaattataagtaaatgatagaatgcagatgaaacttttctagttatatttgattttgtttctttttattttatccaggaataatgaagaggtatctatgctgaatataattatcatttacattctaggatgtattatctcagaaaaaaatatttgagggcatctgaaaagttttttgatactttgaaggaaaagatagattaggcttaaattgacactttaaatggtatgaagctaaaaagaaaattaacagaatggtgaaagtgttttgctaacgtgattggcaacagattgatatatactatataaggaaatcattcaaagactacaagcaaaaaatagattaaggtttatgagcaagtaccagatacgggaatctatttgagctcataagcagctaaagataatatatattaaaagatacctacttttagctagaatgctgataagtacagaccttttggaaaaatactttgatgttatttgttatgggcaatacaaatgtttcagtgcttccaccgtttaggggattataattcagaaataatctaaggaaagaaaatgctaagaattatgcatttcaggataacaaggg

SEQ ID NO: 250303 - DNA, 363 bp, Homo sapiens
gcgagaacttaaacccagagtttgatgataaggcctttgtttgtaataattctgcctaaccactatacacattcactaaatgctcccacagttgcctatgaaaccatctgatcatatccacaaacctaattactttctctttcaaaatcagttctaataatgtcaaatcagtctttattccatcagtggtgcaatgaggaacgttcttagtaaccaggcaattgatatccttaaaaatgtctctgagagccaggcgtggtggtacactgttatcccagctgctcaggagactgagtcaggagaatctcttgagcccagaaattcaagaccatctcttaaacacacacacacacacacacgaaa

SEQ ID NO: 250304 - DNA, 1009 bp, Homo sapiens
ggccaatattatcttcttaacttttcgtctagtgatttccctttcccactttttaatatttctgtggatttcatgttttttaaattaatctaacacatggcattaatggaaaataacccattatgttttaattaatgagttctaatcagtttctgccactgtctttttttcatgctcaaattgtcccaagcttatcagtggttccctttcaagctacttcctatgtccttttgatataatgtcattggtgtttgaagactcccttgctttatgcacaccaaaatttccagggtcatcttgttatcttgcctgccccagacctgtaatcagccatctctctgagaagttctggttcttttaagtggggaatagcatttagaaaccaaatatgggtgttggacatgcccacttttaacggagcatcgttatttttaggacttttctaaggatagtgttaggaaatcatattttttcaaaatcacgaatttagtctcatagctccaattcaagtccaccactacaaggttcttcatcacttctcacattctatatatgcatctcccctctctcacagtgaaaacccaggttctcagcaatacttgcttattcactttatccaacaatacgtacaaaatagtttcagcataacaatactaatactgctaccaacagcaaactacttagtacaactgttttttttttttggacattgtttttgcacttagactatagtccattaagggtatctagttagagttatatatatagttagatacatttgtttctgttgatattcagtgttaggatgtgattttttatattcttattctgaaattctaaaaaaggtttgcatgattcaaaacttaaaaaaatgtggccaggcatagtagctcatgcctgtaatcctagcaatttgggaggccgaggccggaggatcccttgaatccaggagttcgagaccagcctgggcaacaaactgagaccctcatctccatatattaaaaaaaaa

SEQ ID NO: 250305 - DNA, 530 bp, Homo sapiens
tctctttccagtacctcctatctatctagataatacggaagccagggagaagaatgggaacccaagatctatgagcccttatggcatatgaaaagtgggtgttatctgaaaagtagaactctagatgaaaccaggcctttcccaacaatggagcccaggacaatgctgtcttcaatgtccataccattagacttgttatagatgagtttctataatgatggctttctggttaattaaaccttctgaatgattctgtgtaacactgacttctgtgattcatcacagaacaagtcttccttctttcatggagtattactgttttcagtgactatatttggttgtttactctttttggcaccaatcacccagtgaatcaacaaccagagttgcaaacaaattaccctcattgtcttttccgagtcccttaatttactttatttttcatttgttgcaaatgtcattgtttctgctaatgttgttttttaacatctgccaagataaaaaataaaaaaatcacttgtaaaaaaata

SEQ ID NO: 250306 - DNA, 841 bp, Homo sapiens
agagagggaaggaaacatctgtgctggggcctgctccctctgccccagcactggggaatcactgccttcctggctgctgccacataccacaagatctcctctgctggagaggagaggatgtgttcctcccaggccacggggcccctctgccttgccccaagcacagagctacctaagggactgacctttgccacactggagctcacctcccgggggcctctggcctacccttttccctgccagctgaagagactgccggcagcctggacgtcctggttagctgaaggcagctgaaatgtgggcctccctatgtggggtttagtactgaattatgtgtttgtggttttgcttctttttgtagacccacaaatatttttatttgaatagtaaagagctgtgctcagattgtagccatggttgggatttgggatcaacgaggctggttagctggactgggaggggaggcaggtgagatgggaatttggtgttggttttctcactgtgctgtgctcctagcccctgaggactttgcaggaaagctgtttggattgaccacctcaaggaactcctttgctgtcctatgacaattactcctcttgtctttccacctagaggaccgttatgccggggctgtgagttctggctgaagctgcacaatctggctttgatctgggtagctaagaacaggtgttcagggagggcatggtctggaggcgcctgagggaaaagtatcttctggttagaagtgaagcaccaatgctcctgttgcttcccttctcccatatcctctcctgaacaaacactgtgtggcttctgtcttcttggctgtgtgtttcaaaac

SEQ ID NO: 250307 - DNA, 475 bp, Homo sapiens
ccccatgttatctttgaatgtagacacagcacgctttagggttgcaatagcaagagacttggttgcttgtaggtcattataacgaatgccccctggtcctctcagtttctcatcctgcttccctagatcctagaccccacttcctgggtctctactgagtcccaggtaaaccccactgccaaggaagggagccaggtctagtgagaggctgcagcagtgagtgtttcaggaaagcaagcagtggagtgggtgagagccagcaggggagaatctacttggcacctgtgccaggccccttggcattctcctcacgtttccagcccctgggaggattgatgcatctgcctttgagctgttgtgaaaacgcaggggctgagaaatcacttttgtgggctggggtagggggaagggctgaggcttctctgggagatgtccaatgagcggccagtgctgcaggcttggaatcttaatgagg

SEQ ID NO: 250308 - DNA, 490 bp, Homo sapiens
ttaatgaggcctgagccctgaccggagagagggaaggaaacatctgtgctggggcctgctccctctgccccagcactggggaatcactgccttcctggctgctgccacataccacagtggggccgacctctgggcctccctgtcacatgaaacatggaagccaacagcctggccccacagatctcctctgctggagaggagaggatgtgttcctcccaggccacggggcccctctgccttgccccaagcacagagctacctaagggactgacctttgccacactggagctcacctcccgggggcctctggcctacccttttccctgccagctgaagagactgccggcagcctggacgtcctggttagctgaaggcagctgaaatgtgggcctccctatgtggggtttagtactgaattatgtgtttgtggttttgcttctttttgtagacccacaaatatttttatttgaatagtaaagagctgtgctca

SEQ ID NO: 250309 - DNA, 474 bp, Homo sapiens
caaagatatttgagttaatgtttaaaactgaaaatgatgtcaccaattaaattcatcacagaaagaaaaaaaatgttaacatttaaagaatgcctactatatatgaggcactttttacctttaggttttatagttaacattcttatatacaaagaaactgaagcttagagagtttaattaactgacccaatataaaaaaggtagttaatggtgagcctggcattcaaacctaggtccatttgctgctgaaacccatacatgccctttccaatactacctagctctgggaatttataagcacacaaatcatgagtacaagatacaatacaactttagaaagtcagtcactaccagaaaattagtaaaatgtttaagggccagacagatgagagtagcactgctcagattttccaatacactgaagagcttcagtctctaggactaatgtaaatggtttgaaatggggagataaat

SEQ ID NO: 250310 - DNA, 452 bp, Homo sapiens
ccacagggtgtggtggcagcaggtgcctcttctgcatggccagggtcccccatcgctcacagctgtcagtgtgcacatgctcagacctgcaccattcctgtccagcccctgcagttaccacctggaatcttcagccaggacttggaggctgtgaggtcagtcgggaagtggatcaggaggccacccccttctgtggcacttctgagatgacaacttgtttcacagttggatgggggtggggaaggaaagagcggccccattattccagaacattttatccacacaggctcagacaccctgtgatgaagagtccaagaacagcctgagataaggatgtcattcttctttcacaggccccacgatgggtttatcttttgggaccaagacattgggtccctacatgttttcccctacccttcttaggaaataaaatatcaaacaacccacagtcc

SEQ ID NO: 250311 - DNA, 349 bp, Homo sapiens
ctctctgctgggagcctttgtgcagtgcacaaactgcacgcgtgtatgtagtagccctgctaataaggattacttagaccgagccaggacaatgagattcaatcctgaaatttttttcaaacttggaaagaggatctcttttccatgggattgaaaatagagctcctgagaacctgcctgatggagagtgcaacatagagaaaagcagaacgaagacacagagagaaggagttccattttgacttctagatccaaccttgcctgcagctgagcttgttcactgagtaagattatcactatacttttcagttttatgagccaataaatccctcacttttcttcaaataat

SEQ ID NO: 250312 - DNA, 422 bp, Homo sapiens
cagagttctggaggtatttttagtctccatcttaaagataaattcacatgatcttcgaattcgaaaggcagcagtaaggcagaaattatttctcttctttctctggcagcagtagaaggcatagcatgggcctcctaaatgattacttagaccgagccaggacaatgagattcaatcctgaaatttttttcaaacttggaaagaggatctcttttccatgggattgaaaatagagctcctgagaacctgcctgatggagagtgcaacatagagaaaagcagaacgaagacacagagagaaggagttccattttgacttctagatccaaccttgcctgcagctgagcttgttcactgagtaagattatcactatacttttcagttttatgagccaataaatccctcacttttcttcaaataat

SEQ ID NO: 250313 - DNA, 396 bp, Homo sapiens
atgacccactggagagtgagaaatttaacccaaacaagttgacgtacattcttgccgtccactccactgctctgggaaattctcccctggcccttccattaaagccacgtgataacccatgagatgttaccatgactgtggggcccgcattggtcaaaatggaggacataatcaatctgtgtaagcgacctaaaattgccttgtccctcttgcatctggcccttgcttacagaagggctgggtatgagtagggtatcattggtaaacaggtgaaaatagctcccgaaataggaaacatacaattttgtcctggtggaaggagagcaacaatgctagtacctagggaagtggggagtgcattacaccttgggaaattctgggacagggaacattaat

SEQ ID NO: 250314 - DNA, 5401 bp, Homo sapiens
  misc_feature (343)..(343): n is a, c, g, or t
  misc_feature (378)..(378): n is a, c, g, or t
  misc_feature (696)..(696): n is a, c, g, or t
  misc_feature (894)..(894): n is a, c, g, or t
  misc_feature (1142)..(1142): n is a, c, g, or t
  misc_feature (1891)..(1891): n is a, c, g, or t
  misc_feature (2039)..(2039): n is a, c, g, or t
  misc_feature (2050)..(2050): n is a, c, g, or t
  misc_feature (2118)..(2118): n is a, c, g, or t
  misc_feature (2132)..(2132): n is a, c, g, or t
  misc_feature (2181)..(2181): n is a, c, g, or t
  misc_feature (2388)..(2388): n is a, c, g, or t
  misc_feature (2520)..(2520): n is a, c, g, or t
  misc_feature (2556)..(2556): n is a, c, g, or t
  misc_feature (2692)..(2692): n is a, c, g, or t
  misc_feature (3978)..(3978): n is a, c, g, or t
  misc_feature (4047)..(4047): n is a, c, g, or t
  misc_feature (4113)..(4113): n is a, c, g, or t
tcggtggcttcctcctcgtcccctggactctcgctctcttcctcctgtctcctcggccccttctccgcaggctgaaggcggagctggagatattcggggagcaggtccggagcgcccccgaggtcggggccggcgagggagaggccggacctgagctcccccgcgctcgcgacgaggaggatcccgagccgccggtggctgcccctgacgccctttaggccagcaggacccgcccgttcccgaccttccctcgagacccgccaagaaataaaggcgatgatttccgaccatgctcgcgttctccgcggagtctgtgctacaccgtggagcggggcggggcgtnctgggatctcgaggcggggcctctgccggaccccncccaccagtcgagccccgggcgccgtacagaggctgggtaaatgctcctgaactcagagagagtaagtgggtgtcagtatcccccgccccacggcctcatctcgagttcccaaaccatctatgttgtcaacaggggccggagggcaggtgttaacccattccggtcctcggggcctgtgcgtctccggtggtctcaggaaacccagagtctctgcaagacccgcagactcgcgctggctctgggacatgcccgcccatctgagctcccctcacaaattgggttctagccaaggctgcctctccacccgtctcaaacantccaaaacacgtgtcccctcggggccttcgccctactggtccttctctggggtcacatcccccaggcaacctcagatctgttaaatgtgtccgccactctggaggccggcatttgggacccaaatccaaaggcacccagcagcaggctgcggccattgactgagcatgtactgactaagcaggcatttgccgattgcntgctgggtaccaggcactgttctaagcactggattttaaacagcgcggtcagcgacggcctcacctaggaagtggtatctgagcggagaagcgaggtagagaagcgagggggtgagccctgtgggtgtctggggaaaggtgggcctggcagaagacatgcctcatgccaaggcgggaggtgaggctgcacttcgctgtgtttgaggagacgtctggagaaggccggcgtggtagagtggaatgaggtngagtgggatgggagacgacactggagagttgccaaggaccagtcaagttggacactatctaatgtgtgtagaagaggacctggcacacagtcagtattcagtgaatgccagctctcacatattgttgggatgattcactattcccagtccctagagaatgggaactgagatgtgtgactcacttagatcagaggcttctgtccattaagtgatcagtaagtggttcatatgatttattattattattcccaggctacagatgaggaacactaaggtgtgtatatctctcagaacagagatttttataacataaatgctcaataaatggtatctatcatttattattctcactgctattcttgctgttattcccaatttagcgatgaggaaaattgagatagtgaatctgtacagtaagccctcaataaacgttgggtctcacgtttgttgccattattatcccaagtccacagatgaggcccagggagctttagtccccgagtcaccactcgcatccgggcagagctgactccaggcccaggctgtggtcccctgccccactgacaccacctacttgctaaggccagtctccaggaatctctaaggaacttcagtatcctctttgtcatcctctctgtgtcacacaaatggggtcagcctggatattctgccgatttaccactgggcacctaggattcgagtcctggtttccctgttcaccagctggatgacctcaggcaaattgcttnatgtctctaaaacgcagtgaccagctgggtgctgtggctcacgcctgtaatcccagcactctgggaggctgaggcgggtggatcacgaggtcaggagttcaagaccagccttgccaagatggtgacaccccttggtttggtggtggcnggtgtctggantcctagctactcaggaggctgtggcagagaattgcttgaacccggaaggcggaggttgcagtgagccnagatggcgccactncactccagcctgggcgacagagcgagactttggcttttgatttgccctntgttctcctgactcaactgaccttcctggcagggctacttctcctttcattgaaataattgacagctgcctgggaagtcttcactcacttcctgtaacagcttttctcagggcttgcattcaattaccataattctcaagcttcttggcttgtagttcaggttcaaatgtgaatgagcctgggggagctcagtgttgccaaaaggcngaaggacattctttttattattattattatttttatttatttatttatttatttttgagacggagtctcgctctgtcgcccaggctggagtgcagtggcgccatctcggctcactgcaagctccggctcccnggttcacgccattgtcctgcctcagcctccagagtngctgggactacaggtgcccgctaccacacccggctaatgtttttctgtatttttagtagagacggggttttaccgtgttatccaggatggtctcgatctcctgccctcgtgatccgcccgcctcggcctcccagantgctgggattacaggcgtgagcaaccgcacccggccaggacattcttgaaaaaagtaagccagaaagaaacccactgaaaaacagaggagtcagaggaggggcccgaagagatgcaaacatagcacatcctgagtagcaagctagacaaggcatggaagagagagtggccaaagtgactgcagtagaatctcccggaggataataatattactacctaatagagcacactagttagcagaacagaacccagggccagactgtgtttgttagaatcccagctctgctgcatactagctgtgtaacttcaggttacacagttaggttacttaaattccctttttttttttttttttgagatggagtttcattcttgttgcctaggctggagtgcaatggcgagatcacggctcactgcaacctccacctcctgagttcaagggattctcctgcctcaccctcccgagtcactgggattacaggcgcccacctccacacccagctaattttcgtatttttagtagtgacggggtttcaccatgttggccaggctggtctcaaactcctgacctcaagtgatccacccgccttggcctcccaaagtgctgggattacaggcgtgagccaccctgactggccgttcataaagttttgaggacatgtagcatgttacgtttcagagaatcaaaggcatccaccatttcttttttgatctctcaattttgtgttcatttagatttcagacagcaatcaaaacatcaagtacaggtgaatacaatcccaggccaccttttcctgggaacctggatattgagctcttacttttctccattctaggatcttgttaagcagtgatgctaaccagtgagtagaacagtgagaggtccgtgcatattctatttgctgatctaccagctgttttaagggactggtcagtggcagaattaacatatttgccatacctacaaaattcacaagtacctagacttcattttccattttcctacaaaactcaaactctgtttttgtgacctattactcaccgtaatcctacccagcatctttctcattggaatcttgagtaacatttacccaaagattacattagttccattcttcttcctttcattatcaagtcattattagatggagatgatttgaatagcctaggtgcctgttttttgtcttgtagtccttccttggtgttaactctgaaattaatttatctctttttttatttttatttatttattttttgagatggactctcactctgtcgcccaggctngagtgcagtggcacaatctcggctccctgcaacctccacctcccgggttcaagcgattctcctgtctcngccacccaagtagctgggactacaggtgcccaccaacacgcccggctaatttttgtagttttagtngacacagggtttcaccatattggccaggctggtctcaaactcctgacttcaaatgatccacccaccttggcctcccaaagtgctgggattataggcgtgagtcaccatgccctgctaaaattaattgatttcttccaagtgtgtgcagtcatgttttacttctgtgatcagacctatttaagagttataaagattccttccaattgtatcttatgaaagccagtaggcatttaatgaccttcttttctggagtcattgtctttatattttgtgcctcatttttggaaagcctgttttactttccgtgtgtcttcttatttctaaagtcttattaaacctacattatctaaaatgcccattacctataaatttctcttccactctgagattaaatatctttctcagtggttacctttatatttttagaacattttattgtttaaaaatcacagtcaaagcttcaaaaaacatacaccccaaaatatcccaatttcagtatcctactacccagaggagagcacatggctgttcttccccttctggtgcccacagcactagcgaggaccctgccctgaagagaccacttgcccaccctcctgcccaccatatgttaagtcaccgtttctaatacatttatttatttatttatttatttagtaagatggagtctcgctctgttgcctaggctggagtacagtggtgcagtctcggcgcaccgcaagccctgcctcctgggttcaagcaattctgtagcagcgtcccgaggagctgggattacaggcacccaccatcccatccagctaatttttgtatttttaatagagacggggtttcaccatgttggccaggctggtctcaaactcctgacctcaggtgatccacccacctcagcctccaaaagtgctgggattataggtgtgagccactgctcccgggccctaatgcttttataatttagtttatatttgaactatttggaatttattttgtgtctgtacataatctggagagaatttactgaatagcacatgtatccccccaactgcaatgccatcctcgccatataccaaataatcatgtctattttggtcaatttctgaactgtttattctattcctttatctagttacctatttatacacaaataccaaactttttattattatacccttaaataatattatgaaactcacttggtgagacctcctctatattttcctactgtttcagaatttttcaagggtagtttctttcctatgcatactctagaatcatattgtctatttcc

SEQ ID NO: 250315 - DNA, 808 bp, Homo sapiens
attcaaaaattattaagaaattcgagatggcaacagcagttgtcacaccaagcacagtgcccttctgagcatgaggctctgtgtgactgcatgggtccatgagaccagcactgtgtgggtctgaatgatggctttggtgttcagtttagcacacgcggtctaccacgtctgcatgagtggtaaatgtagtgcctgggtcaaaatgttccttctgttcaaatcgaaatacctcatctctatggctctatggctgtacattaggacctagaacagtggcccattgctcttagactggaaccatgtccactaaaataaacctaagcagatgttgtagacctagccccacaggactgcatttagctgcttcagtgacactttgatgaaagtatggagaagtggagacattatagataaaatatatcaattcccagagaaaactcttgacttaaaaacttaactgtagtaaatatatctttttcaggtgatgaattatttttttaaaaaaggttacatataggaattctgcagtataatttggaggctattagtgctatattaatggaaattaattattttttaagtaagtccaaaaaataatctagaaagtaagtttccagagcaaatctgacctagcatttggtatgctaggctctgcttttcatgattttgaaataaatcataattagacttaacaatatggagaaaataaacttgtatttttaagtgttctgttggcttattttctgtttcatccaactcaataattctgataaataaatttggttctagtttggtgcttgaaaaaata

SEQ ID NO: 250316 - DNA, 307 bp, Homo sapiens
  misc_feature (48)..(48): n is a, c, g, or t
  misc_feature (61)..(61): n is a, c, g, or t
  misc_feature (65)..(65): n is a, c, g, or t
  misc_feature (73)..(74): n is a, c, g, or t
  misc_feature (88)..(88): n is a, c, g, or t
gaaaaaaaaaagttttcttttgaaaaatttgtttcttttttttctttntttaaaagaaggntttnaaagaggnnttcccccccaaganaagaataatctagaaagtaagtttccagagcaaatctgacctagcatttggtatgctaggctctgcttttcatgattttgaaataaatcataattagacttaacaatatggagaaaataaacttgtatttttaagtgttctgttggcttattttctgtttcatccaactcaataattctgataaataaatttggttctagtttggtgcttgaaaaaata

SEQ ID NO: 250317 - DNA, 336 bp, Homo sapiens
atgctcactcccactcctgttgcataattcaggtgtgcctctgggaaaagccgttcggatcattgtctttacccacataatccttggtggtgaaggtgtggcctaaggttaattttcaaactgcataaagatatgaagctatgataccaaaaaacagaaggaaaaaaatgccaattatttaaaagactctgggagacagaagaaacccaagatatctttaactgatgggttcccaaatgcctgcccgtggatctatcagttttcattgacctgcagcaagaatgacaaaaaaacaaacaatgcactgaatttttcataaagcttaatttattcaaa

SEQ ID NO: 250318 - DNA, 368 bp, Homo sapiens
gaacatgacccgcaccactcatggggccatgtttgtctcagaaaatgcttgaccacagagcaatgcagttggcaaacaatgaccaaaagataaccagaaaaaaagtcactaaacaagcaaatacaacagcagcggcaaacacaacacatggctgggaggggagatctgatttccagagttgccatatgatttaaaacgtccagtttttcacgggaaaaattacgggacatatagaaaacgaaaaagtaagctgcgcatggtaaaggcaatgtaatttgaagagaaaaaggagatataaatataagaaaatcagatgtgtacatgattcatgtttgcagatgacacaactttattcctagaataaagtt

SEQ ID NO: 250319 - DNA, 647 bp, Homo sapiens
tgagattacaggtgtgagccactgggcctgctcattagttcttgctggtgtaacaggagggcagagattaggccacagtagaaatctacagcctttcagctggaaacaactgtgaaatatcatacactgtgagctattatagtggctttacaatgtttttactgatataatcactatattcattttttttttttttttgaggtggagtctctctgtcaccaaggctggagtacagtggcgcaatctcagcacactgcaacctccacctcctgggttcaagcaattctcctggctcagcctcccgagtagctggcattacaggcacccgccaccatgcccagctaatttttgtatttttagtagaaacggagtttcactgttttggccaggctggtctcaaactcctgaccttgtgatccacccacctcgacctcccaaagtgctaggatttacaagcatgagccaccgtgcccagcacactacattaatttttaacaccttgtactcgctcatatattttaaagttgacatatagaaattttcatcacaactctaaataattacaaaggatatttctggcatcttataaatactgatattataaaataaaacttacattactatttttaatgtacgcaatggagact

SEQ ID NO: 250320 - DNA, 725 bp, Homo sapiens
cacacaggctttaaaaatgattaaattactcgttcagtatgatcaggattatggtcaagtgccttctttctgctcttctgtctgacttgcagctaaaaataaaagtcaggaattagattcttctttttcttctccactgaagagcaccctttgtggtcgctggcgctggttaggaggagatcccctgcccagagccctcatgtggggacaggatcttccggcagcactgggtgttcaaggtagggtgccgggcctttggtttacatttctggatgaagctcttctgctgccctaccctccctctgtctgaggccacccggagtcttccctttgcggcacacagtaagcagctttagtgacacgtttccgggcctcacctcctcagtttgctgagtctccattacatctgtggcaccgtttaagcagcccataatcatttgtggggtaaattaatacagtacatgtctcaggccctcccccaggattggcatagggaactgagaattccacctgtttccctttcctggatccttgcagttggtgaccagtggagaagatggccctggggtttcctcctcagccccaaattcctacatccctccaaaagaacctcagagagcaaaggcagccggacgcatccgaccctggcctccttctcaccactgctgacagaaggagcagaatcttggcagcattgttaggtcttcatctgctattagctgatt

SEQ ID NO: 250321 - DNA, 294 bp, Homo sapiens
ctgggagcaatgcaatgccaagagaggtgtttttttgttttttgttttgttttgtattgtttttaagtgacctaatctaaattgctaaatgaactctttggttatcttatggagaatggactttttgggaagcagggatatgggtttgaagataagttcagtaatctaggcaagagataatggtagtttatagtgtaatggaagttatataatatatatttgtatatatattggtctcaggatatatttttgaatattttttatccttctgatggatgaagatgcaaaaaaaaa

SEQ ID NO: 250322 - DNA, 883 bp, Homo sapiens
ctaaaagtgtgatgtcaagaattgagaatgaaaatttaaaaaaaaaagttgagaatggtactcaagattaactgagtcttaatgcgtggaccacaacatactgatctcctaaagtactagttgtcaattcaagcaaataagtgtcttgaatttcccttccttgtgcataaagttaaagactgtacttcagtattctactaagtctagttgccaagcaatacatgctgtattataagtgttgtcttgaactgatcactatttccaaatgctgctattaccacttcttaaattataaattagtttagcttcatcagcatcagtttggtctcttgtggattcattaaccattcaatgtaattttccaattagtagaacttcagacatgtatgaattgcacttcaaatatgaatcacccatgcttctattactgtagaataaatcccccaaattatgctttacaattacagtcgcccaaattataccttacaattaacaattttgttatcaaaggagccctttttttttttcaccagaaaatggtaacaaatggggaagataagctgtgcgttcttttgcccaacctcagtggggcttaataataccactactcttactgtttaaaactccactgtaaagtgagattgatacttctattgcctgaacattttattgctgttgcagctgaagattgtatagcttttgcctgtaagtcattctttggtaaataatactgttttttaataatatcaatagtaggggtccggtgtggtggcacatgcctgtaatcccagaactctgggaggccgaggcaggcggatcacctgaggtcaggagttcgagaccagcctaactgacatggtgaaaccctgtctgtactaaatac

SEQ ID NO: 250323 - DNA, 571 bp, Homo sapiens
tggtaaatttttttccctagtatcattaaacatttgccacctaactgataaatcacactaactggtgacagtgcagggggagcgggggaaagaggcactggctagatactctggctagatactctggttaacattagtttaacaagaagaaaacagaagcagagactaaaatccaagtttgtgtgcttctaaagcctgtactctttccattatgtcctactggctctatcaaacactactcctgggatcttctcttattcatgtattttatatggattgtgataacacaataaagactttcgttccaaggaacaaattgcctgtatccagttagggctgtggaatctaactccttcaattcttttaacagttgctgtatggcatagcagaaacaacgctggatttggaaataaaaaaacacataactgcatcccattctggcactgcaatgctgacagttacaacttgtgtgagtttaagcttccttggctagaacttagttagtaataataactgtcctatgcagctctgaagtatgttgtaaagtccaaatgaggtaatgtttaagaaa

SEQ ID NO: 250324 - DNA, 627 bp, Homo sapiens
  misc_feature (14)..(15): n is a, c, g, or t
acaacacgccattnncacctcgagcccaagaattcggccaaggaatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaa

SEQ ID NO: 250325 - DNA, 589 bp, Homo sapiens
actatctcagagtgtctgggggagaaggttgatagatatgtcatctctcaggtatttatccccaaactgcaaatttctgtatgtccgaggaaaggacaaacccattaaacctactttattatttattttccaaactttctgtgttttagttagaagcgtgatagatacagtcaacccttggaaaacttttttaggattttttgttgttaaaatgatgttcgtaaaaacaagccttctataaagatatctttcagtttttatatacccaaattaaagaataataggatagggattataacttttgattatattacaattgaaaacaatatggtcatacaaactttttttgtttttcctttccttgagaaaaatttaagactgaagagaagtacagagaattaaaaaaaaaaaaaagaaaaccctactgtgtttcttctgccagcatttaacaagtgtttatgcagtcatttttaaacttaaagaaagggaaacataacacacaaagttgatgtcctgtttgatacccaccaaccccctgggcaatcactatcctgagtttgggtgtctattattctagtatttaaaaagt

SEQ ID NO: 250326 - DNA, 407 bp, Homo sapiens
cactgcactccaccctgggtgaccaagcaagatcctgtctcctccgccccactcccccaccaaaaagaaacaggagataacaaatgttggcaagggtgtggagaacagggaaccctgtacactgttagtgggaatgaagattggtgcagccattatggaggttcttcaggaaattaaaaatagaactaccatatgacccagcaatccctcttcttggcacacacccaaaggagatgaaatcaccatctcaaaaatctgcactcccatgttcgctgcatcatgggagcacacacacatacacaaaatagaatatcattcagccttaaaaaaggagactctgtcatttgccacaacatggaaggatgtggatgacattatgctaaatgaattaagccagacacagaaag

SEQ ID NO: 250327 - DNA, 714 bp, Homo sapiens
gctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaaggtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatattaatacttgctgacttccaaagtatcatctgtgataatttatctcattgtattccatttcgttgtaccaaacatcctaattgtttggaaaaaaaaaa

SEQ ID NO: 250328 - DNA, 530 bp, Homo sapiens
caggagggaagaccaaggcccaaggagccaggaagttcctgacagtcatttgaaatatctttgcttttctctgctgaatctcatctttagttatgagaccacctctctagttaaaatacataaagtttcttaagcttttctaggggcagggtgattgtaaagtagcatacctgtcgtttgtaaagtagcatacctgtcgtgtgtagtggccattggtgctttcatgcttattttgacaggagacctgtaacaactcagaataggtttgcaagagaaaaactggtattatctcttcctaaagggaaatcattttcttctctggtagattttgcaaatgatctcatattcactaaacctctatttgcctggtctcaaaatggatgtgtactaaaagcagaacattgctagcccaaagctacattttctttaactaccttctataaacaggcctaacgtctagacctttttgcacaaagttgtagtcacaaagtcaagccccttctccgtaataaacacatttaattatatta

SEQ ID NO: 250329 - DNA, 507 bp, Homo sapiens
caggagggaagaccaaggcccaaggagccaggaagttcctgacagtcatttgaaatatctttgcttttctctgctgaatctcatctttagttatgagaccacctctctagttaaaatacataaagtttcttaagcttttctaggggcagggtgattgtaaagtagcatacctgtcgtgtgtagtggccattggtgctttcatgcttattttgacaggagacctgtaacaactcagaataggtttgcaagagaaaaactggtattatctcttcctaaagggaaatcattttcttctctggtagattttgcaaatgatctcatattcactaaacctctatttgcctggtctcaaaatggatgtgtactaaaagcagaacattgctagcccaaagctacattttctttaactaccttctataaacaggcctaacgtctagacctttttgcacaaagttgtagtcacaaagtcaagccccttctccgtaataaacacatttaattatatta

SEQ ID NO: 250330 - DNA, 2081 bp, Homo sapiens
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggaaaccg

SEQ ID NO: 250331 - DNA, 1958 bp, Homo sapiens
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggaaaccg

SEQ ID NO: 250332 - DNA, 1835 bp, Homo sapiens
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggaaaccg

SEQ ID NO: 250333 - DNA, 482 bp, Homo sapiens
agtgttttaggaagttgtcccagctaagattttagctgacagttgagatcaatcactagacagacaagtgagtgaatcttcagatggtcccagcttccagctgttgaatcttcctgctgagctccaaaccttgtgaacaggatgattaagttatctctgctatgctcatgagcgtaagaagtggttgttttcagcttactctaagttttgggggtgattcgttatataactgtattaaccacaacatcatgttccatttttaccttcgctgtcaggaaactcaaggtcaaatttattccttaaatacagcaactgcaatagccttaagtgttagaacaactactttttaattttataacactgagcatatatttctattttattaatcttattttgtctttcgttgaaaaaatatgaagtgtacataaacaacaaaatgacccctacctaccccctaataataaaagtatgaatttaatacc

SEQ ID NO: 250334 - DNA, 733 bp, Homo sapiens
ggtgcaggttttgcaaaaacaaaccattgatttggaaatcataaatatattctaaattttaatatagttacttatgttaaacataatgtgttaaagttttagcatattctttttgactaatcattagttacttatgttaaacataatatgttacatttttgacatattcttttgactaattaatcatttcctttttaaactcggagaggcaatggggggtacagagtgagacaggaaggcagcctctgtaacaacctgaggactcatggttggggaaagatgtcatctacttttagtcaagagataaatgttttacctgctaatagggaaacccacccaaaagcacagagaaaagtctggtcaaaacattgcattgcatctaataaaaactaattaactggtttaaaagcaaaagatcccttggtactgcaaaactcaatcgctttcacaataaatagataaactgctttgtgggaagaatttactaatacatggaagaacttccattagaaactacatgtttatttgatttcttaaaacgtatttaggcataatgtgtgttctaattattttcatttcttgaagaatatgtattcttatacaattcttattgttgacaactttgtggctacacttttgtcttttcttctttccttcctttctctctattatgccttctttttccccttttttcttcgtcaaaattcttaagccttctaaagtcaatcctgtc

SEQ ID NO: 250335 - DNA, 400 bp, Homo sapiens
atttgtttttacttttttgaagttcttatttccgccactttgcttttcaagtcatcctttgctttattttttaatcccatcctgtcatctttttctctttctttcctcttttatttttctgctctaattcatggagacagcatcttcctgcattctattgagaatgtccaagagatttttaaaaacattcttcagaactttgggaagatactttttctttctttctttctctttctttctttcttttcttctttctttttctttctttctttctttcttctttctttttctttctttctctttcttttctttctttctttctttttctttctttctttctctttctttcttcctttcttcctttctttctttcccttcctttcccttcctttcccttctt

SEQ ID NO: 250336 - DNA, 520 bp, Homo sapiens
tggctgagggagggaggtccctttgcaccatgcagctcccaggtgaactgtcaccccaccctgcatttctttgttctccatggatgatgccatccacctagtcagtcccaatgacccagagaaaatctgtgtacctcagttggaaatgcagaaatcacttgccttttgcattcgtctcagtgggagctgctgaccagagctgtttatactcagccatcttgggcccttctccagttcataattttatgtcttctattgtacagctttacttattttgtctctgttttttgttattgaaagagtgttgctgaaatctttgactgtaagtatgcatatccctatttacaattgtggatatgcctatctcattgaagttctatcacagtatttttgttattattattgtttattaatatactgcagggttcaccttgacaatttttcattattgtttatgattgaacaataattttctcattattgttttgttatgttgaactcattaaatcagtttggatag

SEQ ID NO: 250337 - DNA, 657 bp, Homo sapiens
cgccaagagcgcacagactttgaagcaggaaaagacagtctctagagcaacatggaaaggatccagtatttgttttcaggcaaaagcaagcctccaaaagccccttggttcttctctgtgtgtctcgccccttctgccttgtacaccagactgccggcaagcaagcggggaggtggcgaacagctgggatcctccagtgaaaagtttgctcagcgcgagagatgtcaagaggctgggattgtcgcctatcgggaggtggggagctctctcactcacacttcctgggaaatgaaggagaactaataggcagcccgcatttgcagccagccagcctgggtggtattccttgaagtgaagcgctcataaatcccttctggggccagagccggtttcacaagctgcaggatttgggtggcctgcctgctctttgggagcgggcttgggaagctgaagaaattgaatcaggacctcaggccctttacagactcccttctacacttggttgctgattaagaacattatgtggcatttaaaatggcacaattatcttccgttggccgttcctagctaaaagtagactcctatcagcccgtgactgacgacaagaaggctcttcgtccctgtttttgaaataaacatgggtataatctgaaaaag

SEQ ID NO: 250338 - DNA, 691 bp, Homo sapiens
gtggggaacgagcgccgggttccgtccaagcactgtgggagcaggaaaccccgagactctcggcgaagaacgtctctagagcaacatggaaaggatccagtatttgttttcaggcaaaagcaagcctccaaaagccccttggttcttctctgtgtgtctcgccccttctgccttgtacaccagactgccggcaagcaagcggggaggtggcgaacagctgggatcctccagtgaaaagtttgctcagcgcgagagatgtcaagaggctgggattgtcgcctatcgggaggtggggagctctctcactcacacttcctgggaaatgaaggagaactaataggcagcccgcatttgcagccagccagcctgggtggtattccttgaagtgaagcgctcataaatcccttctggggccagagccggtttcacaagctgcaggatttgggtggcctgcctgctctttgggagcgggcttgggaagctgaagaaattgaatcaggacctcaggccctttacagactcccttctacacttggttgctgattaagaacattatgtggcatttaaaatggcacaattatcttccgttggccgttcctagctaaaagtagactcctatcagcccgtgactgacgacaagaaggctcttcgtccctgtttttgaaataaacatgggtataatctgaaaaag

SEQ ID NO: 250339 - DNA, 217 bp, Homo sapiens
actccacccgctgcagtggcatggttgtgcctctgcactctgacagaagactggctatgcagctgtccagtgttgaacacagccttgcattgtaattgcttaaatgtctgtttctccaactgctctatgaccttgttaaagatgggaaccatgtcttagtttgcttacccctgacatagaggagcctcaataaataataaatcttaaaagtttaata

SEQ ID NO: 250340 - DNA, 195 bp, Homo sapiens
caagaaatggcatcttagtgtaattataatttgcatttctcttatgaattaagttgaatttgcaaaaatatgcttaaggcacatttttacacccattttcggtgaattgcttgttcgtgtatcttactcatttttctagaatgtctagtcccctttttcttcactcgatataaaaagtattttttaaatattaga

SEQ ID NO: 250341 - DNA, 298 bp, Homo sapiens
gcttgaaccagagaggcggaggttgcagtgagccaagatcacaccactgcactccagcctgggcgacagagtgagactccatcttaaaaaaaaacaaaaaacaaaaaaactctgttgcctacttgagaacatccaaacccctgtgctaagtcaaagcctttcaagccatctgctgccttctctcccaccccatcttttactgttccaaccagattctctactctggtctcactttggtaaagttctctcaacttttccttgttttactgtctttgctcacactgtcccctccatctat

SEQ ID NO: 250342 - DNA, 288 bp, Homo sapiens
atgagaaatttccctctagaattgtattttgatggaaactgatttcctgtattggataaataatggacaatatgtacgcaactttagctcaagaaacatcatcagatttcccccaacctgaggccttctctgcacatgccagaacatctgcaggaaaaaagtgcctggggcaggtacagggtcactgtgtctacacagtgctagagcatctgtatatttgaaaacattcagacaattaactctatttttcactttttgtcacatagacccagtttgagtttaacgaaa

SEQ ID NO: 250343 - DNA, 592 bp, Homo sapiens
cagaatgtaaggtttcatgatgttttgaattatacgtgtgtgcatgtctgtgtatacccacatatatttctggattatatatgtatacatgtaaatatatacaggcatattcagcaaaacatacttgaaaaaatacattaaagcattaaagtgttaggaagggctatgtctgaagtggaattaaaaatgatgtttcttctcttcttccttgcctttctcaaattatctaaagtgagcacattgtttttgtaaccaggggaaataaagatttgtttaaaaagccaagttaaaaaaatcaggccgggcacggtggctcacgcccataatcccagcactttgggaggccgaggcaggtggatcatgaggtcaggagatcgagaccatcctggctaacacggtgaaaccccatctctctaaaaatacacgcacacacacaaattagccgggcgtggtggcaggcgcctgtagttccagctactcgggaggctgaggcaggagaattgcttgaacccgggaggaggcggagcttgcagtgagccaagatcgtgccactgcaccccagcctgggtgacagagcaagactccgtctcaa

SEQ ID NO: 250344 - DNA, 633 bp, Homo sapiens
taattcaatgccacacagccagtacaaggcagaactttgtgattcaattccagatctctcttactccagagccagtaccccctaaagggcatagtcaaaagaagcaaatagaaagttgatagaagtgcagaataataagagtgaaaaatgtgatgacctttagcatagaaatggcttaaccttctggggatgaaaactagcagctgagctacacaaggtgcctctgtcaaacagctctgtcgaataatgcttttaaatgcgaccaatagatatacatgagccaaaacaaggaggcagctggtgctaatctgattcagtactttaataggggaaagcaccggagcaactattttatagtctttttatatatttatctgtaactaagtatatataaatgttatgaacatgaagagagaattgctgactcaccatcaagtgacatttcagtgaagactgtatatcaagtaggaaaagaaattacatgggtatattcactgatggagccagactgtgaccacccagagtaaggaccagaaccatattcttagtaattattcactctgaatgcacaaagaatttatttcttgaatttctgatcattttaatataatcataaaaatggcgattttgaaa

SEQ ID NO: 250345 - DNA, 424 bp, Homo sapiens
gaaattcctgtgactgcagtcatagtaataatctaaggagcccaaagtatgagttaaatatgaaagatccatttttttctttaatgagctgtaaattgaaggggagaagactgtgtagaataaatattctatataccttgtgacccagaatgtgaaaatgatgacagagccatttttctaactgggcaacctttggaattgtccaaaaatgtattaaaggtagctatttctttaggaaattcaattttatagaattcatcagtgtcttctaaggtatgtgaggctgatctgcagttattctaaaatgtttgactattatttttactaaatttcacggacaatgtaactttttttctcttgtggcttcttaaagggaagaacatctggaatttattaaatatgccaaggggcttctgagacttaa

SEQ ID NO: 250346 - DNA, 388 bp, Homo sapiens
gaaacccagccaccatgctgtgaggaagctcaagccacacagaagccatggagaggtgctccttctgataacccctgctaaagtcccacccagcagccagcaacaatcactagatatgtgagtgggaaagcctttgagatgacctcagtcccagcaccatctaaccacaaccagggaaggattctgagcaagaaccacatagctgatcccagttaatttccagaacagtgaaagataacaataaatgattgccattagaaatggttagtgtgaattagttcctgtaaaacttgatcactccttgaaccctggcaaaaaaaaattaaattaaaaattagctgcttgacttgtctgatttgactccaaaatgaataaacttcactcttat

SEQ ID NO: 250347 - DNA, 262 bp, Homo sapiens
tgcccacccttgaccttagcaacctcaaaggctggaacaagaagacactgtgcagtttttaactccacttggcaccacacatggctgagttctggctggaatcctgtctgaggccaaggggtaaatttgaaatgagtgttagtacttctctaagtcacatcacattcagttctttgaataacagtcatgaaatggtcatgggtcattttgctgaagattcttatcaaggattgataaaatataatttatatataaagctttt

SEQ ID NO: 250348 - DNA, 287 bp, Homo sapiens
agagccagccagtcaccaagtcctgcctcttcagcagccctatttactgcctcccatccttcctaggagggtcaggtctccacctgctgtcacctggaactctcaaaatctcgtaaaaacatttcctgcctccagattcacctccctccaatccaccagcctagtcctcaaactgttgccagagagatctttatttcaaaaatgtgcacttagtcaggttccattgctgttcaaaatccttcaacagctccctgacaatctgcagggtgaagtccaaacatcttaat

SEQ ID NO: 250349 - DNA, 3387 bp, Homo sapiens
  misc_feature (1)..(1): n is a, c, g, or t
  misc_feature (1034)..(1034): n is a, c, g, or t
  misc_feature (1051)..(1051): n is a, c, g, or t
  misc_feature (1425)..(1425): n is a, c, g, or t
  misc_feature (1780)..(1780): n is a, c, g, or t
ngatcaacaactgtcagctcccagtcagagagaaagggcctcttcagtctgtctcaggagactgggagaaacagcataaaggaccccacaaggaagggagaggtaccctgggtcaggcgcttgtggagagagggcttcgcatgtaaagtgacgtcagggaaaatagaacagaaaaaaagccagggccagcccagaggcacctgagaagaatcagacccacagctcagcccagccctggcacagagaagagacaggcctggcagcacccagggaccccctttcctcagcctccacctgcaggacagcaggagcactgatgcgctgaaggtacgttctggagtctggaagcagcagaactgaaggaagtaaacacgggtgtctgggaagacccctcaagctgcagtaaagcccaggactgaattggccacctgaggccaagggtggcactccaacctcctcctaaaggctggctagagccacaggaaagggccagaagccagagaaagggcaaaggtggacccctgcctccaaacctcctctggagactgacctcctctttcctgtgccttattgtttctccctcttctctttgttcgccactgggcggtgacctcagggatcctggcctaacctggtgattgtgcaggcaactgtgtccgagaagacccttctctggaagattgaaccccaattcagccatggtgactcctttgatgtcaaactggtaagggctgagccgtgggcacaggataccactccttccagctcttctgctgtgacctgcccatggaagtccctgtggacacgaaatcctgtttggatcatctaactggaggctctctgttcttcacctccacgcgccctcttgaccccaggaggttcaggggaggaagtacgccactctccactggcaccctccttggcctacacagagtcacccctgagcccctcaatgtgtgctgaggtgggccctgctctctgcaggggtatggagagaaatagcttggggtgctgtgaggccccgaagaagctgngcctgtccttctccatngaggcgatcctaaagaggcctgccaggaggagtgatatggacagaccagaagggccaggtgaagagggccccggagaagctgcggcctcaggctctgggctagaaaagcctccaaaggaccagccccaggaaggaaggaagagcaagcggagggttcgtaccaccttcaccactgagcagctgcatgagctggagaagatcttccactttacccactacccagacgttcacatccgcagccagctggcagccaggatcaacctcccagaagctcgggtgcagatctggttccagaatcagcgagccaagtggcggaagcaggagaagattggcaacctgggggctccacagcagctgagtgaagccagtgtggncctgcccacaaatctggatgtggctgggcccacgtggacatccactgctctgcgcaggctggctcctcccacgagctgttgtccatcggctcaagatcagctggcctctgcctggttccctgcctggatcaccctcctcccagcgcacccatgggaaacacagcctgtcccaggtcttcccatccatcaaacttgcatccctgtgctatgcatccttccacctccacaccccaaatggggcagcatctgtgctacttcaacatagagattggacatgctctccccaaatgagccactttcctctccaggtgaaggcaggtagcagatgtgccctgggcctctggggaaatcgatntcacaatccaaaaatggcccacagcccaggaagctaccctgaacatgccagttggaaggctgcaccagactcaaaagcaaactaaacaataaaggacagctctcttctctcctggctaaagctgctctcctggttcagaagacaggctggatgagatctcaggccgagctctgaaatagggaggtaatcctccagcacctgtgtttcctctaacttgctgtgtgacctccagccggtcactcaccctctctggacctcatctgtaagaggagccagctggataagatgatttctgaagacgcttccatggtgggcactgaggcacagaggaggccaaggagaggttgtttgttcatgcatgcattcatccgtgacacatgagtacctactgaggactccataaacagaacgggatacagagataaacaatttgggttctgtccacgtttgtcaaaaggtggtgctggcccacctctgaaagcagaacacttgctcaacaaccttgctgttggcccaagtctaacacattctttatgactgtgagcatctcagagtgagagaaaaatgtagaaagttttttaaattctaaacaggatttagtgtctttagttatcttgctggatgggaaagggatgttgtcatttctggcacaaatgaaaagtaggacggaaagctcctttcattcagtttatctttccaggatatatgaaaagggaccagctggaagactagcctcactctgtcctcgaaagcctgagctttcattcaactccctatttccatgcaaagacgctgggcaaaccacatgttctgtctgagcctcagttttcctatccataaaatgaaggtagccaggcctgcctcaaagagcattcaggaggctctgagaggacatgagagtattttgcaaagtgagggcaaggcccagtgtggagtgatattgttattccaagattccactgcaaaagtggctgctttggatgccagcccaggatgagtagttcctgttctcagggaggtcatccgctgagcatcccttctgcacagatgtctctgattcttgtccttgcaggtggaggacagggcctgctcccctaagctgggaagcctggaatgacctcttgcacaagcctaaattccaggaatcttccccaaatcccagatcctctgcaatctacctgcacccctgacccacccaggagttggaccgggagttgggaagcctaggtcttagtcctacactccttctaatttgctgtgtaaccttaccattaatctctctgggtctcagttttctcatctgtattggaggtagcagtgctagctctgccttcaggcatgcaatatgccagaactacagacaacagcccacaggatgcaaaagtgctttgccatcttaaaaatgccagatcactcagagcctatgaatgtggatatcaacaccaggtctctagcaccgctggatgaaaggagaaggctagaggctgagggaggaaagagcagttaacaaacaaaggcagtagctcatcacttgggtagcaggtacccattttaggaccctacactcaaatgtgcaaaataaaatttctatcattttgctataaaag

SEQ ID NO: 250350 - DNA, 614 bp, Homo sapiens
agcggagagagagagagagaggaggcgagggaagagcgagcgcggggctgctccgaagccagcagaacctcctcggacagcggccccagccgggccccagcagctcgcgtggtcggaggagaagcagctgccacagctgccgcccgagcccggcctcgcgcgccccttgccgccggctcgccggtgcctgtgcggccccaggacgccgctgcccgctcggcggccgggatgcagccggggcatggccgccggcccccagtcacctgccgcggggagcgctgagcccgttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgctgaagcgatgggccagg

SEQ ID NO: 250351 - DNA, 749 bp, Homo sapiens
agcggagagagagagagagaggaggcgagggaagagcgagcgcggggctgctccgaagccagcagaacctcctcggacagcggccccagccgggccccagcagctcgcgtggtcggaggagaagcagctgccacagctgccgcccgagcccggcctcgcgcgccccttgccgccggctcgccggtgcctgtgcggccccaggacgccgctgcccgctcggcggccgggatgcagccggggcatggccgccggcccccagtcacctgccgcggggagcgctgagcccgttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacaggtgtcctctcccggagaagctagccacaactctcccagcaccgcctctgtgctttctgtgctcgcccatcgtgaagccagcctatgcctccagtctcttctctaccaggagggagcagctaaaagctgagatttgttgcaatttacttttgtcccccacccatgccttcacagtgcccggcacttatttggtgtttaataaactgcccattaaatgc

SEQ ID NO: 250352 - DNA, 454 bp, Homo sapiens
  misc_feature (221)..(221): n is a, c, g, or t
tatgagtctaggtggcagtttctaattagggctgtgaccttgaccatgccccctaccttcctgggcctcaggaaatgaagatggaaccagctccactcataactgagcctggagacttcatgtttctagacttactgagattcttggatgacacatgccaattaatccagttaatctttttcttatcagcaagaggcaagaggaaagtgggggcacggggnaaggtgaaattatttatatcctcaattttatatgtttttctgggcaatgttttaagcactgcacataccatatatctgctagaggtgcccagcaatgtgagacaaaactcatagcaggcaatggaatgaagagccacctcctctgagctacaaaatcattgctatgctaaaaactataattctacgaggtctatgacttttttgtccttaatatgtgctaagtgttacccaaa

SEQ ID NO: 250353 - DNA, 220 bp, Homo sapiens
caccatttcttcaagaaactcctatgaccatttgtttcagattaagcattagtatcagagttactgtggtaccttaagattacccccaaattcaaaagctacacgaaaaaagaataattttggctctctctcaatagtaatgtaatccttaacagttcaaaattatccctagctatatgttactataaactatttttaagacggtttttaatgaataaga

SEQ ID NO: 250354 - DNA, 236 bp, Homo sapiens
gtcagccactgagttaaaagatcaagtccaagccattaaatgtaacatctaacagtctccatgacctggcctctttaatttgtaaccttccaccctttactttgaacttttctgccaagagcactgagcttcctttatgtttttgcccatagttgggagccccctatctggaatatgctcttacccctttgctggtctagctcctactctatttttattttttggaaacagtctcg

SEQ ID NO: 250355 - DNA, 383 bp, Homo sapiens
gggaaggcctccaaaaggaagtgactttaaaggaattaggcaggagattagggggatactagaggtagaggtgggggaaggaggaacaggtaccaacatacgcaaaggtctagaggtgagaaaggaactgaatacagtacaatctgactgaagattagactgtgaatagagggcagagatgaagttggataggtaggcagtgcccaaaccgtggaccccttacaagctaataattaaacatgtgtttgagcacctactatgtactaggtgctgttatgggccctggggttttgctagttatcaaataagaccaaaataagactaaataatccctgccctcttgaaacttatagtttagtggatattaagaagaagaaaaaaaa

SEQ ID NO: 250356 - DNA, 360 bp, Homo sapiens
cataaaaaggaatgaagtactaatacatgctacgacatggatgaaccttgaaaacatcatactaagtgaaagaaaccagatacaaaaggtcatatatgatcatatattgtatgattctatccagaatagacaaatatattgagatggaaagtggattcatggttgcctagtgctgcgaggagtggggaatggggaatgagtgcttaatgggtatgggtttcttggggtgatgaaatgttccggcactaagttgtggtaatgactgcatgactttgtactaaaactactaaattgtacactttaaatgggtgaattgtatggcatatgagttatttccaaataaagagtattatttaaaaa

SEQ ID NO: 250357 - DNA, 341 bp, Homo sapiens
gcctggatgaggggcatgacatggaggacatgccctgagtgagggtgtgtggtgagaaagcagctgaggacgggttctgtggacagctttatcacagatggaggagatgacagtgaaaggcctgcagcatggctggaggaaaggaaagcccgaaagaggtcggtctgggaagcaggagaatataggttcttcccttttgaagtattttaaacaagcccatcatgtttctattctgcccttttcctcataaaatcaacaagaggaattgcacagttgaaagacttaattgagcatagtttatttggcttggcaggcttctatgattttttttttctctcctg

SEQ ID NO: 250358 - DNA, 363 bp, Homo sapiens
ccagccatatttgcagtgcccagtagctgcatgtggccagcaaccctgatactggatggtgcagctctagaagattttcctccaagaaaggggggctttttcctccccacaggagccaggtccatctggtctggatgcctccaagctgcagaatgtgttctttgcctgagccaaagcctctctcccctgtgcctccccctccaccagccagcgctgccctctggggctctcccttccctggacagtctctgtcaggtgtggacacgattggggcatgtccccctggaattttctccaagtcaacccttgagtgttggtttctccccctggacacaggaggaagatccccaatgatttaataat

SEQ ID NO: 250359 - DNA, 416 bp, Homo sapiens
acctactttgcagtgtttgaggatgaaaggagctgagacagggtcctcgctctgctgtgcaggctgaagtgcagtgatgtggtcacggctcactgcagcatcaacctcttggactcaagcgatcctctcgtgttggctgcctgagtaactaggactacaggaaccgtgcgaatagttgaggcaagaacaacatttgacgttatcctttttgaactgctcctggccttaaactgtcccaaaatgtctcttctttggatggaatctccttgttctgcactcaaaatgaaacctgaaagagactacgaaacacactcaagcaactccagagctcttgagacaattacgtgattgtgctctgccttcaaaaagggtgatcccccgctgcaaaacaaggaaacaaaaccaaaaatcacaca

SEQ ID NO: 250360 - DNA, 192 bp, Homo sapiens
tgctaaaatatttacatggctacagtccccaacccccaaacatcagaatcaaagagagatttttctttctgaatgggaggtatgggaggagtgagtttatggcaggagttaggatagtgtgcagcataatgtgctcttcacttgtaggtgtctaaatgcacagctgtcactaatctggcataatgaaatagg

SEQ ID NO: 250361 - DNA, 348 bp, Homo sapiens
gtactattcattcaaggagttaataggtaaaccagtttatccatcactaacttgtttttatagcatcaacatggtgtaaagacaaaaacaatcttgaactctagtaactatcatctatatttaatgcctctatgctacaacagtaagactctggatgattatcagtaccacttagaattagagcttcttgttaaataattcatacatttgatggggaagagcttcaaacaatgctcaaagctccagtaattaatgggctaattacgagatgcttgtaaaatggcttaaacactgaaagttcagtgtaggtataattgttttagagttaaccctgtgtatttaaatgtc

SEQ ID NO: 250362 - DNA, 325 bp, Homo sapiens
tcacccaggctggagtgcagtggcgcgatctcgactcactgcaagctccgcctcccgggttcacgccattatcctgcctcagcctcccgagtagctgggactacaggcgtccgccaccacacccggctaattttttgtattttgagtagagatggggtttcaccgtgttagccaggatggtctctatctcctgacctcatgatccgcctgcctcagcctcccaaagtgctgggattacaggcgcgagccacagcgcccagccagaattgactcttaatgcttactgctagccttaaacagaagcaattcaccccaagaggcaggg

SEQ ID NO: 250363 - DNA, 521 bp, Homo sapiens
atgcagcttgtgcaaagactaaaacaccatcaggcagcttttccaaagcacagaaatggctggaatccacctgccccatgcccttaagagcactgaggtaggctggagcccagccttttctcttgtcctctctgcccaccactttctgggccctctgactgatgcctggatttttaaaattagtatttaaaatgttaatagttttttgcatataggtcatagacacttatctgaggttattcccacatagtttatatttttgtgttattacaaatgagcattccttgcccagtgtactttctcactggctatgaaagatatgcttttcatttttgttcatttatttcataccctgccactctcctgagctaatcatatcaggcagcctttaagctgatccctttggattcccagagatccaatcatcatgtacaagaaagataattatgcttctttttaaaatatatcttgcttgttttgtgttttattttttgtccagaacttctcaaatgtgactgcat

SEQ ID NO: 250364 - DNA, 485 bp, Homo sapiens
cacacttatttaaaccaaaaagtgtagagaacattacatgttcatcttaatacaagtgctgtttgttttagaagggttatcatttgaagtatagatctaagacattttagaaatattcatgtaaaaggatcaaaaattgctttgggggctgggcacggtggctcatgcctataatcccagcagttagatagagaggcctgggcgggaggaacacttcagcccaggagttggagaccaagctgggcaacatggtgaaactccgtctcccctgcccaacctcccccaccgccgcctccccgcccaaaaaaaagctgtgcgtggtagtgtgtgctcttgtggtcccagctgctcaggaggcttgaggcgggaggattgcttgaacccaggacccaggaagtcaagactgtagtgagccatcattgcaccacagcactccagcatggccgacgaagtgagaccctatctccaaaaatgaaaaaaaaaaa

SEQ ID NO: 250365 - DNA, 395 bp, Homo sapiens
cagggtctcactctatcacccaggctggagtgcagtggcgcaatctcagctcacagcaacctccacctcctgggttcaagcaatcctcccaccccagcctccccaataactgggacaacaggcatgcaccacccatgcccagctgatttttgtattttttggtagagacgggggtttcaccatgttgaccaggctggtctcaaactcctggcctcaagtgatctgcctgcctcggccttccagaatgctgggattacaggcgtgagtcaccatgcccggcctagattcagcatttctaactagctctgactgattggtgcacataccacactctgagtactcaggaattagtgaaacataacttccctcacctttcagatctctggagtctagca

SEQ ID NO: 250366 - DNA, 463 bp, Homo sapiens
tcatatttactgattttaatgccctttgaaatatatatgtaataatttaggtaactgcctagtgctggacatttctagaattcttacatgaactttgttgtatttatatttttccttctatagggtttccttaaagcagattattaaaaaagagattaatgggccaaagttcttacaaagataacgtgatttttgtttgtgtgttttttgatatgtatttccacattgctttccaattaaaacctgtagcaacaagtgtgggtctgtcagattcatcacatcttcatcagcttggggtgggtttttgttttgttttgttttgttttgctattttgcaaaatggtagaatcagtggagtttttatcttattattttttttaattcttattgatatcattatgttccatgtctcatagtgacgtgatcaagcatactttaaaataaaggcaaatactttgaagta

SEQ ID NO: 250367 - DNA, 436 bp, Homo sapiens
tacatattaatggatttctttttctttagaaagtatgtttctaaataattaaaacattagaatagctggagaagctaattttgtacgttttgtttttccttctccatctaagagagttatgtgaaaattagtataactaatactaaatagttataatggaatttatagaaacagatcactcattttctaagtataaaatattaggctacacgttaagagaacttaatccagaaaccatcagactttagggactcagaaattgtccaaaagattaaagggagttattagtgtaaagtgtccttaacctagaggccacagatgctgtgaaattattttgcagaatttttcaatgcatattcatttttctggaacaagaatctgtagttgttatcagacttgcaaagtgattcgtgaacatccccccttcaaaaaaaaa

SEQ ID NO: 250368 - DNA, 692 bp, Homo sapiens
  misc_feature (605)..(605): n is a, c, g, or t
  misc_feature (680)..(680): n is a, c, g, or t
catagtattaataccatcatgtatatataccatattttctttacccattcatctgttgatggacacttagcttgattccatatcttgactatcgtgaatactgctgcaatgaacaggagtgtagatacctcttcgatatacagattttatgtcctttggatatatacctagtaatgagattgctagatcagatgatagttctatttttaatattctgaggaacctctgtactgttttcccataatggctgcaccattttgcattcccaccaacaggtgggaagggtatcttgtggtttaatttgcatttctctgataattaatgatgttgagcatttcttcatataactgttggctagttgtatgtcttcttttgagaaatatctattcaggtcctttgcccaatttaatcaggttgtttccttactattgatttgtttgagttccttctatgttacggatattagcccttaccagatgtatggtttgcagatgtagcctcccattccatagattgtctactttgttaattgtttcctttgcttacagaagcttcttagcctcgtgccgaattcggcacgagcgcggtcgtaagggctgaggatntttggtccgcacgctcctgctcctgactcaccgctgttcgctctcgccgaggaacaagtcggtcaggaagcccgngcgccagcctgg

SEQ ID NO: 250369 - DNA, 372 bp, Homo sapiens
tggataagaggcataagtggtcagtgacaagttgtagcccagaaagtgtgaagggaatgggacagatataaaattggaagaaataacagctctgaatttttcaaaagtaaaaacgatatcaatctacaactttaagaatctccatatatcctaagcaaaataaattataagaaactcacacccagacattgcagcaaaacttcagacaacaatagacagagacaaaaatcttaaagcatcagaaaagaagcagttactttcaaaggaagaacagttagactgagaactgacttctcaatagtaacaaaggaagccagcgagcaatggaagggttttcaattaacactgaagtttgataaggcaaaaaacaaa

SEQ ID NO: 250370 - DNA, 581 bp, Homo sapiens
caatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaggaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatactacaccattatgtgtaagggattgagcatccacagattctggtatggtgtgggggcggtatcctagaaccaatcccccgcaagatagcaaggatgactgaactatggaagaatcaaagcagtgttacacagtatgcaattcctgtcttcaaaaaagttacctcatcaggtagatgagacttataatgaataaaatgaatcaatacagattt

SEQ ID NO: 250371 - DNA, 298 bp, Homo sapiens
tccgccctggacacaaagtaaacatgagctgcagaaggcagcaatcgggccctggccctggcctgggaaaggggtggcatcctgagaaacgccctggtctgcacggggtcacagcagccctgccttctgcaacaaggaaggaaagtgttgcctaaaagaacgcttagctttggtggtgggaaaggagcactacttaggcctagacccattttatttcccattgagaaaactgccttgatagaaaacgttttgtcttagtaaaccaaaagcaacctaaaaaaaaatcataaatcttagt

SEQ ID NO: 250372 - DNA, 358 bp, Homo sapiens
aggactccatctcactttgctgtgttgttctttttcccttttgcccaataaattcgtaacccctcacctttcaaagtgtccgcgtgcctaatctttccctgccatgtgaccagaacccggttttgtctacaacaccagcactttgggaggcgaagatgggctgattgcttgagctcaggggtttaagaacagcctgggcaacatagtgaaaccctagtctctaccaaaaatacgaaaattaaccaggcatgcctgttatcccagctgaggcacaagaatcccttgaacccaggaggcggaagctagtgagccgagattgcgccactgcaccccatcctgggagtgagacgctgtctca

SEQ ID NO: 250373 - DNA, 274 bp, Homo sapiens
taacatgctgaatgggttggctctcatagaaggtattcttgagtgggcagttttccttacaaaacatagtatactaagactgtggtattcagacagctcttcaatcttcaagggaactgtggaagtaaaccaggggtgacatggattatcaaatattgtggatcaggtgagctctaggcttctcaatgcaaggtaattaccctgcactttcatctattttataatattgcctttatttttttccatgaaagagtaaggtttggaaaaacaagaa

SEQ ID NO: 250374 - DNA, 169 bp, Homo sapiens
ctcggctcactgcaaccttgcctcccaggttcaagcgattccactgccccagctactcaagaggctgaagtgagagaatctcttgagcctgagaagcggaggttgtagtgagctgggatcataccactgcactgcaacatgggtgacagagtgagacctgattttggaa

SEQ ID NO: 250375 - DNA, 610 bp, Homo sapiens
aacattcaaatttaagattctagaaaatatttgctccatagctaaatataaaaatttgaaaattatgtgagccactgctcccagtgggtttggataatgaagaattggttgacttctgatgagtttattcatatctggtgagtttactcatattgaaattacactattattaatattacttggctccatgtttattgacacctgcatttaagatttcaagtgttttctgtcatttctcccagagatgtttagttttgttggaacttttgtttggttataccaataagttaatgactatgctttttaattcccttgtagatttcatagggaggatggtttacctaagtgacagttacagtaggacaatgaagttctgttgtgatttgtgatctcttctttaattttgtcactataaaaaccttttattttttattatagaagtacacctataatgttttaaaaaagaaaaatattgaaaagttagattcatcttcccatgccacttctaccctgctaaaagtttagctactcctaaggtctttcttagtgcacataaaacaacatacatatattgatctgtgtaatgccagtgtatattgtctctttgaat

SEQ ID NO: 250376 - DNA, 794 bp, Homo sapiens
agcagtggcaacccgcttgggccctcttccacactgtggaggttttgttcttttctctttgcagttaaatcttgctactgctcactctttgggtccacgctgcttttatgagctgtaacactcaccaggaagatctgcagcttcactcctgaagccagcgagaccatgagcccaccgggaggaacgaacaactgcagatatgccgccttaaaagctgtaacactcaccgggaaggtctgcagcttcactcctgagccagcgagaccacgaacccaccagaaggaagaaactccgaacacatccgaacgtcagaaggaacaaactccagacgcgccaccttaagacctgtaacactcaccgtgagggtccaaggcttcattcttgaagtcagtgagaccaagaaacaaccaattccggacacactttgatctgtgttcactgttttactaacgagattaagaatgttttcacatgtagattggtttatttaagtgaatcacttgactgtttccatttttatccatctttctgccttttttcctttttttacttgtatgagctcctgacctattatgaataataatctctattaaccatgtagcttgcaaatattttatccagaactgttgatcatattttatttatatcactgcattaaacctcaatttttttttcttgcgatggagtctcactatgtcacccaggctggggtgcggtggcgtgatctcggctcactgcaacctctgcctcacgggttcaagtgagtctcatgtttcggcctcccgagtagctgg

SEQ ID NO: 250377 - DNA, 820 bp, Homo sapiens
cgcagtggctcaagcctgtaatcccagcactttgggaggccaaggcaggtggatcgcctgcggtcaggagttcaagaccagcctggccaacatagtgaaaccttgtctctactaaaaatacaaaaaattagctgggcatgatggcaggcacctgcaatcccagttactcaggaagctgaggcaggagaatcgcctgaaccggagaggtggaggttgcagtgagccgagatcattgcactccagcctgggaaacaagagcaaaactatgtctcaaaaaacaaacaaaaagagttaattcattgactaaaacaattctgaaatcacaaagataattacgtatttgttcatctttgagatagcttctccctgggacctcagtgttctcataaaactcagacgttttgttagcattttctttgcttgctctccataataggtaggactcaccctgctctgaatcttactcagggtttaaaccacataaagctgttattaaagacccctctagaaatcagacaagaagaagcatcctaagctattttttttctgatcctgttctttttgtaactaaggtaaggaattgcaaaggtcaaaatctggagagcaaatgatgtcatggatgtcatgaagttgcatcaatacctgatgatgatttagcataacagtgcaacatattatgccaagaagcataatgatgagccaccaggatgttttactgcattaatttcatgactctttattagcaaattgatatgcaaagtagctctccaattttctaccacagagaagctgctggttcagatttacatctttagcaaag

SEQ ID NO: 250378 - DNA, 707 bp, Homo sapiens
tttttttttaatttttgtagagatggggtcccactatgttggccaggctggtcttcaatttctgggctcaagcgatcctcctgaaccggagaggtggaggttgcagtgagccgagatcattgcactccagcctgggaaacaagagcaaaactatgtctcaaaaaacaaacaaaaagagttaattcattgactaaaacaattctgaaatcacaaagataattacgtatttgttcatctttgagatagcttctccctgggacctcagtgttctcataaaactcagacgttttgttagcattttctttgcttgctctccataataggtaggactcaccctgctctgaatcttactcagggtttaaaccacataaagctgttattaaagacccctctagaaatcagacaagaagaagcatcctaagctattttttttctgatcctgttctttttgtaactaaggtaaggaattgcaaaggtcaaaatctggagagcaaatgatgtcatggatgtcatgaagttgcatcaatacctgatgatgatttagcataacagtgcaacatattatgccaagaagcataatgatgagccaccaggatgttttactgcattaatttcatgactctttattagcaaattgatatgcaaagtagctctccaattttctaccacagagaagctgctggttcagatttacatctttagcaaag

SEQ ID NO: 250379 - DNA, 858 bp, Homo sapiens
gtgattctcctatctcagcctcccaagtagctgggattacaggcacacgccaccatgcccagataatttttgtatttctggtagaaatggggtttcaccgtgttggccaggctagtcttgaactcctgacctcaggtgatctgcctgctttggcctcccaaaatgtttgagaagttaggggacttgttctttcagcatctatttaatgaatctgcttgtatttttgatatcctaatgtgtcccaacactgaactcctaatctttcctctaaaacctgttccacctgcagccctctctatttcacttgatggcagttttatccttctcgttattcaggataaaaacctgagactcattcttgtttttcctctttctcttatatcccacatctaatccttaaggaaattatactggcaccacttgtgaaaatatatcctgaaatctgatcacttataccatctaaatcgctaaagtcatctgtacccccacctctcttttgtgccaccatcatcctttgcctagatttttgcagtagcttcttagttactttctttccacctttgctgccttcaatatcttgtcagcacaacagattggcggacattttaaaaacgtaagtcagataatgacactctaataaaaatgagaaaggtttaaaaatagtaaagataggaagcctggacaacatggtgaaacaccatctctacaaaactagctgagtgtggtggtgcatgcttgtggtcagctactcaggaggctgaggcaggaagattgattgaacctggaaggttgaggctgcagtgagctgtgattgtatcacttcactccagcccccgtgactgattgaaaccctgtctc

SEQ ID NO: 250380 - DNA, 341 bp, Homo sapiens
cccctcagagtcattcatgagagttggaatcaacttcttccaaactcctgttaatattgatattttgacctcctcccatgaaacgtgaatgttctggatggcatctagaatggtgactactttttgaacattttcaatttattttgcccggatcaatcagagaagttgttatcagtggtgggtttccaagttgtcaggggcgaaccatacagatcttcagcaacctcaactcttgccttctcagaggaaagaattctacggagggacataaggcagaaaaagagactgaggcaagttttagagcaggagtgaaagtttattattaaaaagctttagagtgg

SEQ ID NO: 250381 - DNA, 2127 bp, Homo sapiens
atccccacccacccggctcccaggatcctcattaggaagccctcaggagccctggggtgggtctccttgccctgtgaacgctccatttgtgttattgaatccaacataaatgcagcattgtcttcagaggtgagcaatggccgtggccggaggtgcgcatgggatgcaggcggcgtgtgctgctgttgattttctctgctctgctcttagcttactttagcagatagtggagtttcacgtggcagtccggtaaaccaaggcagtgtgaacatcccttccccacaatgagtgaaaatgcaggaggtgccgtagcgagaacagcgacagcattctgcgcattggtgagcccgactccccagcctcggtgcccaccgaagccccctctggctgcactgtgccagtgagtccaggctccttctcagcagaaggtggctgctctgcagggcccctcgcctccctgctcctcaggggacccgcactcttccatgtccgtagggagacgcgcaccgagctggagacacagatctgcgaggagtaacttgcctctctcaccagcactgccaggggcggatcagcgccagcaccttccagcatgcgctaaactgctggagaagctggagtggctggaaggagccctgcctgcctgccctcctcctcctcagttgctggccttggcagctctagggtgacccagcaggggcctggaggagtaggaagcagcttcccagctgcagtctgcatcatcctctctgtgctgtcacagaatggaaggttttagcagaaaaaggagtttgtaagcgacattcagaagatttgggcagcagtttcttcccccatagggtcctgtcttttgggagtggggagtgctgggccaggctgctcgctggctgtttcacaggtggtggaatttaagagcagacttgggtcgagctgtgaccgttcaggtgatgcacgcacaggaggttcagctgtgtgcctgtgaggcaggcaggagcgtcacccaagcttcagaagagaattccccggcagcagcgtggcgctcagcatgttccgtgtctgactgttttgattgtctctcagtccagttgacaaattccttttaagatgaaatttgaattaatttgcagaacttgtacaaatctccaagaaaacagcttaaggaacagattaaagaatgaatgccttaggaattaaagcattaatagctcttgagtagactggatggaaagatgagttgtgtaggttatccagatgaggctacatccagggagcaattcttaccttcagagggcgctgcctgtcctccttggcatccaagtgagcgcatctcctccacgctcaatgatgaatgctggccggcatccctgtgaggaaccttgtgatcattttccatttctgaaaactcccaggtggtgggggcccttggcccacatcagcattgaccaccccgggctcagatctggccaggtgcctgcgttgtgatgggaatttcagtacactgaattttgcctctgaccctgatgaaatagcttcggtggcatttgcatcaagatcatgttagtgtcatctctattagatgctttggagcaaacatgaacttgggtttccttttaagatgtcctgtgattccagattcaggggaatctgagaaaagtttgaagaaagaaaattccactcggccagccaaccttgggtgtgcagagcctgccccgccttccccactttgtcctgagaagctgggtcctccccagcaccagagttgctgctgcttcccctcgcgctcttggctgctctcccggccccaagcctgagtgacactctaggattgcagatggcaggctggtctctgggctcccccgtccccatgaccctccacctgcacccagacctctgggtccttgctcaggcagcccctgccctcggtgagacgcagcccactgtgggcccttcccctgggcctgccatcagctcctgtgctcctcggcgccccagcggctgccctgggcccgttcccacagcacctggcacacagcaggagccatgaatgttctttgggaactgaatgaggagtggaaatgcgggcatgtcatgtttttgaagttaataaaaaaaatcccttaaaagttg

SEQ ID NO: 250382 - DNA, 263 bp, Homo sapiens
agtctacagcatcttctgtactcctaatccacccttcatcatttaccaaggcaccgccagtcccagtcaattcttcatttgccctgccccgctccactgatgttgccgaaaaggatacccgctaaagtaaatgggccacctccagatgaatcttcctcgctgtccgagtctgacatgatggcggcagtgacggtagctgctgccctcagcagcaaatcgcagccgggtcgcataaaccggaaataaaacaacagtcgcccgga

SEQ ID NO: 250383 - DNA, 482 bp, Homo sapiens
atttctaactgggttgactggtgaaggtcttcccctgtgtgaagccactttataaagattggaagagacatttgctttttcaaatgcaaaaaatgtaacaaataagacacataaagaaacagggaaacatgacccaatcggaggcccaaaatagatcttcagaaactggctctgaaaaaatgaaaatctattaatatgaattacttgacaaagaattcaaagtaatcattacaaagctcaatgtgctgtaagaaaacattaaaataaacaactaaatgaaatcaggaaaatgatgcataaacaaaatgagaaaaccaacaaaggaatagaaagtatgaaaaggaaatagaaaatctggaaccaaagaatataaaaactgaaccaaaaaattcactggagaggttcaacagcagattttatcaagcagaagaaggaatcaggaaacttgaagtcaggtcatttgaattttttgagtcagagta

SEQ ID NO: 250384 - DNA, 454 bp, Homo sapiens
ctaaactattaactgtattacaagatctctgagattttggtttggtagcttccaggggcgtcttacgtagtgatgctgtttaggggcatctagagatcaggaacaacacttgttctgctgatacagatttgggaatgaaatctgaaaaggcatgaaatagactggtagaagggaaaaaatgttaagaaaagagcattcatattttattctaggtaacagcttgataagttgatacagagggaggagaataataaaaagaacacaagcaaatatttagagaagtatcagtgaattataaggtttttatgtgatttttctagggtctttgttgatttgtcaaagaaaatcaagaaaaatagcatacactttcttctttaaaccccttttgtgtatatgcttttgtgtctgtgtgtataaaatatgtttataaatacattaaactatttttactaat

SEQ ID NO: 250385 - DNA, 488 bp, Homo sapiens
tcaggaatatagaaacccaaaagagatcgtagaagtgacaagagtaacggcaataatgtgttagtggagaagatgctatcagagcaaaaacaataagtggaaactaatcaaaacaattggtcattttaatgtactcatatcatatgtcttaagtaactggtaaatcatgaaatttgcttatttcacttaaattattttgcctgaattttattatgtaattgttattgcttatttaggatgcagcataatataatagattatattgtttgaattattaaatatcaagatcagagaaaattgaataaatcatttctacaagagatgcgaggaatgaatacccagaaaaagtatccaatgcatttttataagtatacgtaaaaaccgcattacatgtattgatagtgttatatagtctgacatgctttgtctagaaaacaattagtatagtatggattcttaccacttaaaaattactctgtactttgctt

SEQ ID NO: 250386 - DNA, 545 bp, Homo sapiens
ctatacagtttgtggcgtcattcaaggttggacagatcacacctcaggaagtcatccctgtaagcacactagaatttatcataaaggcaggtcagtttgtctctttgtacctctgtatttttgtaagtaaaatgggagataatattttgccttgaaagaattttaagaaaataaatcaagcatagtgatttgaaggtacttagctttctgaagatgggtatgttaatttttcctacctatataccagagctataaaggaaaagcttaaggtcctcaaaacataagaattatcaaattatgaattgatggatatgttatatcaatttcttcactacttccacaaacattgctgtatttgtggtatgtgccagacactgtgataggacattctgtttggtgctagggatatataagaaatggtcaagacacattccctggctcctggggcttacgaattcctaaagaaaataggtttggaatttttttaaggcctcattttcaccaagcatatccccagttacagaaatgcagcaaccatactgatt

SEQ ID NO: 250387 - DNA, 231 bp, Homo sapiens
tccgcggatgctcgccctctccgcgctaactagggcaactggaaaagaggcggagagaagtcgctgctgcagcgatttcccccggcggggagcagcccccagctggtgcccgtgacagctgcgacctccgccccctccagccgcgccgggccgcgaggggaactcggggaagtgggaggaggatggagcgggagaaaggagagcagggggcggaggggcgccagctgctcc

SEQ ID NO: 250388 - DNA, 520 bp, Homo sapiens
aagtttcatttggatattttgaggaatatggtaaacatattcaaaaatgtttatgaaagaataaaggtcctaaatagctaagtcatccttgaataaagaggagtaaatgtgggaggtgtgggtggggttggcccttcctacctgatattagtacatcttacaaaaccatggaaataaaatcagtattgtattggcacaagaatagaaagtgagtcaacctaataaagagctcaggaacagacccatgaatatttggggacttaatatacagtaaagtagcacaaatcaaagaggatggacagactgtgtagtagacggtgttgggaaaactgtctcactttatggagaaaaatacttgatctctacttaataccgtatagagaagtgagtgtcacaggactaaagacctaaatgtaaaaatgtaaagctataaaattgaatataacaaaatacaaaatattgctgtgacctagaggcaggaggagacatcagaagctcaaaccaaaaggcaaaaaaaaaa

SEQ ID NO: 250389 - DNA, 436 bp, Homo sapiens
cgccttacttcctcataccagcagccgtggagtggatcttcaacaagcagccaacagcagccagggacagatcctcgggcactgtttttctgtccgaaaaatcagaatcgtatcaaagggtcggacacctggactggcaagacacgttggggttatttataacaggggaaaatgaggtctccagggaaacaaaccgtaataaagaatatgaactcccgcagaccgaattgccttcaacgatcctcaaagacttttgtgtttgaccaatatcaattaattacatcagtaaataactgcctgagccttgtacttctgtcctcccaagatccggaatgacttctgctttcaaaatgaatttcagggctttctttgaagcagtcttgtaaagttgttatatttagtttaaattcaattaaagctcaatctgaaagctctt

SEQ ID NO: 250390 - DNA, 511 bp, Homo sapiens
tctccagtttcattcatctgtcagcacatttcttctctcccatattattccttttttgagagactcctttctgctttttagcttaaattactcttctatatatatattacatcattgcagaaatccaacagattgacattcatttaaagtattcccaataccttcataaaaatgacaggaggcccgttaactttactgaagtctcagttgtggtttttactttgaccaattattttgttttacactggggttgaatagctgtggcctaaccttgggctttttgagaaatgaatgctgtcattcatttgggtgacttgggcaaccttggaaatacatctgagcacctgttggctcatgtgggctgtgggtcaggaatgtgatcttcttgctgagggtcttatgaggccaagtaaaatgtctcaagaccccctggcccttcctgtcttgtagggttttttgtgttatagttgtactttcctctacttctccccttccttgtactatccctata

SEQ ID NO: 250391 - DNA, 377 bp, Homo sapiens
ccaggctgtgagcgggaccgcctgtccttcgggttctgtgagacactgcgcctactgggccgctgccagctgcccaccgtccgcacccagtgctgccgctcgtgctctccgcccagccacggcgccccctcccgaggccatcagcgggtcacccgccactgacagtgccaggatgcacagaccgaccgacagacctcagtgcccaccacgggctgtggcggagctcccgacccctacgccctaatggtgctaaccccctctcactacccagcggcaggctggggagctcctccccctcgaaaaaggtatttttttattctaacagtttgtgtaacatttattatgattttacataaatgagcatctaccattctaaa

SEQ ID NO: 250392 - DNA, 302 bp, Homo sapiens
agcaaaggaattgaatagacatttctccaaagaagacagacaaatggccaataggcatatgaaaagatgcaacatcactaatcattagggacacactgttacaacttgctactggagaaatgaagcctgtggtgtgcagccccactgggagaggattctggaagcttctgcctggtttcctttggacttcaccctatgtgccttttctctttgctgattttgctctgctatgagtgcaaccataggccgggtcctcctaaccaatcagttacataaaatacgctatttaaattttcaactgt

SEQ ID NO: 250393 - DNA, 386 bp, Homo sapiens
gggaaacattacctcatccttcaaggttgctcactgcagacacaaccctgagaagcggcccaggtaaggagtttaggtcaaagccttgcttttttggtatatacagcaagacatattgaaggactgtctttttgcagcccatatggatcagcattccagggagaccagggtgaagaccagtagaggtgggtttggattggcagatggaagattctggcattctgggtccatagcgttaaattcttatttggattacagccgaatcagcagttctggcctgtgatcagggtgcaatattcttattgttctttctcccatattttcttaatcagaaggaaggacctacttccacaggacaataaagagttttgactccaaaaaaaaaa

SEQ ID NO: 250394 - DNA, 546 bp, Homo sapiens
gggtttctcttttgcacctgtaacagagcacaggacacagaaagaactacccagggtggcagctggagcaagctgagtttcctattttttgttattaacaatggctaatatttatcgagtgcttactcagtgccagccatcatggtaaaaacgttagatagatgttttcttttggtatatcccagttgttttaaagcttcctttttatttgtaagtttccagagttttatgcccttcatagctttgagaaatatgccttctatgatccatatagggcattccttaaattgtggaacaaaataaattaaaaggcctgccccaaaattgacatctaaggtgacattgctccctttatatggtttatcaagatgattttcagccccaaggaggtgaaaaactgctgaattgtattctttaaataattttttcttctgcttttttcacttaagagaaatctcttgaaactcatttaacagttgtatacgggaagaataacccctataggttcttattggaatgaccccttattttcagattaaccaaaaa

SEQ ID NO: 250395 - DNA, 443 bp, Homo sapiens
atccctttctggcactgttgccctgagacaagcagtatgcccgtctgcttcctgccagcctgtcccctggggcctcagcaccactgggccagaggcttaggaccccctcctgggagcccccattgcagagggcaggctggggccagggcctgggatggcaagtgcagtggtgagagaccctgcaaaggccgccaggtctgtgagtgcctggacggatgcaaaaggggcacccggcgaggcagggcctgcaaacatgggcttccacaaggttttcatcagccttaagataaatacactaatgacattcaggacattgttacagctcagaaatggaatccatcactgtcctttgcccttgataattaattccagcatcaatgatctgagagctactggtagtcatttttaaatcatcatctcataaaaagaattttctcagcaaa

SEQ ID NO: 250396 - DNA, 348 bp, Homo sapiens
atggtatttttactgtacattttctctatttagatgtgtttagatacagaaatactcaccattgtgttacaatcacctactgtgttcagtgcagtaacatgttgtgggtttgtagcccaggagcaataggccacactatacagcccaggtgtgtggtgtgtgacaccatctaggtttgggtaaatccagtctatgacgttcacacaaccacaaaatcgcctaaggacacacttctcagaaagtgtctcctcatagttaagcaatgcatgatgaattttgtgcaaaacatttgttttcgttttgatcagtaactcagagattgaaacaaaattatgaactgaacccata

SEQ ID NO: 250397 - DNA, 588 bp, Homo sapiens
acatactctaatttggagattacaacacaaattgaaagcactttctcaaatattgtcctaactgcttaaatatttatatataaattagttttctgatgtaaaaatgtttgcagtaagaaggaggaaacccagaagttacaaaggaaaagacagagttgtctatatgaaaaatttaaacatttgtgacaaaagctatcatagttttaaaaggcccgtatgaatattttccgtttattattttaacattaatatagaaaatgttgcaaatttgtaaaaagaacagccaaatagaaaaatgggcaaagaatataaagcaacatggggactaatgaatatcagtttattaatttttaagagattaaaatagcaatggcataatttttcctccatcagattgcaaagatgaataatgtccagcattttggacattctcatgcagagctgataggagtgtaaattgcaactcttctgacaatatgtcttcaaattagaaacatgtatatcctttaacccaagaatcttcttgaaatttattctaatgacataatttagactgggcagagtgggcaaagatatgtgtaaaagact

SEQ ID NO: 250398 - DNA, 317 bp, Homo sapiens
aagaaaaagtcaggcagtcctgatgagtggggacctcctgctgctgcaatctgttgatggaaggtttttgaaacagaggagcctgctctctggcaaccaggatggacaaatgagctgggacctgcgcccctctgccctaatcaactcgccccatgtccagctcagctgcagaatgggcatgaactcctgaagacagcaggaaaaggagtacgcccttgtgtggctgccaagcaggggaatttcacagcaaatattcactaaggaacttatttttctgtttcacaaatgactaatactcagagaagttatactatgtg

SEQ ID NO: 250399 - DNA, 289 bp, Homo sapiens
tcccctccccttccccctccccctcctccttctcctgctgggagttagctggagaaccaacaggcagcattacagaaagctataggccccttcagctggttgagggggctcagctggccccatggctagggcatttgtgtcctgtttcctgccgtgcaggaggggcactgtgaggtcctcccgcgtctcaccccaaccacatacacacctgtaaacaatggagcagtccagtctccagccctacctagaggagcgatttgttctctgatttccataacacagaaaaaat

SEQ ID NO: 250400 - DNA, 515 bp, Homo sapiens
cattaaaaaaaaatcacagataagtacttaaaacactcaagatttgggatttagatcatgattagatacaatagaaagatcctggaatcccgacatgaggacaaaaatggtactgaattctttttgaaaaatagattactgaaaagcgatctaatatagaacagttgcttttacttagatgttcaatgcatatttgttgtataataaccaagttattacagttcagataaagggtccaaagtgttttcgttatgatataatactttctattgtaaactggactaaagaaacgttgtatgttcaaggaagtgttgagcagccatggtgttcctgggacaggctccccaggtgctgagagaggtgctgcaggagtcacagacctgcaggcacgcacttgccagtgactgggacgttggctggtggttctcttttggtgtgattagagctatgtgagttgtctcaatacttgagactgtcggtggttgccaatgctgaataaagcatttatcaaagta

SEQ ID NO: 250401 - DNA, 621 bp, Homo sapiens
gaggattgcctgagcccaggagttcgagtccagcttgtgcaacatagtgagatgctgtctctacaaaaaatttaaaaattagctggtgtcctctcagtgtgtcttgtcctctccatgtttctaaaataaaggaagaaaggcccagcgcagtggcgtacacctatagtctcagcactttgggaggccaaggtgggcagatcacttgaggtcaggagttcgagaccagcctggctaacatggcaaaaccttgtttctactggaaatacaaaaattagctaggcgtggtggtgcacgcctgtaatcccagctacttgggaggctgagggaggagaaccgcttgagcctgggaggcagaggctgcagtgagccaagatcacacactgcactccagcctgggtgacagagcgagactccatctcaaataaataaataaataaataaaaataaatacataaatacataaaataaaagaagaaaaaaaattagccagccgtggtagggcacacctgtaattccagcttcttgggaggtagaagacttgagcccaggaggctgaggctgcagtgagcagtgttcacgccacggcactccaacctgaacaacagagtgagaccctgtctc

SEQ ID NO: 250402 - DNA, 454 bp, Homo sapiens
gtaaatttgacaacttagatgaaatggaaaattttttgaaagacacaaaacacctaaactcactcaggaagaacaggcactatgaatagccttctatttaaaaaatgactttgtggctaaaaacctttctacaaatataacttcagggtcagatgactttattggtaaattctacaaaatattttaagcagaaataataccaattttatacaaactgttccagaaaattgaaaaggaagaaatatttcccttttcattttagctatgtttattactagcattaccctgataataaaaaaggaaaaagatgttatgagaaaactacagagcagtatcccttataaacatctatgctaaaattgtagcaaatcaaatctaacaatatagaaataggaggatacacccacgatcaagtggggtttatcccagcaaggcaaagtcggcttaacatttg

SEQ ID NO: 250403 - DNA, 407 bp, Homo sapiens
tgtgtggtaggctgagacctctgactcttgctcccaataagctcatgaggttatggctccacgggggaaggggctggaattcggaagaaatggacaatccagttatcctcaagccctgattgccttcatgctggccacacctacagggacaaaggatggaaggaggaagggatgacttctgatttaaaaatggggcccatggctgggcgccgtggctcacacctgtaatcccagcattttgggaggctgaggtgggaggattgcttgagcccaggagtttgaggccagccagagcaagacagtgagaagtgagatcctgtctatacaaaaaaaaaaaaagagggccagggagggtaaggagactgacacaagaaggttagtcaacaaaacaggtagaagtgaggtgt

SEQ ID NO: 250404 - DNA, 976 bp, Homo sapiens
tgcagatatttttcacagtttttcatttgcgttttgactttgtttatggtctattttttcatcagaaattaaatgttttaaatgttttgttgtgaaatttatcagtcttttcagagtctaggttttgtgtcataagaaaggcctttcctattttattattatttctaattcaaattaaatattcttgtgttttctccaggtacttctgtaattttatttttaagttaaatgcacttacccacacaaaatgtaagttaaataaagtgtcgaggtgggaatccaactatacttttcttccagatggctgcccagttatggcagtgtccttcatttagttcagctttgccctgctgattgaaatgttgtctataggtgtacttagttcctacagtttgaggttattactggacttttattctgtttcattgatcagattacctatttatacctaatgactctattccttggttatcatcttccctcattctacttcccagagttttcctgggaagttttctttgtttatttttctatatggcttagaattagctaaccaagtcctgctcctctgtcctgttggcatttttattggtattgtattatatttatagattaatttagagataattgacatcgttttgaggttcaaaaacagggtctatattcatttctttatgttcaagaccagtatatgtggccaggcatgggggctcacgcctttaatcccaacactttgggatgctgaggcaggcggatcacttgaggccaggagcttgagaccagtctgaccaacatggggaaaccccatctctgctaaaaatataaaacttagccgttcttggtggcaggtgcctgtaatcccagctactcgggaggctgaggcaggagaattgttgaacctgggaggcagaggttgcagtgagccaagattgtgccactgcactccagcctgggtgactgaacaagactctgtctc

SEQ ID NO: 250405 - DNA, 423 bp, Homo sapiens
actataggattaaaaaattgcgttatccgataatcatagatgctcttattcaccttcccagtatttcaaacatgaataatttttagagcctgtaatgtgaatatggacagatagtaccactgctctgctattctattttgcattttaacttgttccatttctttgcactaggattaaaaacttgtttgagtttactcaacaaaattcatttgcctaaaaatgaattttattagatcattttcctgtttaaaaatttggtctgggggaggtgctggaggtggactaatacaagattatctttgtttttgcgtttagttgtacaatttaaatataaaagaaagcaagccaaggcaggaggatctctagaggccaggagtttgagaccagcatgggcaacatagcaagacctcgtctctcaaaaaa

SEQ ID NO: 250406 - DNA, 380 bp, Homo sapiens
caaaaagcacatggttgtacctggtgaatcacagattctgagtttacttcatttccaaaggtggaagaatgcagccatccctaaatcggatctgatatcttagtggcctactgtttcattttttttgagcatctattatgaggcagaagctatgagaaaggtcagcaaaatacagctcctgacttcaagacctcagacatggtactcacaagtatcctcagaatatgggacagctgtacttattatttcgctagcttcctaaaaacctctttgcttgaaagatcctgaagcagcatttgcagtcattagtttgctgtcttgtgtgtgcgtatgacttgtaagagtgaggatggatatctcatatcacatggcacagaagc

SEQ ID NO: 250407 - DNA, 648 bp, Homo sapiens
tcctcctaacagttgcaattagacaaggtagtcagcctcaaagatgatttttcattttatctagttacttctttaaaaccttacttcaaaagggagaagcccttcgaaagggaactcctgttccatttcaacagtgtggtttgcagtgctttcatagctgtgtcgtcttggtcattctcaaagatccttttaagccacaattaattgccagagattcttcaagttaacatttttctaatttatcatgcttctcttcaccccagggtcccctcaaaactgtaagctttatcaagctcttttcaatttcctttttaactgccagacaggcagtttgctttttcgtttgggggagtcaaaagaggttacatgctgccctagaagaatttaaaaaacaaaaacccatgtggcaattataagacttcaatttcaatagaaaatgttcatttccagtgaaaccatttttattttaatttgcatttaatttctatgtctgtggtatctctaaatacatgtgacttttggccccacacaaatttatttttgtaagagttcatcttgtttgggccattaatgaaaccaaagggtagttgacaaaagataaattttagatgtttcttggttggtgtgaccagtcaaacatttccatga

SEQ ID NO: 250408 - DNA, 290 bp, Homo sapiens
acaagtttattctcagtgttcagtatttgaggcaagtagctctcagttctttcttccttactacatactgaattgtcattttttctggggaccttaaaagaattcaagaatttaattctccctgaggaacttggaggatggtatcaactaaaagtattctcttttctaccactgaggaatactggaactgggagcaaactgtggacctgtgatagaactgaagtggatatttaccatacaatatctcatgcaaacgcttaactcttaaataaattaaaagtgcttgaact

SEQ ID NO: 250409 - DNA, 436 bp, Homo sapiens
actgagacatgcttagactgcaagagcttgcaaatttatcaaaacaaaacaaaatattgtgttggttcaatataacctcacttcagagatatctgacacacagcccttaggcctaggaccactactactggttggtgtctttcatgagcctagaaatagttaagtatctttaaataaaagaaatcccctccactcatgggactgggcacatgctcacagttccacctgtgcaggcaagaggcagcttcctgcagagaaaatctttcaacttctctgacaaatgaatgctcagggctctccactcagcatagcctatggtttgtcagactatcccaatcttattactattggattactactgggggttacctagatgacagacagccccttcgttgtatttctatatgcaaaataaataaattccaagtcagcagtg

SEQ ID NO: 250410 - DNA, 540 bp, Homo sapiens
acagtataaagtaaaactgagttcatgtagtaatgtgtggagacacgaacaaaattggactaaaattttttattgattgctttctaattatggtagaaatacattttaggtttccatttatggagaaagaaaaaaatggcagagggtagaagagtgatgtggaagaaaaaatagaaaatataacttgatacttttggttgaaagaaaaagatgattgaggcaattggccacacctgctctgtctgactactcttgactcctttggcttcttagtgttttcaccatcctaaccactgctggccagtcccgtcacagctgccctctgcttcctgctgcgctatatgtttggccactctcatgttcacatgaatggtacaagacattaactcatgaagtcaaaggatactcatcaggtggcgaacagctgcacacataatgcacagctccacagtgacatataacagtgtgttcaaatacttcagaaagacccttgccacttcgatgacaccaatcaaggacctgatcaatggccaccatttc

SEQ ID NO: 250411 - DNA, 531 bp, Homo sapiens
gtcccaatgagtacaccagtaatcttagcctcagaggtgtgcatctactcacagaagggctcagtggcttccagtgttcaaggttactggattgcacaggagctgttataggacaagccccgtggatactggtggctcagaggtcttacagatgaggtttcactgggaaccaatcagaactcccttatttgcaagtaacagacaccaaactcgaatggacttgtgagaatatgttggctcatgtaattgaaaaagccacttggggctgggcgcagtggttcacacctgtaatcccagcactttgggaggccaaggtggggcagatcacgtgaggtcaggagtgcaagaccagcctggccaacatggtgaaaccctgtctttactaaaaatacaaaaattagtcgggtgtgttggtgcgcgcctgtaatcccagctacacgggaggctgaggcagtagaatcacttgaacccgggaggcagaggttgtagtgagctgagatcgtgccattgcactccagcctgggtgacaga

SEQ ID NO: 250412 - DNA, 466 bp, Homo sapiens
ttttagattgttataagtgtttccaaggaaataaacatggtgaaacactaggaaataacagggaagtgaagagaaaaaacttgaaaaagaacattcaaggtgatactgaagtaggactgcagagaatgacaaagactatgaaggccacaggaaaatggaacagcattccaaagcaggggtaaaaggccagggagcagatattttaggcttgtggaccctctgtctctattctaacgactcaactctgcagttgttgcttgaaagtagttacagacaatacacaaatgaatgggtgtggctgtgtttgaagaaaaccttatttacaaaacaggtggtggtccacaggccatagttttctgaccctgttcttaagaaataacagtcctaaagagtgctgaaagaaaagaaaattgtcatttactgctatggtgaagtaaagaaaataaataggataatagtcgaaaga

SEQ ID NO: 250413 - DNA, 482 bp, Homo sapiens
ctaaaaagcaaagaagaaacttttctgtattaaaaataacaaacattagtaaatgtatatatacagtcatgtgttgcttaatgatggggatacattctgagaaatgtgtcttgggtgatttcatcgtgacgtgaacatcatagagtacactgacacaaacctagatggtatagcctattacacacctaggctatatggtacagcctgttgctcctaagctacgcacctgtgcaacacatcactgtgctgagtactgtacacagttgtaacacagtggtaagtattcgtgtatctgaacagaaaagtacagtaaaaatataggatcataattttatgggaccactatcatatatgcagtcactgaccaaaacatcacacagcacatgacttgtgtgtatggatatctcaattgtaaacaatttcacaaatgttcattatctctttttaagtaagttaataagtaaaactattactaagctgca

SEQ ID NO: 250414 - DNA, 457 bp, Homo sapiens
caacttagcataattttttgtccatggtaggagtataataaacatttgtgaaataaccattcataaattagacattgagggaaagaacttacgaagcatgtgattaatattatcaaaagaacaaatagcagaaaaatcattggtctagtatttaatgatctataaaatgctttcatgtctttttttgctcaacaatattgagcagtaggcaaaatagatgttctctttttataaatgatagtttctaagcagcccaataatttggccaaggtagtaaatgagagggtgaggaccagaaggcacttgtctcaagtctagcgcactccatggcagcttccctttgaactttgtgtgactgaccagaagaaattgcttgaacccaggaggcagaggttgcggtgggctgagatcgcgccatcacactctagcctgggcaacaagagcaaaactccgtttc

SEQ ID NO: 250415 - DNA, 448 bp, Homo sapiens
cagatggaaaaacttcccgtgtgtgtttgtctatgttggtgtctctggctgtgtccacatgtctgtctgtgcatcactggtcagtgtctctgtggatgtgtctatttcgagggcggcggcagggtgatgtgtaagttatgcttccatgtgcaagtgggtgtatatggtaggaagaatcccttcctcttggggtccttgatgggcatgtgtgatggggaaggagcagtctcccagccctgggtctgctccccacatctctcctaattccacttcaccttttgccaccccctccccaccaggggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctata

SEQ ID NO: 250416 - DNA, 600 bp, Homo sapiens
gcatttgtcacttctgaataatgggtatatgggtattcattctactttatttaatactttgctatctatttgaaggtcttcgatatttaaacaattttaaagcattttaaatatatatatatataaaacagtctattggaataaacagctgaaaagcatacagaattaggtacattatctttatccatcatcctcatgtgtctggagaaactaactagataattgtctcccatgtttatgatacctatcagctaaattgctttcaggcacattatctcacttaatattctgaacaaccctttgatattggtattatgacagccacttcacttataggaaaagtcaacctttagagttttggagattttcccaagattatccagttagtaagtgatgcaaaactgggatctcactgtcaatgctacagcacagatgacccgtaagaaccctgacaatatattattccaaagttacatgcatcatctttaagatctgtcctgaagctacaggtttgaattcacaaatgaaacagaatactttatcactgacatttttaaagccttcagtcaaatctgtttcttctgactatttttaatatac

SEQ ID NO: 250417 - DNA, 465 bp, Homo sapiens
cactgatgcaatgggcactggtatattctttcagaaagtaattggtcagtatttttaaatagtcataaaaatgtttatacaacttcacctagtaaacctattttcaaaattcatccgggcaacaatatttaaataggaaaatgttgttagtagtagcagtgtgcactgtagcagaatttaaagatgggaaaacttagcaatgcttcctaatcagacgaaggagaaggccaactagattatggttattttaaatttatggaatatcacgctgcctttaaaaaagatttgtgaggatttaatttcagtatggcaaaatttgatgttaaatatgtaaaagtgatgtgcacacatgaatcaagactgctagggaaactgaaagatgaagcaagttgatttggatggtgatattgtaggtatttcttatcatttttgtgtttataatatttgtataataaaacattttca

SEQ ID NO: 250418 - DNA, 472 bp, Homo sapiens
aggaaggctgaaaaaaatgaaataacttggtgactggagttgtttcacaattttattcaggcagtactactggaattaattaatgcttgtgttcttgtcctctctggacactataatccaaattataggaagaaagggtgtttgtctcacaatatgagttaatgcctcaggaaggggacgagtgcagaagaattggttatcagctcctgtaccacacattttttagttgctgagagggaatgccagaaaaaaacaaattgatgttggaatcggtgctgggtagcccaaatctagcggcaattgtccattaaagaatatatccataaaaacttcccctcgaggatacattattttccttctcattgccagggttcaaatttaaagtgcatgtgtgtgtgtttgtgtgtgtgtttgtattttataactctcttacttaactaattttattggatgcattaccaatgagaacccc

SEQ ID NO: 250419 - DNA, 489 bp, Homo sapiens
tgataaatatgttataagaagctcttgggtgatctgaaagctgtccctagccttctgagattttaatgcaggattactaatctgtcccacaaaacatcttttaattccatgtgagagactgtttgaaccacagatataaacccagtatggcaagtcacttattggtgttttgttgttgttgtttaaaatgtagacaacattctcagagttgaggcaaaattcgctaagtctgttctgtttcacatttttttatgatagattttatgtatagagaggagagaaaatatacaatgtagaattggatccagctgctgataaaagagaacacagtaatgtttgacttactcgtaatacttgcatatatattttcaatatgttcatatggtttgaactcctaaagcaaattgtccaagttactagctttaaattggttttttttagcattagacaatcaggaaggcaaggaattctcttcaaattataactcgc

SEQ ID NO: 250420 - DNA, 535 bp, Homo sapiens
acgggaagtgatcttaattttcaaaaataaagtatcttgcttaaaaataggcagttaaagtctgggtactcggcgtgtgcacacacgccgagagtccatacattacttaataatttctactagttgatacttttttccactaaataatgttgattcttgggtcctttgcttaatgcaggaaaatctaggtccttaaatgtgagaattgacacacacacacacacacacacacacacacacacacacaaattaggacctggctgttgacagtcaaaaagaaaaatgaagcctctctagaactaaaatgcaaatagactggagagctgaacttggggatgaaagagaggggaggctataccctaaggctaaagagtcatttgtgatatgattaagatctctgattgcggatgggcgttggctggtggatgggcagtggcttgcgcctataatcccagcactttgggaggccgaggcatgtggatcacttgaagtcaggagttttaagaccagcctgggcaacgtggcgaaatcctgt

SEQ ID NO: 250421 - DNA, 648 bp, Homo sapiens
tgttgttcaatttggacaaagcttcggtccctctgagttttgcgtgtctgtttctgggtgtatggggtggtggtctagatttgctgtagtagatgtgagctgctttgtgtgactgaccatggcaaatgacaaaacttgccagatttttttttttaatctctgaaactataaaatgcccctgcatctactttagtgacccccaagccccccaaacattacttaataatttctactagttgatacttttttccactaaataatgttgattcttgggtcctttgcttaatgcaggaaaatctaggtccttaaatgtgagaattgacacacacacacacacacacacacacacacacacacacaaattaggacctggctgttgacagtcaaaaagaaaaatgaagcctctctagaactaaaatgcaaatagactggagagctgaacttggggatgaaagagaggggaggctataccctaaggctaaagagtcatttgtgatatgattaagatctctgattgcggatgggcgttggctggtggatgggcagtggcttgcgcctataatcccagcactttgggaggccgaggcatgtggatcacttgaagtcaggagttttaagaccagcctgggcaacgtggcgaaatcctgt

SEQ ID NO: 250422 - DNA, 221 bp, Homo sapiens
gaaaataattggacacatttatatttgctgcaaatgatcacttatttattttgctaaaatccaatcttcacatatattctgtgatatattgaattcaagggtttatctcaaaactttgcattttaaattatcaccacttccaacaccagaaaagtggtttaattaaaaatttaattccaaccacttatttcctaaggattatcttttgcatcatataaata

SEQ ID NO: 250423 - DNA, 301 bp, Homo sapiens
aaggatatttttaaatgctttcaaatctgagacttggcttggcttcgtgaatgagtttctagtgtttaaattaaagtattttgtaattagactcctcgtgggcttgagaaataaaaagcctgtccaaagtctagctttatttagagggtcaggaagtcaaagagcacccaggaccatcttggcaattaatagcggcaaaaatagacccagcttctgcaaggttttccaggaaaatctgcttggggcagcatttgttaacctagctgccagtactcctactctcttatactggctgctttta

SEQ ID NO: 250424 - DNA, 331 bp, Homo sapiens
caaaaaaaaaacaactgaggctcaagcctgaagcccactggagcctctaatacaggtctgatgcctgggttttgcccccagacattctgatttaattggtttgcactggcttcctggcatcaggacttttaaaagctcacagatgattataacatgaaatgaagttcaagaactttggtactagcagaacagactggtttaaataaatcaaatacagttatttagccaattcaagactttctatcaccttcctggcctttacactttagtttacctcctatatcccacctacatactcttttgaaaagattctgctaagtccagatatcca

SEQ ID NO: 250425 - DNA, 316 bp, Homo sapiens
ccttagaagcaaagccatggtggaccacaaactggcttcccttgtgtatctgctttgggcacaaaagaccatgtcttcatttcagcacaaaacagtgcacttcattgaggtgtgatataattgcttcaggagagagtttgctctgaaaatgtcttctcggccttcctgaagcaggctgcacgcttatttatattggcaccacatgctaatctcacgaatggccctgttccgccagtgggaggacaaatagctgttcttttgctcccgtgtccatggaaagctcccctttctccttgcatggttgccatagtaacca

SEQ ID NO: 250426 - DNA, 618 bp, Homo sapiens
ggaaatttgatacacaagttgacttttttctacttctaataggacctgagggccttgaaaatatcttttcccaaaactggttttgttatattgtcagaagaatctcactttgtcacataaccagaaatcctaagattcaaatgattcttaatcatcttttataaaaattgaaatgtccttgggaatgttaaaggaatgagattgaatatttataccttcaactgaattacctgaaacagattgcagcccccattataccaggctgaaatcagcacacaaggggatgatactgacacaaagggaaccatgccaaaaagtgctttgaaggttttatggttgttttgaagggaatggggtgaggaaagtagggggaagggagtcctgagaagaatatagatgaaagagggctctctttgattagccagagggcaacataagatttggagaccatgggaaaggagctctggggtgccttcctgcttctcctgtgagttaagctttgacttcttataaatgttgtttcacacctcttctggacaggctcctaattaatgggagacaagagagcaaggtagttgtgtcattgatgctcacaagtagtgagaagttaaaaaaaaa

SEQ ID NO: 250427 - DNA, 437 bp, Homo sapiens
gaatctgactcactgaagactgtcaactgaatgaaggcttaaatttcatggtcttgggtgggagaactttttcatattctttccccatatggaataacaatctgccctgaaaacagggagtattttggcatgatctctttttgcttatttgccttccattttccataaagcaacttttgccaagcaccatacttaagactcaacttttttgcaaaaatatcagacaaagcactgtctttaagaacacagagaacacactagatcccttcttctgaaaatcactgttctatgttgtttgtggatatttttttagcattcactgcatgcctggaatgaataggctgtgtttctccccaaaagagcacaaattaatatacaaggtcaggttaaatagttaagtctgctttcctatcccttatacagaagctatccattca

SEQ ID NO: 250428 - DNA, 580 bp, Homo sapiens
attgggattacaggccacaaaatgcatggcacagggaagggtttgacaactttttgatggatgaacaaagaagattcaagccacttgtcaacaagctcaaagtgattgaaagtggaagcatttacccacacgctcatgcaggttgagaggtgctgcggagatgggtgtccacggatgaccgttcggaggccgacttcggggatgtggccccattagctcaagagtgggtgactccctaccacactgatggcgttggccaggacaggacaagcctactgcagtgacacagtgtcactgatccctgatgcccacgtgggtgttttactttagctaatgctgcagagataatgcagacagagaaatgaggccccagcgctgagcagcccaatcacctggttgtaagcagcgagtgtttctggctctgctcctgggccccaaaccactgtgggctcacgaagaatctttcagagttggagtcagaatgtcagggtttgagtgtagtctccaccccttaatgaccttgcattgataattctattccccgagcctcattttacccatctataaaatgaggacaaat

SEQ ID NO: 250429 - DNA, 461 bp, Homo sapiens
atggaaaacacttgtgtttgggaagttgtgttggaccataaggcatatatgatcaggaaagtggtgttacaaacaggaaatgtaatttggcataagatggaagagaaccctgaaatatcaagttagggtaaggaataaattctttttctcttttgtttgagatgaggtcttactatgttgcccaggttgaaatgcagtggctattcacaggcgtgatcatagcacactgcactttgagctcctgtctcaagcaatcctctcacttcagcctccaagtagctggaactacaagtgcatagcactgaatctggataaattctttttcttaaaaaatcatttgtaaaaatcaaaagaaaacaaaaagttgtaaagcatggtaaaacatggtaaaacgaattgccctgaacctatcattcgacttaagaactagaacataaccaataccttggcctctttccctt

SEQ ID NO: 250430 - DNA, 567 bp, Homo sapiens
cagctatctagtttagtcttggtaaagagctcataaggataggaatggagagtggaactaacttcaaactagccagaggcaggggaaataaatatatactgaaaggtacctcctctttcctgtgccatgcaaaggctaaaccagtcagcacttgcacatcaagaaacaattgtttgggtggctgtttattgttcctttacttcatctcctctagcttcattaattcccccagctcttcctccatttctcctatcttttctgcactagacttccttatttactataatgatttgaaaaacctacaggttgtggaaaggggactagtctggtaacattactcttctgccagggtttgctgtattaccaaagtgccattaatgtattctaggttcctcctgtgggcacatgctagtgctgcagagcattgcccaagtgaggggcagggcttcttcataccccagctacctatcctgtgagtgcttgtcaacctcaggttccacattaaaacatcatgtgtagactcagacttagaagtgaggattagattggattagaatggaaagaatt

SEQ ID NO: 250431 - DNA, 357 bp, Homo sapiens
aaaagtatgcacatatccacaaagattttcaaattctgctattcagtggccactaaggtctcctgtgacccttcatcaaaagaagcaacacaagcaacaagcaatgatttttaaaaagacactatgagcagaaggtctaaatactgttctgagagactagcaacaggacactagggctgagaaagccagtatggcacggaggcaggaagtgactggaggtgctcttggcccaaggtagctcaaaaaaagtatgaagattataatttttccaaaaactttctgggaattactatcttgatactcagggctaatttcaccttttaatgcaattgtgtaaagaagtacaagcttataaac

SEQ ID NO: 250432 - DNA, 714 bp, Homo sapiens
tgaaaaccaggtaatccctctcacccagagtatcacacattcccatcctggaccctctttatgagacaggggccggaggtagcagttgctaggcaacaccaaccaccccacagcttctcaccagccccatagaataccatcagcatcccgattataagaattaggtattctgtcccattaatttgcccaaagatggaagaaatcctaaatgactatctcaccctcaaaagtagtagttacctcacttccttcaattccttgctcaaatgtcaccttctcaacaaggtcaaccctaaccactttatttaatactgcaatctgctccctccttctaactcctctattgcactctactttttttctatagaaaataaaacattatataatgtatttatttaggaagtttactgtttattgtctgtctttacctcctagagcgtatgttccacatttaacagtaagagtttattgctcacacatctgagctaatgggctatctgttctgctgatctgttctgcctcagctagaatgactgggatgacttggctttccttcatgtgtcactcaaccaggttggcctgggtatgttctcatggtgttggaagttgtccaagagagtaagtcccaaatgcaagcccatttcaagcctctgcctcaccggatgtctgttcatatggttgagcccaaagtcaacaatcagcgcaggtcacctc

SEQ ID NO: 250433 - DNA, 521 bp, Homo sapiens
tcaaatcaactagggatgaaaaacacttgtattttaaatgttttttgtttaagtcaagggctattgaggaaactggaagttggtaaatcagagaagcatataaaatatgggaaagagattgcggggtcatttatttctttgctgttgaaatagttgtcatgatattaatgttctagtcgtacttagagaaattcagcaaaaaagtgcttctgatcatggtttcttagcacctcctgtattagtatttaaaacctctatcatgtcttccttgggatttaagacgtttgtgttttatgggtagttaagaactaaaatagataactgcttgagaaactgaccatctcctgcgcatattcagtttaggagtgatctggaaaccacaaggatcgtagacttgaaaataaccccaaggtgacaaagcaatctctgagtaccagtagcatgtgaacacacctcagaagagtcaaatatcctaatattttaagtctttctagaagccagctgttagtagaagtgttaga

SEQ ID NO: 250434 - DNA, 737 bp, Homo sapiens
gatgaaggtagcttttcctacagaaagtcgtgcgtttttgggttcttcgttggctgcttttgtgattgtgtaggctgtacatgcagattcgtttcttgctcatgatttataggtgcattttattcgatgaggaccccttactttgctagatttcggatatgaatgtctctgcacttgttacttttccccctccacctcctgattcagtcatctgaaattctgtattgttaagcaaggtctaagtattccttttagttatatgttccccatgttttttcttagaggaaatgtttgatagtttctcctaaaaaattaataattggcacaaaagactagttttgtgtcaaaagtagttttgagttttatctaaagactgacattggcttgaagttgggctttccagattcaaaaatctgccccagatgagatttagatgcagagggttagtgtccttttccccagggggatggcgtgatgatttgttcaagattgtgttatagtagctgccccttttaaggcagctgtgtgtgtgtgtggtggggagtgggcagtgtgtattccacatcaacatcctagaaagaacgaataaacatttagtgatctcactgtttctacttacatttggtataatgtactgtttttattggtgctattacctatgttaatagggcactttacaaaattttcaagaacgtttttattaaaattatttcaaagacttctttcttaaaatatga

SEQ ID NO: 250435 - DNA, 386 bp, Homo sapiens
ttgagacagagtctcgctctgtcacccaagatggagtacaatggcaagatctcagcttactgcaacagagtgagactccatctaaaaaataaaaataaaaaataaattaaatttctattcaggaggactggttagagcataatttttatcaaataaataaggaaatcaagacaggagaaaggaaccatggaaaggagataaaagtacctgccccccaaatcttttgttttaatgacctgagctaaactgctatttttttcaattaattatttattaagaggagttaaagacttattcttaaagttatcttgattccaaaagcatttcacaaactggcagagataatctaatacaattaggacagaacacaagaaaataggtgtcac

SEQ ID NO: 250436 - DNA, 827 bp, Homo sapiens
gcctttctatattttgacacactgaatcaccatgtccgagtttgttccattatgtatgatggctcatgtttggggatgatgaatcatgattttttttttctgagcccctgcctcccggcagggcctccctcctctcctatttgggtttgagctttgctaagcaccacccctgctctgtgttgggtgctggggcatctcccagaatgccccaccatctgtgaccccataggaggaagaaggggctccggggctctcatttgctgaggccttcagaggcatgagctcatgccatccttgcaaacctccagcaaaatgagtgtcgtatttctgtttacagatgaggaaacagagaagttaggtgccttgttcaatgccctagaggtagtaagtggcagagctgggattcaaacctagaaacacctgtctccttgtagcatgcaccatgtcagactctggagaagccttttgtggattgtctctgccatgagacctcacagaccctaggagagagatgctgtttgctacggtctgaatgtttgtccctccaaaactcatgttgaaatttaattgcccttgtagcagtatgaagatgtgggggcctttaagcgatgattaggccacgagggctctgcctgcagggatgggattaatactgctataaaaggccaagttcagtttccttctgtctctctttgcccttctgccttctgctgtgtgctgatgcagcaagaaggccctggccagaggttggggtttggggttaggaaggccttggactttccaagccccagactgtgagaaaataaatttctgttcattaaagagta

SEQ ID NO: 250437 - DNA, 1101 bp, Homo sapiens
  misc_feature (68)..(68): n is a, c, g, or t
  misc_feature (72)..(72): n is a, c, g, or t
  misc_feature (75)..(75): n is a, c, g, or t
  misc_feature (79)..(79): n is a, c, g, or t
gccagaggaaaagcacacatcatatacacaggaggtataaaatgaatcacagctgacttcttaccatnaacnatnaagnccaggtccacgcgcggtggctcatgcctataatcccagcactttgggaggccaaggtgggcggatcatgaggtcaggagattgagaccatcctggctaacatggtgaaaccccgtctctactgcaatagaatgtggctgccatgctggctttgcaacttcaagagatcctctgcacccttacacttctcagccaatttgtggaagaagtggccagtgccttccagtgccacatcattgtggtcaaaatagaagcccagaatgagagagatgtaggaggcctacagatacaaattgaccaggcgattgacagctgcctccaactcgatgaaataattctgatgagtctagtttgcaagaaggagctaaccacaaaaacagtgttggctggtctcagaagcaggagatggccgagaagatggtcctggaggttgcaagtggagaggacagtggagggcagttggaggctggaagagagggagtccctgggtttgttccatccaaatactattgaagcaagagacagatgggtgggactgtcaaatgcactgccagaacatccatgaacagctcatggttcaagaagtaatttcaacttttaaggcttattatttaggaaatacattttataagactatagctgccatagatagtgagtagagtcaattaaaaaccttctggaaaggagtcaccattctagatgccattaagagcattcgtcattcataggaggaggtcaaaacatcaacgttaacaggagtttggaagaaattgattccaacccttatggatgactttgaggggttcagtacttaagtggaagagttaactgtaaatgtggcccggccagtaagtggtatttttttaagaatttcattttccaactgtttcttgctagtatttgaaatacaattgatgtttatatatttttcaagcttgctaaactagcctgggaaacatagcaaggccccatatctacaaaacatttctaaaagttaattgggcatggtgctgcatgcctata

SEQ ID NO: 250438 - DNA, 525 bp, Homo sapiens
tcagaacagactcccactaactagaatcatcacaggcagctctgggaatgagaatgtgacgtgttcggtcaggctggaacagctttcctccctcccccacttcctcgctgggggcattcgggaaatctgatcattaactagctggggacacatggagaacaggcatgcagatgatgatccgttgtcttcccctgtggcagtctcccgagtggctttcaccacaggtccgatgctccgttttgctgcccaaggaattctgccttgtggccttgtggggcacaggctctctagtttctcttcttcatgttgttttttgttgttgtttttgagatggagtcttgctctgttgcccaggctggagtgcagtggcacgatctcgctcactgcagcctctgcctctcgggttctagcaattctcctgcctcagcatccggagtagctgggattacaagcacgtactatcacacctggctaatttttgtatttttagtagagacagggtttcgccatgttggccagggtggt

SEQ ID NO: 250439 - DNA, 559 bp, Homo sapiens
gccctgatgttgaaggttcaagatcaatggaaattacttggattaagatggctgactgggttcctctggcaggaaaaaatatcaagtacccctaaagaaaatccaccaaaagggaagttagagggagtgatctgtcaaccgtaatttggaatcatcactcactgacactgggcaagcatgatttcagcaaagttggcaagactcagctatcctggtagaatagtcatgctttgggaaaagcagctaaccatatgatggaaaaccgtcacagtagtgctcttgagacccaagcagggacatggtgcaaggttttgaacccaaaaaagcacataaccatgaggctgcacaggactggcattcaacagtgccaccatgtggcaggaactggagtatagcagcagtggactgatgagcctctcttgtcctctctgtacttgatgctgaactgatgggtctgaaatgaataatatcccaggtttttggataattacaggtggcatgggaaggtcttacaaggaagacccctgccagtgtggctaagtgaagtcttgagtaacga

SEQ ID NO: 250440 - DNA, 330 bp, Homo sapiens
agatgcttttctgcagttacagcacctcatggcagctgtggtctgtggctgtttggggcattgctgttagagccggccacggcagaattgtagggacagtgacgtttgcttttggtcttgccccctccccacaagtgcttcctcccttctcaccctaccatcccgtaatacacagcactcctgtcctactgccctgtgtttggttattctcaactgtctgttccccagccccggcaaaagggtcagttccggggttcttaacctttatgactcaggcctcttctccaaatactgtttaaatgcatgtataaatacataggattacagaag

SEQ ID NO: 250441 - DNA, 504 bp, Homo sapiens
tgggtacctccattctgctcatgaaagtcacagaggggaccggggaccccaggcccctagcgataccagcaccccacacaatgcctttctgggatacacccccccaacatggcctgcccaaggcatcaggagctgtgtagaggagtcagctgggggtggcagagccccagggaacaatcatgggtcgctggcagataagccatgcgcccacacagcacaggccctcacccctgcagctgggggagccctccttgggagcgggcccaggatccgggcaaaatgacacagaccggatccaggagcagactgagcaaaagtggcaaaagtattctccaggttaagggaatattttcaccaattgagagaccagctgtccctccagacccaagggttccacatccctggaggcaaccaagccagatgcaaaatatttgaaaaagaaaaatgaaaaaaagaacaatacagcaataaaaaagaacacaaataaaaaatacagtatagcta

SEQ ID NO: 250442 - DNA, 1051 bp, Homo sapiens
gagggggtaccccgaggtgctccgctggagactctgctcattctgggggtgcggttgacggctggtcgtgatctttcccgtaatctgtcccctcttacggaacctagtcttcgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctgtgttccctgtcccagcagaggctgtgtcctctccactcaaagcctgaagcatgttggggtctcttcatctctgtacatgcccatttcagagtccagtctggtgggagagggaacagagtgggaaagaaaactagggtaagcagaaatgatgaaaccttataagagtgagattatcatgtacaagagtgagattatcacgtacaagagtgagattatcacgtacaagagtgagattatcatgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaagatcataggaaactgcccctgagctcacacatatttccaatggtgtccccaatttcagggaatccatggattacctaagccagcccctccagtttggctaagaaactctagtctatatatcaagttttgtatcatatgtattgctctgaactcagaaatttcccttccatttatggattctatgaat

SEQ ID NO: 250443 - DNA, 451 bp, Homo sapiens
  misc_feature (392)..(392): n is a, c, g, or t
caaataggccaatcattaaacgtagacttgtatgcaagactgcatatattctgtagtgatttttggattctagttccattttccatcactcctctacaagcaaaaccaaaccccaaactcttatctcaatgctattttgttcttctgcttggaaagtccccacctcccccatgcctgtccaccttggaggatgtgaccagtgtcactgctacaacgaggtccttgcttcactgtcaccatttttcatgtgacccgctctcccatgtgcctggcttatttcacttagcataataacctccagttccctctatgttgttgtaaatgacagaatccctttttttttttccttttttttggactgaatcttgctctgttgcccaggctggtggttncgataataactagtatggggataaggggtgtaggtgtgccttgaggtaatccgtgaggg

SEQ ID NO: 250444 - DNA, 441 bp, Homo sapiens
tattcctttatagcaacaccaaacagacgaagacaatgtatatagaacaaaaacaaagacaacaaaaaaagctgaaagtagagaacaactatagagactgagcatataaaatacttttatgatcaagtaattttacaaggggggcattatttgcacgatattaaataatcccatagatcatgcacttgatagtgattatgaagaaagcattttttttgtaatatagactatttttctcaggcaatgccaatgacaaatttctagaaacatttctttccaatttttcccttgacctatgatatttttaactttcaacaatattacagaatttggggtggggtggggactgtatttccattttcaggtaacaggtgaaagaacggacattataaagatattgaatcagaagaaaaataattcatgcttacaggtgattacaaa

SEQ ID NO: 250445 - DNA, 222 bp, Homo sapiens
aaggtgccccaaagctttcaggtcaagccacagtgaaatctctgctgcatagttggtcacatggaggacatcttcagggcttcctcttggactcttcaaattcttctaccacctggggcattttgagcagtggggaaaaaggaaactaaatttatattcctccttagacgcttcctgaagaaaaggaaaaataaataaatactggaaaatgcttgtgaattt

SEQ ID NO: 250446 - DNA, 435 bp, Homo sapiens
gccatgagttcataatgatactttaaataatctcactggtcgtctaaaggttgctaaggcaccaactcatagtatgctaactgataaatgaaagaaatcaagcatcaatactgccatttctttacagactcatttcaggggaatcaaagctgatgagggaaagttctatatggaacaatcacagacaatatatacaggaagaataacagaaatggataattaatccttaatgaaaaaatagctatcagcaatgatcaatggctgctaaaacaattaggtgaaagtttgatgaagaccatattggatgaatcaggctgacaaatgctgaaaccactgatccatcttaacagcattaaaagtgggacagacattatatgcctcatgtgatgccacaggaagcacaccactttataatacaggcttgcaaaaaaaaaa

SEQ ID NO: 250447 - DNA, 750 bp, Homo sapiens
tatgacaattgtaaataaatttattaatataaatatatatatgtatccaacaacggagcacctaaatatataaagcaaaaattaataggcctaaaatgagacataggctgaaatacaataataataggggacttcaacaacacatttgtagcatttgacagaccattgagacaaaaatcaaccaagaaacatcacagttaaatggcactgtagagcaaatggacctaacaggcagttacagaacattccatccaacagctgcagaatacatattcttctcaacagcacatggaacatctaagatagatcatatatgataccacaaaaaaagtcttggtgattttttaaaaatcaaaattatattaagtatcttttctgaccacaatggaataaaactagaaatcaacagaaggaactttgaaaactgtacaaatacatgaaaattaaacaaccatgctactgaatgactaatggatcaatgaagaaattaaaaagaaaaatttaaaaattattctgataaagggaaatgaaaacacaacttttcaaaacctatacatacaacaaaagcagttctaagaggcaagtttatagcaataaatacctacgtctaaaaggtggaaagatctcaaaacaaaaaaaactactctaacattgcacctcaaggaactagaaaaatgagaacaaccgaaatcccaaattagtagaataaaggaaataataaaaatcaggcagaaataagtgaaatagaga

SEQ ID NO: 250448 - DNA, 1177 bp, Homo sapiens
gagtttagctcttattgtccaggctagagtgcaatggcatgatctcagctcactgcaacctccacctcccaagtttaaatgattctcctgcctcagcctcctgagtatttgggattataggcgtgtgccacagcatccagctaatttttgtatttttaggcaccctaacatggtgaaaggccaggctggttggccaggctggtctccaactcctggccaggctggtctccaactcctggccagcctcaagtgatccacccatcttgacctcccaaagtgctgggattacaggtgggcgtgagccaccgcacccagccacctttctttttgtcctcgtttgcaaatacagaatggacctgagtctgcaaactcagaagtgcgagacatgtatttttatttttataaaattgaactggactcctaccaaaagcccccaatgcagagtggcagaaactttatcggagtccattttggatcatcatttcccttgggcttgtaccagggcctggaaccttctgtgaggcccacccagtagacacttccacaccacagagagactgagcatgagaaggtccgtgcttgaaaaaggcctaacagtgggatctcggtgcaaggatgggagagtggaaaccgagtggtgaagagatgactgtggcacttagcagggaattcctgggagggtgaggcttcgggaagtttccagggagacaaaccctgttaagaatggctctagggccggacgtggtagctcatgcctataatcccagcactttgggaggccgaggcgggcagatcacgagatcaggagttcgagaccggcctgcccaacatggtgaaaccccgtctctactaaaaatacaaaaaaattagctgggcatgatggcggatgcctgtaatcccagctactcgggaggctgaggcaggagaatcgcttgaaactggaagtcggaggttgcagtgcgatggttcaaagcagttttgggggaagtggtggggaccagagtggaatagtgggctcaggagagaatgagaaaggcaagtgattgaatctgccaaagacagatcaccttttagagggcaggagagaatgatcagtggactgaatgtccccatggggatgaaggatggttggggtcagggtcctagagggagggctggaaggagggaaggagatggc

SEQ ID NO: 250449 - DNA, 530 bp, Homo sapiens
gagatgactcaatgtttcatccaaatgcatgttgttcacttttctagtaaaagggaagagagcatgtgtgatgtatattatatataattttttactcctggaacccataaaagataaaattttaaagcacgtaacgtcattggatgtcagacattctctgaatttacatatattatctgggtgctgacaatacctctttactctacacatgaataaactgaggattatagggcacacatgtcttgcctgagctcagatggttatgaaactagcaatgaagctgggctgggattctccttctcgatgtttgaaagcagagtgtgtactctaagctacacacaatagaagacccttgagaatcacaaaataccaattatttcaattgataaatttgtgcaatgtgctcacatacatcactggcaaatatatccgttgggataatttctaaattgcatctagtaagaaagagttcattaaacttttcattttgttacattaaaatccatttttcttccttgcattactcatga

SEQ ID NO: 250450 - DNA, 459 bp, Homo sapiens
tatttgagcaataagtgaagaaatgggtaagagaatgttaggagaatgttaagagaaagttaagagaaaaaggcaggagaaaagaggtgattgccacagactcgcacagtgcctttgagacctgagtatttcataggccagactgtgtggttggccttgcaggagtcttatagttacttgaagtctggaatcttcctgagaagaaaccagatgggctgcattctgtgactgtgtttgcctcgctatttggattccttaaactctgcatgatgatcccgtttttctagatcagtatatttttcatgccgtcatatctcagcatcccactagagttgtctggaagttgttaggttctgctgccggctttgcttgttatccttggaacttggtttccttatctctaagacagatggttgagacttactggtttccagactgtggtgtttgagccctacttca

SEQ ID NO: 250451 - DNA, 876 bp, Homo sapiens
caggaaattgggacacagacacaaagagaaaacaatgtcatgtgaagacagaggcaaagagtggagtgacagatgtacaagcgaagaacctcaagagcgccggcagttaccagaagcttagagttagggaaggatcatcatctgaagcaagtcctggcctgtcaacatgttgatttcagactactagactccagaaaaccatgtagaacacgcctacttccctttcaccattcaccatgaatgtaagtttcctggggcctcctcagccatgcttcctgtacagcctgcagaacaccatgaaagtggacaatgggaattccagctttgggacatcagacaaggcttgttttcactaaactaactggacacttgtcattcgtaaattgacaatatatgtataggactatttctagacaatgtgttttgttttattgatctctatgttaattcttacaccaatttcacattgtctttattagagttccttgacagaaagtctcaatatcaggtatgagtccttaatatttgttattttttatcattgtaatggatatttgcattttttaattttcccatttaaatgttgaaatcagattgtcaatttctggcaaaatcatcaactggaaatgtggtttaaaatatttaaaatccataaatcaacttgggaccatataaaatgttaacataataaaatttttgattcataaatgcaacaaatatcttcatatatttagttttttctcaattttcccatcaatttttatagattttagtatacacatttttcttataatctgttatacttatgcctaagcatttcatattttattctattgtgaattatgtcatttttaacttttagttttctgttgctca

SEQ ID NO: 250452 - DNA, 780 bp, Homo sapiens
caggaaattgggacacagacacaaagagaaaacaatgtcatgtgaagacagaggcaaagagtggagtgacagatgtacaagcgaagaacctcaagagcgccggcagttaccagaagcttagagttagggaaggatcatcatctgaagcaagtcctggcctgtcaacatgttgatttcagactactagactccagaaaaccatgaaagtggacaatgggaattccagctttgggacatcagacaaggcttgttttcactaaactaactggacacttgtcattcgtaaattgacaatatatgtataggactatttctagacaatgtgttttgttttattgatctctatgttaattcttacaccaatttcacattgtctttattagagttccttgacagaaagtctcaatatcaggtatgagtccttaatatttgttattttttatcattgtaatggatatttgcattttttaattttcccatttaaatgttgaaatcagattgtcaatttctggcaaaatcatcaactggaaatgtggtttaaaatatttaaaatccataaatcaacttgggaccatataaaatgttaacataataaaatttttgattcataaatgcaacaaatatcttcatatatttagttttttctcaattttcccatcaatttttatagattttagtatacacatttttcttataatctgttatacttatgcctaagcatttcatattttattctattgtgaattatgtcatttttaacttttagttttctgttgctca

SEQ ID NO: 250453 - DNA, 463 bp, Homo sapiens
caggaaattgggacacagacacaaagagaaaacaatgtcatgtgaagacagaggcaaagagtggagtgacagatgtacaagcgaagaacctcaagagcgccggcagttaccagaagcttagagttagggaaggatcatcatctgaagcaagtcctggcctgtcaacatgttgatttcagactactagactccagaaaagtaagataaaaaatctttaatatttgaaggtgcccaatttgtggtaatttgttcctgcagcctgagcaaactaacaagctcactttcagttcaatttcatggaagaatagaacaatcttttggtcccataacacaactcctcagtggagaactctgagtgattttaaaaagacataccaaatattgtcccttttatgctcaaaatgatccagtatttctatgtcattcttaaaataaaaactaatataatgtctacaggcttata

SEQ ID NO: 250454 - DNA, 535 bp, Homo sapiens
ggtgtggctgaagcctctgcagggaggtcctccccagtgaggaggaatggattggggtcctgcttaaagaagcagtctggccatgatcggatagagcagctatgctctgttggtgggggaaccttccttgtctggactgtttggactctccaaagctggcaggctggaacagctgagtcgaccaatctgcagagatggtggccaccctcccccggaagccctgtcccagggagagatcggagctctgtccttataaccctgactggagtggctaaagcttccacagggataagtgtattttttgcatctaaataagtatgtccttttcatatataatctatttattattcatttactgtctaagtatttgagtgactatgttttcccttctggggatatattagtttacaatattaagatcttttctcttgtgcaggttaaattttagcaggggtagcgtgcatagggagacagacaataagtgatagacatatgtaaattgagttacatgtcaagaagctgagaaatgctatgg

SEQ ID NO: 250455 - DNA, 681 bp, Homo sapiens
cttgtactttttatctgcatactctactaaatttacttcatatttattcagggtctttcatatcccagcccctgggtgtttgtttttcttcagtttctctgatgggtcgagcttgactttccatgtagtgagaactagaaagtaatcttctgtagataagatcatgctttaaatcctacagccttgaatggctgttggtttttctaggccctccattgaccctatgtgtagagacttccctctccgtgcctttgaagagggactccaggacccacgttggggcggttcttgcttattgcttttgttgcattttcgaaagtgttgtgggaaatggagagtaaaaatgggaaatgtagaataaaagtgcttcacggctacattttcccttgcagttttatccactacgagtttggtggccccacaactttgttggaaagagctcactatcgagattcttagagtccctagaaaaataaaataatgagacataagaacgcaggagaaatgtgcaagccaggtcagaggacaaactgcagaacaaggctcaaagatgagactgctcatcaaacctccaggtgacgaagcacacacacgcgctgccacatcggagcgacggatgaagggagcggttatctgggggaaacagaaccaggctggcttaattttctcttcctagtttgg

SEQ ID NO: 250456 - DNA, 177 bp, Homo sapiens
cgatatttgaataatatgtaagtattggggcaagattttcttcaatgctatttgtgataagtgtggtgtaggtgagagtaagaccaatgtcttgcttttgcaggaaaaaagaaaaacacactgactgggatatagcagtcctgaatgccaatttgagacaaattccagcaagcaatg

SEQ ID NO: 250457 - DNA, 650 bp, Homo sapiens
cgctcagtctgctcagtcgatgtgaggactgtgaggaagggttcccaacaggacagtccgaaggacacccaaatcctgagggctacagaataacagaaaggagctggaatcagcaccaggagagcaggagagcgacctggctgtgatctcaggtcaagcccaaaatcacaaaagatagcatcttcccatgtccagatggactgctctatatgcctggtcctcacctgggtgacattttgtgaccagaagagaaaggccaagagaaacgaacatcagcttctctaacctatttatagccaggatgatagaatcacaagattttcaaggtttataggtgatgggctgctctcaaaaggagctttgttgtgaaaacgtaccaaaagaaaatggatgagtgattctccaatacgttgcttttcaatcctatgacatcctcacctctgccctatgggtagattctttgatgtctgaaaagtttctgtacataaagaggaacattcattactattgtttaatgccccatttgttaactgtgtgactttattaaaaaattatttttgaaggagtaaaccatcactattttaagtattcacatagtactttcaaaactaataaatatagacttggaataaaacaaattagatttacta

SEQ ID NO: 250458 - DNA, 394 bp, Homo sapiens
aggtatatggcttaccacaaactacctaccacagagtgctctttttgtggagcaggactcaaaaccattattctctgaaagtgtggccaacaattagaaataagagcaagagccgggcgcggtggctcacgcctgtaatcccagcactttgggaggccgaggcgggcggatcacgaggtcaggagatcgagaccatcctggctaacacggtgaaaccccgtctctactaaaaaaatacaaaaaattagccgggcgtggtggtgggcgcctgtagtcccagctactcgggaggctgaggcaggagaatggcatgaacccaagaggcggagcttgcagtgagccgggatagcgccactgcagtccagcttgggcgaaagagtgagactccgtctca

SEQ ID NO: 250459 - DNA, 968 bp, Homo sapiens
agcacatactgtagttatttctcgttttgctttggttttttaatccaatctgaccacctctgcatcttgattagattgtttaattgttcacacttaacactattacccactgttattttgagagaaatttcttttgtgtttctaagttctaaggcccctttcaaagttatggcatttttttctgcttcttttgagaacaaattcctctggggcttacctgatgcagatactgaacaagcaaaggagagaacaaaagctcagggacaagcacaagagtgggctgcatgaggagtgaaagttggaaggacagactcagccacacatttttggctgagatactatttaagtacttccggttaggattctctcaagttggttttctctgccccatgtcatcctcctctgtcttaatagttgagaatcttggaggtggggaacttgcagttactcatctgttcttcagttaaaatctctgtgatctatcttgtgatattcctttctagtcactaagggagaaaccagggtctttgattttacatagctttgagaggagctacagctttaaattggaatgcttttccaaaatttaatagctgcctgccctaaggggcagaacttcatgaaggaatgatttctagattctcattgaagacaactgaaaatggatgcaccctggattcagagcaagcactggaagtggcccccagcctcagttcttctcggatctgatgtttaatggggaagagaaagggtgagatggaagctttccctcgccactgaaaggcccatctcatccagggcctgcaaggatgctgattaatcatgatgagtgagtggggtggaaatgcatggcccatgggccaaggcgagaagcaaaggtggaaccagtcctgccagtggattcattggcagagcttggccgggagggcactcttctggagaaaagagaagagggaatgacaggaaaa

SEQ ID NO: 250460 - DNA, 781 bp, Homo sapiens
tggcagacgggcacacagccttgttccgttgcaaaacaagtgagagatggtattggtgtaacatgtaaaaatgcaaatacttaatttttatcaattcatgtgtggggaaaagctgaagatacgcgtgggaatggtgtggtcacttctaggggtgtcggagggtagaacttcaactgttttgctttaaaaagtaaggatcgcatggcagaactagcatctgttcacctgttgatcctgataccgtggattacgagaccccccctcttttctgtgtggttcagaaacaagcccctcagacaggacacagtgcccaggggcagtgacctgcaggcccacccactgccatctccgctggtctcggggttgccacatagcctgccagctgcggctgcttcctgggtgccctccagggagagcaggggatcgtgggtccccggcggtgggtgtttccttctccggggagagcaggggatcgtgggtccccggtggtgggtgtttccttctctaaggtttgctgctgtttccaggcctttctgtggggcctgggtcctgtcctggggccaagccacggggtcatcctcagctgcactgggcgtgccaaccacaaacgagtcacttgctacaagcagcaccatgcagcctcctgtctggacgagaccctgccccccacagactggagacgcaccccgatttcccaggtcacagggggaagtgtggatctgataagggactaaatgtggcgtctttcatatgtttctcttacatattttattttaaaatg

SEQ ID NO: 250461 - DNA, 674 bp, Homo sapiens
ggctcggtactacttttccacgggggaggaaggtcatgtttggttggaatatattgaatttgagatacccattatctgtacaagtggtgatgtggaggaagtgtttggataagggagttgggagttcaaaggaaaggtctgcagcttgagatatgttttgtgagttttcaaggtgcagaatgtatagtggatgaggtcactggcaactggggttctcaaccctggcctctggatatttggagaaagatctttagggcaaagggattaggaaataaaatacaaatcagcgattatgattcatttggaatggagtgggtccaaggtatcagcatcctttagaagctccctatatgattctaatttgaatgcaggattaagaactcttgcccagaacatagataaagtgcaaaagtactccaaaaactaagccctgggccattatgccactgtagaaaatgaagagaaactatcaaaaaagtgaggaagagtagctagtaatggagaagggataaagaggggcagcttggaaaccaaatgaaggaagtattttaaaacagagggagtgatcatgtgtccaaagctactgagaaatccagtaagatgaatgagaagtgacattgaaattgtcacgtacaaattcatggtgacttcgccttttgtgttgtgacgggcag

SEQ ID NO: 250462 - DNA, 382 bp, Homo sapiens
acttgaaaaccgtaatcttaaaattagtgagctcattgctactgactttgtccttaatctaggccctttcaaaggaaagagctagaaaaagtgtgtgtatgtgtgtgtgtgagagtgtgcgtgtgtatgtttaattttaagactaaatacatcaggagctcacactaatacttcctattaatatacaacccaacaggattttaatttagtcacataaatcttgtatcatatcaatgtcctttcttcccagctgaccatcctacaatcttaattcttaatgatagtagcgtacttatttgcttatgctacaaatacacttataacaggctcagaataataataccaagactactaccatcagtagtgatgtacacatcctgtg

SEQ ID NO: 250463 - DNA, 323 bp, Homo sapiens
cttttcctcaagagggaacaggaggagtggaacaggtacatccatagaaaaggtctgggagaccccaagaatccatatccaggctgattggtgaaggtatttctctccagagatgataaattctacaggaagttacatcttcaccaaatgaaaagactgtaatgaaagactgcattgaacacaaaaactcaaggaaacataacactatgacagaacataatagttttccactaaccaacctgaaaatattagagatctatgaaatatctaaaaaaaaatcaaaataattgttttaaggaagctcaagatgctacagaaacaca

SEQ ID NO: 250464 - DNA, 403 bp, Homo sapiens
agctgctgagtcccctggggcggccgggcactggggaatggtgaactcgccgtgccgcgcctctgccacagtctcccgtgggtccccactgccgggagttttacctacctcccaccctcagccacgagcacctgcaggatgcggtgccatcctcgccggtgcccgctccccttccggaggctctctccaccctcactgacgcctcctcgggaaagcccccgctccttccccgacctcacagcatgccaggtctggggcttccgctggggggcttacctgttttccacccctgctagactgggagctccagggcaaggccgtagctgccttgcggattgttacgttgtccagcttgtctccacacgtgatacccagcaggtgcctaataaacttgtgtagaaag

SEQ ID NO: 250465 - DNA, 710 bp, Homo sapiens
gttctctctaaatactgaaaaacacaagagaggagactaaggagacatgatgacttaatgcattgtatcctagattggatcctggaacaaaaatggggtattagtaaatagctggtaaatttctttctttcttttttttttttttgttttctttttctttgagacagtctggctctgtcgcctaggctagagggttgcagtgagccaagattgcgcacgctactgttctccagcctggtgacagagccagactctgtctcaaagaaagaaagaaattaatgtaaattttcattttagatcatctagcaaaaaggttttaaaactgaattttggagaaaataatatatggctaggtagtttatcaaacatttttatcttgaaatgtttatattcttgtatttaagatactctgtttctttattataatttttaaaaaacagaactttaatttgccctgcttttataggaaaaaatatagcaaatattgaaaacagtggccataaattctggaaatacagggaagtatacacattagtttaatgttacaatacttggtaagattgtagctatcatatgatgtattcagcatgttgtccctcattagcaaagatggctcagtacacaagttcaaattgcaagagcactgcattaatataacagtttcatcaatctctatacatgcatgtatgatttactgtctcagatgattt

SEQ ID NO: 250466 - DNA, 700 bp, Homo sapiens
  misc_feature (1)..(1): n is a, c, g, or t
ngccggtccatttccctcgcgtgccgcgctcacccacccgcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgcc

SEQ ID NO: 250467 - DNA, 894 bp, Homo sapiens
  misc_feature (1)..(1): n is a, c, g, or t
ngccggtccatttccctcgcgtgccgcgctcacccacccggtgaatgccctctgctggggtggggaagggaggggagcgcgggaagactgcgagcccctggcagccgggtccagagctaggccgggtccagcccccgggttcttcatccgctacccaggttgggcaggctgtgtgtggctcgaaacggggctcttgagacgctgagcgcgtggtgccacccttcctgtccgcagcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgcc

SEQ ID NO: 250468 - DNA, 676 bp, Homo sapiens
  misc_feature (1)..(1): n is a, c, g, or t
ngccggtccatttccctcgcgtgccgcgctcacccacccgcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgcc

SEQ ID NO: 250469 - DNA, 341 bp, Homo sapiens
ccagacacagtagctcatacctgtaatcttggcactttgggaggccaaactgggaggattgcttgatacagcctaggcaacatagggtgtttttttagagatctctaagcctcccaaaatgctgggattacaggcattagccaccatgtctggcctaccagagatctctaaaaaaaaaaaaaaaaaaaaaaaattagccaggtgtggtggtgtgcacctgtagtcccagctacttgggaggcttagataggaggatcgcttgagcacaggaggccaaggctgcagtgagttatgatggtgccactgtactccagtctgggtgacacagtaagaccatgtct

SEQ ID NO: 250470 - DNA, 688 bp, Homo sapiens
tataagtacacttataatacataatacttataatgtacaatacattacttatacacttataagtaatgtattaagacttgatagtctatatatacttaatatatattttatctctgcttattttctctaacttttctcatgctttttgttgttattgttgctgagatgtaacttttatgtagccatatcttttattttacttctttatggcctctgggttttattttgcttaaaatgtcttctaaactgcaagataataaaattagttttccagaaggttcatgtatgtgttatatgtgtgtgtgcttgtgtgtttgaatatacgttttcaaccttttgtctgtcaataattcatttttgcatgtcatgagatgcgaatctaactttatttctttgatatcattagcaaattattcctatggtatttgttgaatggtttatttttccctcctgaatggaaaataatctttataatagactaaatttctatgtttgcttgtattgtttctagattttttatctttttagagataatgcctttctctgtcacccaggccaaagtgcagtggcatgatcatggctcacttcaatctcaaactcctggacttaagtgatcctcctgctttagcctcccaggtagctgggactacaggcatgcatgtgcaccaccatacctggctatttattt

SEQ ID NO: 250471 - DNA, 341 bp, Homo sapiens
ctgatgtcaatagcaatggggggcagtggctgccttcccacaatctacccattttctgggctgggaggggtgaagtcaccacccgtccctgtgtgcctgaggtggtggtcagccacaggagctgacattctgctgtgaatctggatgcggggtggcagggtacccaggccacaccctggtgggctgcagggctcaagaggcagctgcgttgcttgtatttaaagtcaaatgggagcaattagaaaagaggtaaacgcaagttctctcttgtaggtcgggctacaggtgactttttaaaagtctgaattatcctaaattttctataataaacattttaaata

SEQ ID NO: 250472 - DNA, 213 bp, Homo sapiens
tcaaatcttcccaaacatctttcattataatgtttaatcaattttcattctacaccagtctataagaccttaaccctttctatcatgttgactgttccttacacacaagtccatgactgcatggtttgaagcatgttttaggcatgtaaaaatcctttcttcagaagactgggatctcccagcaccccttccttcaccttttccccagaaccc

SEQ ID NO: 250473 - DNA, 452 bp, Homo sapiens
tgtaataatcataggtaataagtataattatcttttatacatgtagaaactaaagtttatgaaaacgaaatcatgtacccaaagtcatgattaataagtaaagttgaacccaacttttttttttttactttaaatcctgtgcttttatttatttttattttttatttttgagacaagttctctgtctcccaggctgagatcatgccactgcactccagcctgggggacagagcgagactccgtctcaaaaataaataaataactaaaaacaaacaaaagctaaccatggaaaatgatattgatggatccaagtgatacagtttgtttcaacatattgagatattggatccttttaaattctttgtactgctcatgaccagttgccatacaccgcagaatgtcaattgcctacaaggtaaatttcacatcggtcgacttaccctcctgtcact

SEQ ID NO: 250474 - DNA, 287 bp, Homo sapiens
atttgcttttaattttacccagtcaaaaccaaaacaaaagaatattcatctcattgtctaatcttttcattcccatctcaccaaatcttagagcagagagaaaccttgagaatgctctagtttcaccttctgcccatgacaggccccaggctcatccaacctctggttgactacacttggtgacaagtactttactaaattgcaatataattcattccattgctaaagagctgtagcattgaaaaagtttactttcaataaactttaacagtaaaaagtttaaaata

SEQ ID NO: 250475 - DNA, 614 bp, Homo sapiens
gagagatccctgaatctttcaggcattataccctgctcctgacttacataacctacctcattagtgctgttctttgcctttctttacatggatcactgtatttcttacttcattatggtaacatgaattggatgctttccttgctgatactgtttctcaatatttcagtcatcttaagtcagcttagaaatgactataagaacaagaagaaccagaacagcctctcttattagagttaaagatcttcgacctttcaagtccagaaagatgtaatctgaagagtatgtaatcttaaatctattcaacaatgttatttaataaaatatttttttgcaaataattacaggatatgcacattaaaggaaagtgcttaaagaattaagtttaagatatataaaatagagggaactaagctatgaagatgcaaaggcacaggaatgatacaatggactttgtggacttgggggaaagagtgggagggggcaaggggtaaaagactacaaatatggtgcagtgtatactgctcaggtcatgggtgcaccaaaatctcacaaatcaccactaaataacgtacttatgtagctaaatactacctgtaccccaataacttatgg

SEQ ID NO: 250476 - DNA, 420 bp, Homo sapiens
aagcttgatttacgccttttggttacgcatttgccgcaaggcccagagctgtgcgtgctcccgctgggcttcttgtgtgagatgcaccgcagccaggacagcctgggcacctgccactctggagcaggaagtgaagcctccagcccttggttcttggggctctgccgggagcgaacggggctggaaacgccaagtccaggctgctttcacacattcaaacaccacggcttcctgccatcacttaggcctcagtggccctgaaagttgctctaggacgtacagaagaggccgttttgtcgttgtaaaaatcccaaatgttttgtggattactattaattgttaacgcttgtcctgtgagtagctcgtcacctgaggccttgtcgtgaatattaaaatgcacgtctggtgtcccttttggct

SEQ ID NO: 250477 - DNA, 360 bp, Homo sapiens
gcaaagtgttctggatagggctaattgaagaaccaagagagaaaggcccccaaactgttgtaaattctaggcttaaaaggtttaagcccatcctgcagctagaggaggggttcctgggactcagagcagaccctttaagaccatggactacatttcccagcagccttcatgtcacattggcgtcctctactggtggagaggggagtccttccaagagagggctgtagagggcagagcagggcaggagagcagctgagaggagccttggctaatactattaaggaccaggatgacaaagaaaaccacttctttccccccgaaacaaaacaaaacaaaagaccaaaaaataaacaaaaaaga

SEQ ID NO: 250478 - DNA, 422 bp, Homo sapiens
ctgcgcttggctcattcctgggcccaagccttaccacttgctactcttcctctaaatttggatttcttcccctctcttgtcctcaaacccactgtcacttttgaatttgaagacatgttgctttgcacgccgctcctctttggggtacatctgtgagcacctgcatggctaagagggagtgctcagtgagaacccagtgaatgatgaaggtgtatgtgaatgacgattggatgggagaggctgcccaagtggaaaagcggtatttgcttttcagtacaggaaaatttccgtgatatttttctggcacacaataaagaaaatgctatattgaagcaaattaatatattttaactttgtgtagatgcagtgggaattactttttaaatggtgtatggaaataaaagaactggttgaaaagaaca

SEQ ID NO: 250479 - DNA, 563 bp, Homo sapiens
tttgagactcagtctcgctctgccacccacgctggtatgcagtggcgtgatttcgactcactgcaacctccgcctcccaggttcaagcaattctcccgcttcagcttcccaagtagctgggattacaggcacgcgccaccatgcccagctaatttttgcacttttagtagagtcggggtttcaccgtgttggtcaggctggtctcgaactcctgacctcaggtgatccacccgcctcaatctcccaaagtgctgggattacaggcatgagccaccgcacacagccttgcagtacctttaatagttctgattatatgggaaaccccaattctcttaacctagaaacacaagtggacaacccatgctttaaaaatctaatgagtcagtgctttttttctgttttgacttggctcatgcccttaagctactcttaaataacacagtaaggaaacctatttataccaccacaagcagctgcagcttgtcaaaaaaaatcaatgaattttctaaaaacatttctttggcttggtttcagttttcagttcatcttagaaggtcatcagc

SEQ ID NO: 250480 - DNA, 347 bp, Homo sapiens
tttaaagtatcaggagcccagtgcagtggctcatgcctgtaatcccagcactttgggaggccgaggcaggatgattgcttgagcccaggagtttgagactagcccaggcaatatagtgagctcttatctcttcaaaaaattaaaaaattgacctagtgtggtggcacgcacccagctgctgggtagggtgcggtgggaggatcgcttgagcctgggaggcggaggttggctgggtgacggagtgagaccctatctcaacaaaagggagctgggggatgatcaggagcccttgatgtggaaaaaagtaggatcagatttctaataaaacgctttcagccatgacatac

SEQ ID NO: 250481 - DNA, 142 bp, Homo sapiens
ccttttcttcattttctccaactgacttctctgaagttattggtgaggaacactgccttgggcttcctatcacaattcattaataaaggtaaagcactattctaggaattagaacaggccacctcccattccacacattgca

SEQ ID NO: 250482 - DNA, 332 bp, Homo sapiens
agtgacaaggtttgggttcattgtggggtcctgagtggggcactcactctgcaaggataatagttgcagctgtatttattttgtggactcggagatcatgcacagggcgaccttttaagattgagtatgtagtgcactgcacaaaagcatcacaccaaaggacgcgtttacatcatagatagtgtagaaatggatgtttactctgaccatttttcagcagatggcaaacaagggtgtgaggatgggccccttattctaatttgcacaagggcatgaaacaggctcctgggtggccctaaatctggcactaaagctgagtgactgagtgaaca

SEQ ID NO: 250483 - DNA, 442 bp, Homo sapiens
aggtcacaggggatatgttggcttagcttgggctcaggcctgacagtcttagactcctgacctcaagtgatctgcctgccttagccttccaaagtgctgggattgcaggtataagccactgcgcctggcctgctttcttgataatgttattttacgttgtatatgtatatccccccaaaatattgtttgcttatgcatatttttaaactttatataaatggcatcatgctatgtggactttttttcctgcaactttttaaattagttactaagtttcatccatgtttttcttcaaaggtaagaatttctctggaatatacatctaggattggagttgttgtttgtcaggtgcgtacaccagtaactactagatacaaattgctttccaatgtagctgtacggttttattgtcctacaagcagtgggagagttcctgttttta

SEQ ID NO: 250484 - DNA, 443 bp, Homo sapiens
gcaagacacatagtatttaagcctagattcattattcaaagatatgaaattttaaaatgcatagcattactttttaaaaatagcagaatggctattaaatatctgttctcccaaccctcactttctttatttccaacacaactttaaaaaatagatcagtttctaaaattacatgctagcttaacttgcttttcatcaggggaagtgaaaatgctaaatgagaagtacatttaggttgctaaaatcagtatgctttctttctttcttttttttcccaaaaaatgaagaaataaggactctgaggctatttaggtatttgcagaacctgggtaaaattttacttaagaagtagtgtgggcagggcgcggtgtctcacgactatagtcccactactttgggaggcttggcctacatggtgaaaccccatctctactaaaaataca

SEQ ID NO: 250485 - DNA, 757 bp, Homo sapiens
atgctgtagctttcaaaaataaatattcacatctttccattcactgtgttaaatctgccttgtttgtggtcataaattgatattggtgtgtaacggatacatcagtaaagttcctagcagtgaatcttgacagttgctcagagaatctgcttgaactgaggtaccctatctacaaggatcaccttttatttaagtgttattttctccagcacacgataaatatcataaatctctaggtgtcctaaggtgaaagatttagaaggaaaatatgctttctaggttttcctaactttgctatccaaaggaacttggagcgtccctacttgttctctaccatggcagtaaattattatgaataaattacattttttgatgtgtttctcctgctcctccacgtttttggggatgttgaattaggggcaagaagtgtagctgtggcttagatcagcatccttctgtcttttctcagtggtttcattgtgtgctttcttcttaaatcagagcctctcaggaagggcagcctaacatctactggttcattagattgcagttaattctcttttttttatttatttggttaattaattaattaatttttgagatggagtctcactctgtcgcccaggctggaatgcagtggcctgatctcggctcattgcacctctacctcctgggttcaagcaattctcctgcctcagcctcctgagtagctgggattacaggtaccctccaccacacctggctaattttagtattt

SEQ ID NO: 250486 - DNA, 374 bp, Homo sapiens
ggccctaatttttaggaggtagtggaaatgatattttaagatactagaaatcttattgaaacacgttgtagctatccttaaaaactgtggccgggtgcagtggctcatgcctgtaatcctagcactttgggaggccgaggtgggtggataacctaaggtcaggagttcgagaccagcctgaccaacatggagaaaccccgtctctaataaaaatatacaaaattagccgggcgtggtggcgtatgcctgtaatcccagctacttgggaggcttaggcaggagaatcacttgaacccaggaggcggaggttgcagtgagccaaaatcgcgcacttgcactccagtttgggcaacaagagcgaaactcccttcgta

SEQ ID NO: 250487 - DNA, 410 bp, Homo sapiens
agaatacagatggccaaaggaaacaccatttttaaatagttactttaaaaaaatcctttcagatgaaaaaatctgctatggttgatctttctggtgttggtgaaaggaaagagaaatctccgtgtggggaggccctgggcagcgttcagggaccgagccctgtggagcggaaaggctcgagactggacctatcttgcaaaaacaaggctcctgttagcagaatcgaagtccattgaggagctggaagaagacaggtcccttctctaaagcactgtgattagctcaagctcgttggatttgcacttttggagaagatgtgttcagtgagggctgtggaaggctaggcaggctggacgcccggctagaggccaagcctgcagacggcagaaaggcgaatgcaccttccagat

SEQ ID NO: 250488 - DNA, 209 bp, Homo sapiens
caaagtcatgtaagacgtgttttctcaattgttatccaaggctgagaaccaccctatccaagctattctcttcattggttctgatttcagcttttctcctgaggtaaaatcatttctgtattttccattcatactagactctgcttcaaccaaattctcacaatgttgtcagacatcttgtgttcaataataaaatatccaaaggtcta

SEQ ID NO: 250489 - DNA, 823 bp, Homo sapiens
gcatcctgaagtgagaagggaaatgaagctagtcatagccttgaggccctccaacattcaatggatgtgtagaggatgaaactgccaaggatagtgacaactggagagaggcaggaagaagaaaagaggctacttgaaaaagaagtggtagggtatcatgtcaaaagacacacaggaagaactcaacaaatgtttgatgaatgaaataaaaaatgaattaatgaataaatgagacttgcttcagattacatggccaggaaagctagacctgggagtcaaaccccggtcatctttaattctctgcactttcccttataccgtgctgactttcacgtccaaaatcttacattgaaagaggggacccttcttagaaaaggtggggattgaactgaggttttgaaagaaggtttggatttgcagagtggagtgggtatttcatttggattcgatggcactgccaaagacttggagctggaggtgagaaaagcatgctgacccttacgcctttgctttcctccttctcgtcctcaacttctaaacccttgttggctcttccatttgttacccccattcccatatgtgcttctttccatctaccacttgactctggtcctccctatgccagatcaactgcctgtgacccttgactgctccgcttggacaagtggtctctaaacttacttcctgctttatcttatgctcgtttttaaacattagcccatccagaagctgcaatattcattcattaattattcatttatttaacaagtggtaatgaatgcctgatacatgtcaggcactattctagcttcttggcatgcat

SEQ ID NO: 250490 - DNA, 347 bp, Homo sapiens
cattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcc

SEQ ID NO: 250491 - DNA, 406 bp, Homo sapiens
ccggccaggcagcctgaatcaattaatttgaaagcctcgaagagcatggaccttgtgccagatgaaagcaaggttcactcattggctggacaaaaatcggacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcc

SEQ ID NO: 250492 - DNA, 511 bp, Homo sapiens
agaaggctgctggctgcagtaacgggccggaagagggaggcaggggtgctcttagcagattgacagagcctgatctaaaggaaagacatgaaggactgagctaggggcgggataagagctcggccactagtctctaaggaatctacctcataaatctaaagcagcaaatcctgtcccctcagttctccacttttgctcaatgcttattcattaggggccagctctttccaggctatgcacgccgtgaggactgcacagataaaggtggcgtgggccttgccgcattacagagtgtcactgcttagtgggcagtgggcatctccagttattccttcttcatgtgatattgttttaaatgcccttagcttttgcgtttttcctccgtggagtggtctagttgatattccccttaactggtcgtgtcttgaaactgaattgcaggctctaggtaatggtgtgagcaatgtggactagggcccgggctgttaccttctttctgtgaagacggcct

SEQ ID NO: 250493 - DNA, 715 bp, Homo sapiens
aggttacaaaactaacacacctaatggtgaaattggcgaacacctacaagctccaacggaaaagttccggtggggggtggtgggggggcggacgccaggttttctacctacattaactgcttgactcaagaattatgagagcagctaattgctcttattacttccttagcctgaaaagtccctccctcttccctccactggttcccactcaatctccggttcatccttatagtcccatcgcacacgctgcctccaaatggcttttctgacctcttgttccctccacggcaaccgagacacatccagtcaaaacttagtcccctcccccgactctttggggcttccctttaacagtagtgttctgaaaggagcctgagctttagaacctcggttagggacaatgccagactacactaactttctagcgttaatgacaagttacctatcctccctgagcctacctggaatttttggaagggttgttaatatatgtgactgccctgacatattaaaacgtcctgaataatgtcagctttatttctccttggacttcctttaagtaccctgcaccatattttaataatttgtgtgcgtcttagttcagctcatactcccagctccttgatgacagagactcatcataagtcttgctcatcttggctttactaaaatgaccagcacagagctctgcactcaataaacgctttttggattg

SEQ ID NO: 250494 - DNA, 257 bp, Homo sapiens
gtcccctcacccccagggccctccagggtggggcagcagcagcgtggggggtcctgtcctgccctgtgtgcatctcaagacgaacccttggaggcccatatgggaaggcactgagccccaagctccacctaggaggacctggtgctgggcagctcacgcctggaccacgtctgtccctgtggtcggcctggttctgctgcccacagtgggagggagcctgggggccacgccgatgcagaccctgcctccccatttac

SEQ ID NO: 250495 - DNA, 182 bp, Homo sapiens
gatagaatgcttttctgaaaggtaaatctgattgtatcactttcctggtcaaaacctccattagcttccctttacatttagagtgaaattcagtttcttaccatgtttgatgaaggtttatgtgccattttctctacatctgatgtatgtaaaagcatgatcaatgttgctgcactgccttt

SEQ ID NO: 250496 - DNA, 395 bp, Homo sapiens
caaaatgtggtatatccgtacaacagaatcttattcagccttaaaaaggagtgaaatattgatacatgctgcaatatggaagaacctcgaaaacattaagggagagaagtcaggtaataaaggccacatattggatgattccatatatgtgaaatacccagaataggcaaatctgcagagacagaaagcagactggtgtttgctaggggctacaggaaggaaggaatggggagggactggtgaacgggtacaaggcttccttttgcagtgatgaaatattctggaactagatggggtgatggttgcataatattgcaaatgtcctaaaggccactgaattctatacttgtgatagttaaaatggtgaattttatattttgtgtattttatcacca

SEQ ID NO: 250497 - DNA, 371 bp, Homo sapiens
tcttttttaaccgcaactaaacattcagactcctaagactaccaaaattcaccagtttactggtcctgagaaacttacaggaaatgttgtgtcagcaaaggattgtcaggcatttttcaatacacttgttttttttccttgcagcagtccataaattttcattattagcagataataaaatgatctacttagaatactcaagggaattaatgtagaattattaaaattcgttaacaggccagacgcagtggctcccacctgcaatcctaatgctttgggaggctgaggaaggaagactgcttgagcacaggagttcaagaccagcctgagtaacatagcaggacctcatttctattaaatattaaaaaaaa

SEQ ID NO: 250498 - DNA, 295 bp, Homo sapiens
tcctcatatcttccctttcaactcaagctaactaagtgtctcatatttgcaaagcaaaatgttccaagtacatgacttaagctccagctacagtgccctgaataagggtgggataatcataatagtaaatttccaagtggccaagtcttaactttgccttggccacactaatgtggtccatgtggtcatttccaggctcaactttctgaagatgatggtcaagagacagaagtctctgaggaagaggaggtagctgtttagaaatgtttaaagggttgccatgtataagtcaaag

SEQ ID NO: 250499 - DNA, 439 bp, Homo sapiens
ggaggcaggaggatgggggagatggaggccaggcctatcctggcccttgccccttgctctggtctctgatctgggatgttctgtacgcccaggaccagaactgacagaagggctccttgtcccatcttatcacttggacatcctgagcctcctcagagagtgcagaccagctttagctgggcccccaaaaaaggtcaaaaggagagcagcagggtggacatcagtaggactgaagtggagccacacagaggggctagataggaggtcgtgtggggtcagaaagggtcatctgtaggggtcaaggccaacatctgagcctgagtagtgcacctgccctacaaggctctgagaatcttccctgagtgatagagccaggaagagggccacaagcccctccgaaccccttccccacagccctggaggccctagctcaatgcat

SEQ ID NO: 250500 - DNA, 514 bp, Homo sapiens
agtggttggggggatcacaggtctactgtctgtctgccaggtagtgctcttgtcatttatagcttgttacataagaaagagtagtaaataattgtaacctataactcattcatttaagagcacatttctgtccctcagacaggagaataactgtatgcaactcagttgctcagaaaaaaggagtaatcagccagggactcagctttttgttgttgttttttgttaccaaaaaccaaaagttcgtttgaaaagtcatctttgaagccagaagttttttcgaaacacttcctgccgttgcacagaaccctaatgagcagtatttctgcttcttgacaaagtcatggattctaaaggttgccttaccatgtgacggtcattctccaggaatctgcagcatagctgaggtttttcacaaagatggttttaaaaccttgcttacaagggtgattgaccttgccttactctttatgtaaattatggcattttgttattaaactacgattgggtccaactg

SEQ ID NO: 250501 - DNA, 486 bp, Homo sapiens
ccatgactatgctattgtaaatagtgctgcaataaacatatgagtgcaggtgtcttctgtttttatttttttaatctgtcgcaggctttaaaaattaaattttaatttgtgtgggtacctagtaggtttatatatttgtggggtacatgagaggtttcagtacagccatgcaatgtgtaataatcacatcatgtaaaatgagggatctctaccatcaaacattaatcctttgtgttataaacaatctaactatactcttttagttatttaaaaatgtacaattattattaactgtagttaccctgttgtgctagcaaatactaggacttatgaatactttctacttttttgtacccattaaccatccccaccttatcctcctgccactcttctagcctctgatagccagccacccttctactatctatgtccatgagttcgattgctttgaattttaggtcccacaaataaatgagagcatgcaat

SEQ ID NO: 250502 - DNA, 688 bp, Homo sapiens
aatttagaagtatcaggcaagcataggacagactcagaatcaatgaagtttgtatattatttacatcaatgttatgttgcatatttgttgttgacaaccgaaagtatagaaaagcataggaaagagaacaaaaactatccataatccctcagtatggatttataggcaaatgttaattgtggacatttctccccatccaatcttttttcatatatatattcttttctaatatatatctatattatatatattatatgtaatataattatatgtaatatatataatatatataatgtatattatatattatatataatatataattacatataattataatatatattttctacatatatatgtagaatatattatatattatatatagaaaaatatatatttttttctaatatatgtgtgtgtgttttaatattattgaaatctttatatattctgctttttgtcatattggttatttttatgatgaaatatttcaaacataccaccaaagaataatataacaaatatcagtatactcatcacccagtcacccgtacttaatatgaaagtgggagcttattaaatacaacgggtgtacgttaaatggcaacattttttaaaataaagctaataagtctaacttttactgggatagagtcaccagattagacaacacattcaacgcaag

SEQ ID NO: 250503 - DNA, 741 bp, Homo sapiens
aatttagaagtatcaggcaagcataggacagactcagaatcaatgaagtttgtatattatttacatcaatgttatgttgcatatttgttgttgacaaccgaaagtatagaaaagcataggaaagagaacaaaaactatccataatccctcagtatggatttataggcaaatgttaattgtggacatttctccccatccaatcttttttcatatatatattcttttctaatatatatctatattatatatattatatgtaatataattatatgtaatatatataatatatataatgtatattatatattatatataatatataattacatataattataatatatattttctacatatatatgtagaatatattatatattatatatagaaaaatatatatttttttctaatatatgtgtgtgtgttttaatattattgaaatctttatatattctgctttttgtcatattggttatttttatgatgaaatatttcaaacataccaccaaagaataatataacaaatatcagtatactcatcacccagtcacccgtacttaatatgaaagtgggagcttattaaatacaacgggtgtacgttaaatggcaacattttttaaaataaagctaaaaattgggaatttattattggagttgtattagggactatcatatgcttttctttaagtctaacttttactgggatagagtcaccagattagacaacacattcaacgcaag

SEQ ID NO: 250504 - DNA, 456 bp, Homo sapiens
agacggagtcttgctctgttgcccaggctggagtgcagtggtatagtcttggctcactgcaacttctgcctcctggttcaagagcttctcctgcctcagcttcccgagtagctgggattacaggtgcttgccaccacgcctggctaacttgggagcctgaggcaggagaatcgcttgaatctgggaaggcggaggttgcagtaagccgaggtcacaccattgcatgctagcctgggcaacaagagcgaaacgctgtctaaaaaaaaaagaacttacatacttaaacatcgaattgctttaagtctttggcattcactgttcccgtgcatgccagcagcttcttactgcaaacacctgagacttgctatagagcagctggactatgttccgcccacacacaggacagggagctgacaaccaaggaggggggtgggatcaatactccagctttcccct

SEQ ID NO: 250505 - DNA, 516 bp, Homo sapiens
ataattgatggtgcaagaaaccagaaaaggaaaagtagatgggaagggggaaaggggtgagcaaaaagtcagagaagtccgcctcttcctacaagatttaaagagtgcataaagattgaaatattttgaggtagggaggcatgcatgcttccatggatcagctgcctggattaccctctacaatcatccttagggcagctggggtcactgtcctttaaaatttaagtacaattgactccaaacctgtgtaccacttaagaaacccagcatacctgccaatatctccagagtttcattgggaacttacatttctcctaattatctcaggccctaatttcttgtttgcaaaaaatattgtgctctttggaagatttgtcaccatatcccagatattagtccatttatattacctcaaaatattgcaccctacctataagcaggaaaaatgcccaatattatattattatattatagttatatgattgttaaataaactagagtttgtggccattaaaa

SEQ ID NO: 250506 - DNA, 402 bp, Homo sapiens
cactaacatcatagaattggcatgtagtgtcaattattcaccaaaaaagaaacttaagcaatgactaatataccacaacattagatgttgatttgaaaagatgatgcatagatgaagtaattgttaaattaatcataagggaaaatattgaggcttgaaataaatttgttaggttagcataaatcctgaggctttttgaaggcatcgtaaactacttttgcatttgctttaagttcattgttgaggggcataaggagagctcagagcccatctgtgcccaactgctgtgtggtcttgggaaggtcagcctgtcttctagctgattaatctgcaaaatgagagggtcagagagacactgtcccccgcctcatgttgaaaacagattacactcttggatttgtt

SEQ ID NO: 250507 - DNA, 618 bp, Homo sapiens
gatgttttcaaactccggacctcaagcaatcctcccaccccagcctcccaaagtgctgggattacaaacatgaaccactatgcccagccaaacgacacccatgtgaagtgttcagtgtgctgagttcagggacccctcctggcacatgaagctggcagaccttgtccttgccctgcccctgcctgcacagagcttatagtcctggtggggaccaagaaggacaagggatctggacaggactttttgagaccagacttggagaactcccagaagaaactgcacccaaactgaagcctgcaaggaaagggtaagaagaggagaaagcaggccaggcacagtggctcatgcctataatccgagcactttgggagacagaatcagatagatcacctgaggtcaggagtttgagaccagcctggccaacatatcgaaacaccatctctaccaaaagtacaaaaattagctaggtgtggtggcacgcgcctgtaatcccaacacttctggaggctgagacaggagaatcgcttgaacctgagaggtggaggttgcactgagccgagatggcgccaccgcactccagcctgggtgacagagtgagactgcatctcaaaaaaaaaa

SEQ ID NO: 250508 - DNA, 506 bp, Homo sapiens
agaggagccagcgaaggcttagagggtgaaagactaggtgaggcgtagccagggacagcaggctgttgagaagaacattgtgacattatccaacaaatgagtactttgtcggcatgagtacacaaagtgaacagtgttctgggccttgatcttcccctagtcctgttgattatggcctcaggtcaggacacacacactcaccgccctgcccagcctcggataagctcatgttattttttagattttttttttctctttcttgttgccatattcatattcaggactttgatgagagaagaatgaggtagaacatgctcattgcatctgagcccacactgctttgatccttttcttctcaccagaaacagttcattaacctagaataagtcacttttaagcttgttttaaattgtgacaattctgatttaaacaaatttttctttttaggttagctataaaactcaccagtagaagttgaaaataaaaataattctatgccattgaat

SEQ ID NO: 250509 - DNA, 461 bp, Homo sapiens
gcagaagctgttatttctttgctacagatcaaatattctgatttgtttctccttacttctttgcacagaataagtaattgacttattatgaagtagtaccctggttttggagacaagttcccggaataataaaaatccagaattatttgcccagtttcagatttgaggatcagaaccctgtagcaatgatataagaatcagaagcaagaatacatttcatctacatttgttctatttcctgccatttagtttctaaaatggaagccatttcttgctgggaaaacaaaggatctttccatcctctaatggagaatcatgcagtcttagagttggatatgacttgagtaaagttcttccaactcatgtgccacaacacaatggtgtactctgaaaaggttagaggtgagtggagagagctttccagccaccaacagggagtgggatgggctgagcttcagcca

SEQ ID NO: 250510 - DNA, 469 bp, Homo sapiens
ggcccgggtgctcgctggtgcgcacgagaagcctgcgcccaacctgcctcccgattcaaggctgcagacgctaacgtgaggtgcctggccaatcactcaagccagagaaactcttggtgcattctgttaagagagaatgatgggctaaataataagtccatttattatactctataaagaagtatcaggccagggtgcagtgactcacacctgcaatcccagcactttgggaggccaaggtgggcagatcacctgaggtcaggagtttgagaccagcctggccaagatgtcgaaatcccatttctactaaaaatacaaaaattagccaggcgtggtggcgggctgtaatcctagatacttgggaggctgaatcaggagaattgcttgaatctggaaggcagaggttgcagtgagccaagatcataccactgaactccagcctgggcaaaagagcaaaactacatctcac

SEQ ID NO: 250511 - DNA, 426 bp, Homo sapiens
cagcatggcacatgtatatctatgtaacaaacctccatgttgtgcacatgtaccctagaacttaaagtataataataaaaaaaaagtctcagcaaggtttgaaggaatgttatctcttgcagctgcaagcaatgcaggtttttctgcaatgcagatttttttgcatgcaagcaatgcagttttttttgcatcataaacatatccttgcaacagttatttctaacaaaaaaaaatcgtgaaagatttctctttttttttttttctttttttcttttttataaaattttagttttactgatctttctattgttttctggtctctatttcatctgtgtcttctctgatccttattatttctttcttgtactaactgtaggtttaggttattcattttttaaatttcttgaaatgtaaggtaggcttttt

SEQ ID NO: 250512 - DNA, 266 bp, Homo sapiens
gctatatgtgtgtctgtttagttcattcccctttcctcctttccctcttttcttctgtgttagtttaaagcaaatagggatattttattacataatcataatgccaataacacttctttggtatagtgtgttatctagactataatcaaattgatgtgattatccaaagcatctttttacatttggattgtttggattggaattcaaatacagtctgcacattaattgcattccagcctgggcaacaagagtgaaactccatctca

SEQ ID NO: 250513 - DNA, 117 bp, Homo sapiens
aacctgtagcttccctgtcacttctctggctctcctctcctgctaagctttgtttcctaattaaaatcttctgccactgccatagctactgctgctactggaaccacaatagccact

SEQ ID NO: 250514 - DNA, 463 bp, Homo sapiens
atcctttgactgtgctgtaacagtgagggcttcagagtgttaagtatcttctcatctaaacagtacattgctgaaacatgttagagctctcattgagttttactcttaggttttgatcaagtcatggtaaaatgttagttatcatgtatatatgcggctgtggtagtaattgattctggaataaatgagcaccaataaagaataaaaattaaatgcttcattggtttctaaagggatagctggagtatgaaaaatgattctgatggggtgcctttggaattggagagtaacttgatgggctcacaaataaggcagtattgagagcaattgtgtaagtgacaatcttgcaatctgtgaataagtttaagactattgcttgtgattgttatgcttataatgtggagcctgctgtccatttcaactctcatctaagaattcccttgtcacgtggtcacctttatgt

SEQ ID NO: 250515 - DNA, 614 bp, Homo sapiens
agctaaagtttgttaagatatgttcatgcctagaaatagatgtggatctcagtaaggagtgacatatgtggcaatgatacctttccatactgtggatatcattggcacagagtaaatactgaaagaggggagtgggggacctcaatgattggaaagttttcattgcgcaaaaagtgtgatttggtcataagtaagactccatgtcctgtgcacattatgaatgatgtaaggcaacttaacaattgtcagctatttcttttcattgttcttattttgggaaatgggtgaaatgtcagtaagttgttggaagaaaaaacatacccttttagatcaatatgacatttgcaatgattagacctgattacagttgaaaatgttgctatggttacacattgtcgacatagtgttctgtaatttagatggacaacttttagggtttagagcatatagtcttttattttgttcagtatccatagttggcagagtagtttttaaattaggaaattatcttaatatcaaattctgtactggaagttttaatatttcaaattatattttccccttgactataaaatattatatattagttgtgaaaaatatagaaaatacagaaa

SEQ ID NO: 250516 - DNA, 322 bp, Homo sapiens
cacaccacccaggatggtcagcccaaggggaaaggacctgtgaggtggtccccctccaggttcactgtgtggaccttcaccatttgatagacccacctatgcaccagagcatccaatctgctttttatgcctcacttttaaatatgagcagacagacaaggatcctcaaggtttgggaatggcttccaggacagacagtgtcagagaccagattaaagaggaaaaaaggcacaccggagaaacagtgacagtgcatggggcaggagaaaataaaaacaaacaacaaccttctccttacagagagaagaaagctttgtgcatg

SEQ ID NO: 250517 - DNA, 555 bp, Homo sapiens
atcttggcgtgagacagcgctattccgtgggtgctataacaggttccagcagtacttgggtgttgatgtcccacccctgatgctgtgcagcgcctgaaacccagcgagctcggaaggtgtccagaagaatttcagtatttgctacagtaacctcatcagcctgccaagacagcagtgcaagcggccaagagggcgagcattcgacttccacctgaagtaaatcagatattgtatataagaaatttgccatacacaatcacagctcaatcaatgtatatttgggaaatatggacctattcatcaaatcagagtggaaaacacacctgaaactagaggaacagcttatgtggtctatgaagacatctttgttgccaagaatgcttgtgatcacctatcgggattcaatttttgtgacagataacttgtggttttgtactataatgccaacagggcatttcagaagatggacacgaagaaggaggaacagctgaagcttctcacggagaaatatggttgtcaagatagatccaccaaaatcaatgttttctacatttt

SEQ ID NO: 250518 - DNA, 527 bp, Homo sapiens
taattctatgcaaagtgatgctaaataatgccataactactttaatcagtgagtacattatctttataaaagtgataaagtttggcagttttgctagtagattaaaaaaacaatcaaagaaacagccatgcatatggaaatgattatttaacttgtggctgatgtacttaggggttgctgctctctgttgttttataataggcagggttagccagtatattgattggtagaataaatactcaaaattatcttgataggctgaaatgaggcaccagaatccaagagataacatttaggacattcttttatttatctgtggagaaagaaagcagcttacaaagtataagatagaccagcataaaaagaaggatgtaactatgatctaaggttagtgctttggtaaatcacttatatgtacacatatcttcacagtgagggtactttcacactctttgggaaaaagatagaaacactttatttgttcataagtttggcagccaacagtgcaatataacagctttttatta

SEQ ID NO: 250519 - DNA, 268 bp, Homo sapiens
gaaagggaaactggagtctcacagtaagaaagttctcaccacagatgaaggtcaatgagcatgaggtgagaagagacattcattactttggaactgatgagaaatattgattcctgaccacaggagtagtggccgagtttgttttgcgtggagtgtggcataaattccgtccctgttctgcatcttactacttctctaaatgtctttgctattttcaaaactgattctgcttgatctcataattcattaaagcaagttgatctcatgc

SEQ ID NO: 250520 - DNA, 402 bp, Homo sapiens
ggcttccccagagcagacgggttgcactctcctgcccctcaggcccactctgtcatccaacaagctcactgcaactggcccatcttaaaaacaacaccggctggtcacgctggctcacacctgtaatcccaacgctgtgggaggccggggcggggggatcacttaaagtcaggagtttaagaccagcctgggcaacatggtgaaacccgagctccactaaaaacacaaaaacaaattaaggcaccctgagtggtggtgggtgcctgtagtcccagcgactcgggaggctgaggcagaattgcttgagcccaggaggtggaggctgcagtgagccacgatcgcatcacgcactccagcccgggcaacctggcaagaccctgactctaaaaagaaaaaaacaac

SEQ ID NO: 250521 - DNA, 131 bp, Homo sapiens
ctgtgcagtgattggcccttaccttgctctctggtctctccttccaccaccggcttctgagaggttcgcagtcttacatcttgaaaaccactttcagtttgtgaaatggaccaggattcttctttttcttt

SEQ ID NO: 250522 - DNA, 401 bp, Homo sapiens
tagaacatttaggttatttgtactctattatcaggaaagattggggaaaagtggagtggcaaagagaaataaagaagtattaattggaaaccacctcaaacatgagaaaaatagcctttatttatttcattctgcatctgctagtctctgggcaatctaaaaaaacagtcttcagaattatagccacatggtgatttttttcctctccagaattacaagaaaattggctcccacactgtggaactaaaaagaggggctatagggtgctgcttctctctcttgacattttacttggttttcaaaggaattcgtgactaagaatctcatggaatctaaatgcggtcactgatggaaatttaggtttccacaaagagtgcaggaagaaatttacatggcaaaaa

SEQ ID NO: 250523 - DNA, 623 bp, Homo sapiens
gctgcatatgggaagatctgaagtcaacaggctttagccctgcaggtggagggaggcctccaggaggtgggcccaggactcaggaggactcagggctgccctgctggcgatcttcctgttctgtaacactacaggtctagcagtccagctgtcacagaaaagctaggacatgcagtatgcttctttggatattctgagtaacatttggactgttacccattggctaccagcatctcccaagtgagaatacatagattacccccagtgccctgaacagcactcggtcctaacacccgtgtccatggaaagcacgccgcgtctggagaaagaagcctggctttgtcacttactagccatgtgattttggaaagaaacttaacattaattccttcagctacaatggaattcttgggaggattaaatatggtgacaacgcctaatattagatggcctgtattccacactcaatcttccttccctcttcttccttctttgtagagctataatgaaaagtatcatgtgggacacagaagaggttgcagtctggggtctgcagggcttagcggccaggcagattagctttcttgaggaatcctgacagtgggtggaagggtatgatgatg

SEQ ID NO: 250524 - DNA, 393 bp, Homo sapiens
gtattaagcctagggccttgtaaatagtaaatgctcagtagatgtgtattgactcactcaaagattaaaaaaaacacctttcacttctgttcttgtataaaattataaaccaaatgttaataagtgagctccttgagcatacacccatggctttttcgtctgttaacatgaacaaatgaacttgtgaaagaaaatgttcttttccatatacaaacaaaatgttatttccatatacaaacttgagacaccgtggacactaaggataggggccatatttcattcatgttcatacctccagctcttagcacagtatgtagcacgtaatagcacttgctaaatgtttgctgaaataaaattcaagaagctacccacgaatcactctatgttacctca

SEQ ID NO: 250525 - DNA, 293 bp, Homo sapiens
aaaaatttttaacagctttatttagatgtattcgaaataaaaaaaacccctgcatatacttaatgtataaaagttgatgggtttgaacatatatatccacctgtgaagccatcactcatgatcaagacaataagcatatccatcacctctaaatgtttccttgtctcccttacctattttttaaacctttaacgacttctcgtttcatttagaatgcaatacatattctaacaggtcttcaaggttctttgcaatctggccctttcttccttcccaacttaatctcaggctca

SEQ ID NO: 250526 - DNA, 444 bp, Homo sapiens
caattagtgatgttgagcatttttcatatacttattggtcatttttatgtcttcttttaagaaaggtctattcatgtattttgcccatttttaatgaattatttatgttttgctattgagttgctttagttccttatgtattctgaatatcagttccttgtcaaatgaatagtttgtaaatagtttctttcagtcaaccatgtctcttttgattgtttgctttgatgtgaaaaagctgtttggtttaatatactccaatttctctatttttgtttttgttgtctatgcttttgaggacttagccgtaaaatctttgacgagttaacgggtgcagcccaccaacatggcacatgtatacatatgtaacaaacctgcacgttgtgcacatgtaccctaaaacttaaagtataataataataaaatttaaaaaaagtctttgcctag

SEQ ID NO: 250527 - DNA, 428 bp, Homo sapiens
gggacacgggtcacgctttgaagagggcgtgacaaaggggctgttctccgacactcgcatggcagggaatttcttggtccgctggtccctcaatgacacaatcaatgagtaaagggggatacctttactcatcacctcagacctgagcacgccctgggccccatttgggcagagctttgctctttgcttttcttttaaagtaaagggcccatctgctgcagctagtgacctggccaaaaaagacacagactgctgtgaaatgattgagggcagtgactcccctcccaccccaggagccagagccgacagagccaagagcaaggcaggaattcaggtccccaaaagcaagccagaagcaccacctccaagcgccctgccacttcctttgttctttgttaattgcaaaataaacacaaccctgcccaccg

SEQ ID NO: 250528 - DNA, 437 bp, Homo sapiens
aggtatcatttgaaggtcatggttgaatgtgtttagcaaagtaaggagggtaggtgctaggtacccattttgcagattagaaatgggaagtcacaggtggaaagtcaaaggacttgcctctgcagaaattaagatttcttccatcattctcagcaaactatcgcaaggacaaaaaaccaaacactgcatgttctcactcataggtgggaattgaacaatgagaacacatggacacaggaaggagaacatcacacaccggggcctgttgtggggtggggggagggggaagggatagcattaggagatatacctaatgctaaatgacgagtaaatgggtgcagcacaccaacatggcacatgtatacatatgtaacaaacctgcacgttgtgcacatgtaccctaaaacttagagtataataataaaaaaagtacaaaa

SEQ ID NO: 250529 - DNA, 487 bp, Homo sapiens
tggatcgtgggggtgggtctttcatgaatggtttagcaccatccctttggtgctgttctcatgatggagttctcatgagatctgattgtttaaaagtgtgtagcaccgccccccactctctctcttcctccgctctggccacgtcggccgtgcctgctgcccgttcaccttctgccatgattgtaagtttcctgaggactccccggaagcagatgctgtcatgcttcctgtacaacctgcaggaccatgagccaattaaacctcttttctttataaagtgcctcttgggtattttttacagcagtgcaaaatggactaatacaatatccatgggaggacatacaagaaacaaacacaactggtgccttaggaaagagtaactgtgtgttagactaggaaagagacattttttactgtatacacacttacttttttctgaaaccaagtattatcaattcaaaataaatttgaccaaaaagaaaattcc

SEQ ID NO: 250530 - DNA, 628 bp, Homo sapiens
gtggggacatggctttagtttcagctactctgaaaggtgagatggaaggatcacttggacccaggaagcagaggctgcagtgagctattatcctgccattgcacccagcaacagagcaataccctgtctcttaaaaaaaaaaaaaaaaaaaaaaagtacagtgctctgttttcagaaatatcaaggtaattcaaatgcaaataactgaaaattaactatattggtagggcatttggcccaaagaagccttcctctttttgaaaagaaaatacattgcattgcatgcatttgctcttctccccagagaaaggatgttgggctgcttcagacctctgacaatggatgcacccccaggattagatcagaaagatggacctgccaggggaaagcatcagaggcttctgttcctaccatcagtaccatggatgcgctgcgagtgtggagtctgtatggaaatgccccactgatttcacagtgtctaaagctgatccttgaggactaatagagaagaaagatgaacagaccagtatcccttgtttctaatactgaactggcctttactgagcttttctgtcgcgcagctgagattgaaaaggaagccacaggagcagaagcgaatgcaagctaa

SEQ ID NO: 250531 - DNA, 485 bp, Homo sapiens
aacacattttctttgccttctttggtggcctaagatggcaacagtagaaagactctgctagttttttgttttgggtcacgtttggtatgaagaacagctccatatcatctaaatatgatgtcaacagtattcttacttctcaaaatttactcatgagatggacactacaattcatttgctggtcctgagtgggtctggacaaacattagaaagagcaagaccggaaaagtactattgtaatcattttgatttaaaaaagaggaattggagtaagcactagaagtagaaatggagaaatacgaattccagggctattaggacacagcaataaattttgacaggcctatttaatatagaagccataggaaagggaggaatccagaaagactcccaagtttcaggctcaaggtgactatcttttgaatgggaaaaaaatgatgaagaatgcaaaataaaaagtttgttgatttatttatgcatccaag

SEQ ID NO: 250532 - DNA, 537 bp, Homo sapiens
agcgtaagaacccccactgggaatgacatttttggacttcccaaacactacctttttgttatggttggattgaaagtcgttccagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggttttttttttttttttggaagacagagcctgggcaacagagcgagactgtctcaaaaagaaaaaaaaag

SEQ ID NO: 250533 - DNA, 2269 bp, Homo sapiens
ttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatggcaacagggaggaagctgacaacccaaatacagggattggtgccttccgattcatgctggaatccaacaagggcaaatcaatgttggagttccaggagctaatgacagtttttcaactgctacactggaatggcagccttaaggccatgagggaacgacaatgctctcggcaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggttttttttttttttttggaagacagagcctgggcaacagagcgagactgtctcaaaaagaaaaaaaaag

SEQ ID NO: 250534 - DNA, 962 bp, Homo sapiens
  misc_feature (23)..(23): n is a, c, g, or t
tgaccctagaggatcccacacgntaacgccttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggttttttttttttttttggaagacagagcctgggcaacagagcgagactgtctcaaaaagaaaaaaaaag

SEQ ID NO: 250535 - DNA, 1072 bp, Homo sapiens
tatgagccggacctcataggtcgcaggctagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggttttttttttttttttggaagacagagcctgggcaacagagcgagactgtctcaaaaagaaaaaaaaag

SEQ ID NO: 250536 - DNA, 246 bp, Homo sapiens
gtattttggcacttcctaattgacaccttgggagactgcaggaagggaaagagaatcaatgatcagttatttgtgtgtgtgtgtggttttttttttttttttggaagacagagtctcacacttttgcccaggctggagtgcagtggcgtgatctcggctcactgcaacctctgcctccagggttcaagcgattctcttgcctcagcttcccgagtagctgggattacaggcacacgccacaacgcc

SEQ ID NO: 250537 - DNA, 413 bp, Homo sapiens
aagattattctagaccctgtgaaagaagtctccactgggcgccggccacggcattggggtgcgcgcctgctctgcgagaagggtcccccaggccgcgcgggggaacgcaggagacgcctgtccccgggggaaccagcggaggattgtttcatttcaaagtgaaaatctgcaggctttgggaaacgatattcaaaaaagtatataatctccatatgccgctcaatggaggatcctcataatttacagcggcagataaggctagagggtgtaataaaaaatctgaagccctcccctcccccctcgccgcctccccggaattgcaccttgggcagcggagcagaatccggaatgtgaacttctcccgacatatgtttcccgcagataagtaaacaatctggacgtgaaatggaaat

SEQ ID NO: 250538 - DNA, 466 bp, Homo sapiens
ttccaataatttttttgcaaaagtagaaaaaattaattctaaaatttacatagactatcacaggactccaaatagccaaaatgatcttctaaaagaagaacagtgttggagatttcacacttcctgatttcaaaacatactacagagctacaccaatcaaagcagagtggtacagatagacagacacagagacaaatagaatagaattgagcacccagaaagaatctcttagttatatgatcaaatgattttaaataagggtagcaagaccattgagtggggaaaggacagactccataaaaaatgtttttgagaaaactggatatccacatgcaatgtggaaatggataaaagacccaaatggaaaagccataactgtaaaaatcttaatagaaaacactaggaagaagtttaacaacattgggtttggaaatgatttcttgtatttgacgccaaaagcacaaga

SEQ ID NO: 250539 - DNA, 490 bp, Homo sapiens
ccagaaagaagagagagggagagaaggaaggaatgagagaaagagggaggaggttggttttctctgcatctcctgcaaaagagagaaagaaggaggagcctagtttgctctttgcatctcccactttccaagcatagtcacatgatatatagagagatatcatttatcaagtcatgaataagcatgcttcattaggttataactcttaactactactgtgctgcagcagaagtcttttggagacggaggaacagcaactttatgggcatggtcctctttctaggtggagaattcacctttggctttccttggtggacctcccttgggcaacatattgccaggacagtgcaggacatcaagctccctgacagtgatcctgtacacagatgaggaagacattcttctgcctgaaataaaacaacaggggaatactgatcacagaactcacttttcctacgctctcagtgtctttatattttctttttttaaa

SEQ ID NO: 250540 - DNA, 552 bp, Homo sapiens
ccttggttcagtgaatcctctgttaaaaggcaccaagactgtcagatcaatcttctgctacagcaaatatcatagcagtgactattctagaacacacgtctttgtacacattaacaaatatattctaaagacaaattcttaggactggctttctcgggtcaaatttaagatacatgtattcttaactgtgatagatattgctaattgtctgctataaactgaattatatttccccaaaatacagatgtcaaagccctaaccctcaatgtgactgtgttttgcaggtagggccttaaggaggtaattaagatgaaatgaagatgtaaaaatgggtccctaatctaataggactggcccctataagaagagaaagagactccagagatctctctctctaccctgagcacagaggaaaagccatttgaggacacaacaagaaggtagctgtccgcaagctaataagagagacatcaccaggaaccaagtttactggcaccttgatcttggactttcagcttccagaactgtgagaaaataaatttctattggtta

SEQ ID NO: 250541 - DNA, 398 bp, Homo sapiens
cgtgatgcctccagtctcattcatcagtctgaagaccacaatggactctgacctggatcatcatttaaaaatcatcagctggtcttttgcccaggctatgttacgcctttcaagtagttctgacaaggaagatgattattctaaccagcattatgatgttgtttgtttggcctgagtcgctctgcatcataatattcagtagcatttataaaagctgtctagttagctctttaaaaacttttgtcctgcaaaatgtttgttagtcaacacactactttgtgtaaacaactattatgtttccttgggaccatcacaagctctttaacaaacacaaggactcaattcattcagcaggtggggattaaagaatcaaagcccagtagcaaaaccaaaactga

SEQ ID NO: 250542 - DNA, 368 bp, Homo sapiens
gaagaccatatgaggacacagggagaagacagccatctacaagcaaaggagagaggcctaaggagagaccacctctacagacacctagatctcagatttctaatccccagaattgtaagaaaatcaatgtctgttgttatccagtctaaggtactctgttgtggtagcccaagcaaattagtattaatacaatctacctgtcctgtggcccagcaaacccatcctgagtatgtgtcaccagagatgcataaatatgttcacccaaagacgtgtccagttatagtcagagtagtcccaaactggaaactacttaaatacgagaattatggaatgcataaataaactgtgggatgctcacatgttgaaca

SEQ ID NO: 250543 - DNA, 608 bp, Homo sapiens
aaagactttcctctgcccaccaaatgcccagaactattttcatgacaatttccttcttgctcctctgctcattataaccccagaggggcacccacccccaatccactgcagacttctatggctgtattgatcctctgggagaaggaggcagatatgagtcacttcacttgcacagggaaattggaagagaccagagaggagattggcattctaaggccacatgacaatttcccaggaagccaaagagttgcattggagcattgagaaaatttagtgtgtgtgtatgttttctacctttccaaggggctgtttgtatctcttttatttatttgtgcagccaataagcaatgccttctattaggcattaggtaaggtataaggagatagaaatgacagaaactcctggacaacatagtgaaaccctgtctctactaaaaatacaaaatttagctgggcatggtgatgcatgcctgtaatcccggctatttaggaagctaaggcaggagaatcccttgaacccaggaggcagaagttgaaatgagccaagatcgcactgctgcactccagcctgggcgacagaacgagaccccatctcacaaaaaaaaaaa

SEQ ID NO: 250544 - DNA, 579 bp, Homo sapiens
ctggtcatatctctttcttcatctgagtgatgctgacagggataaatacagtttgtaaagctttatcatttgccaacctatctatgcacattaagtgcatattatactgaaatatatttttaaagtaaaaatagccctttgtgtaaacctccacattttattcccttgttctgaagaactgttaacagcttggtatttccttctagatatgtttctatttgtttatactgataggttgaccaatgtaagcgagtggatggatggatagatagatggatagatagtagctagctaaccagacagactgagtttgtttgtttgtggtgttttttgtttgtttgtttttgtttgtttgtttgagatggagtctctctctgtcgcccaggctggggtgcagtggcgtgatctcgactcactgcaacctccgcctcccgagttcaagtgattttcctgcctcagctacttgggaagctgaagtgagaggatcacctgagcctaggaaggtcaaggcttcagtgagccataatcacaccactgcactccagcctaggtgacagagcaagaccttctctcaaaaaa

SEQ ID NO: 250545 - DNA, 593 bp, Homo sapiens
ttgaactcctcgcctccagaactgtgagacaatatatttctgttgttttaagccacccagcatgtggtacttggttacagcagccctggcaaacaaatacaggtttgtaggactgtatctttagagatgaaaaggagaacctcaagcggaaggaagagcatgagcttactggggtaagaatatgtatttatatattgagtgcattcagcagttcggttctactggaaccacggtctgtaaaggagccatgtatgggaaggttattgtggccaagtaacagaggctttgaatgctggaaaagacatctaaattttggagccaggcacggtggctcacgcatgtaatcccagcactttgagagaccgaagcaggtagatcacgaggtcgggagatagagagtatcctggccaacatggtgaaaccccttctctgctgggaatgcaaaaactagctgggcgtggtggcatgcacctgtagtcccagctgcttgggaggctgaggcaggagaatcgcttgagcctgggaggtggaggttgcagtgagccgagattgcagcactgcactccagcctggtgacagagcaagactccatc

SEQ ID NO: 250546 - DNA, 675 bp, Homo sapiens
cttatccctagccaaaaacaaaacaaaacagtaagccttctcatactctttgaacatatttgcctgcatctgaaatatcacaataacactcaaataatattattgccatctaaagatgtattcaggcactacaccaccagcaattataaaacatcccttttttgttagtttaagaagtttgcatgcaggtgttaagattatgggaaatcggtggtgaaatatacaatcaggacctacatttttttaaaaaaatatataaattcttgtaaactatgatttacctgtgacagcagagatcttttctctgtctctcagaatagtattgtcatttcttttttggcaagaagaagaggcccctcctcttctctctaagtgttaggctaatacttaggtttgcagtgtatgtttttataactttcagatggtgtgaccatcggaaacagggcaggcaaaaccatggagttaaaaggagaggagtcactaatttaaaggtgttggaggcattctttgaattggagcagtcctaccatgggccccaggggcatgatgtccttgcctagcctgcctcttggtgggaagaagcttctacatctgctcttggctgcagaaaagtaactttcctcattggagggacctgaggatacttaaacatccctaaaggcagcagccccagag

SEQ ID NO: 250547 - DNA, 362 bp, Homo sapiens
tctttgtaaatctatgtgctgcttttaggaaaatggagggcagagagttttcccacatctgcttcttcttgattgtctttagctcagtaattctttatattttggggaggcatattccggtctcccacaatcatatacattatagcttaagtatatgttcttaaaatttgaaatattgtattataaattttcaacaagtggaaatggttaagtaatttacaaggtatctactcagtgaaattttaaggagttattaaaatgtttctgacaaagaggtattaacaggaaaatgtgtgcaattatagcagatgaaacagtaaagtgaacatttttttgatatagtgtgaccttaacattgtaaa

SEQ ID NO: 250548 - DNA, 180 bp, Homo sapiens
cattgtcttttagaagaaacagagatgttgatatatgagaaatgtggtatggcaggccaaataatggcttcccaaagatgttcatgtctaaattcctagaaactatgactatgttacattatatggcaaaggagaattaaggtagtaaatggaattaaggttgctaatcagctgacctta

SEQ ID NO: 250549 - DNA, 352 bp, Homo sapiens
actctgcctttccatccccatgaaacactgagatgatttatatgaatgaaattgctggtgattttccaggtccaacatgagttagttagtaaatcttacgcaccatggcaggtggagatggagagatgatccttaggcagacccaggttgaccctagagttagaaaatattatttttccccatgcacacacacacacacacacacacacacacacacacacaccactagacaattcctcataaccttgacatgaaaatgccacagagtgagtggtaaaaatagaaaaatgcctgctttctgtagctatagaacatatgggaaaataaaatccttaaaatgacattagacgac

SEQ ID NO: 250550 - DNA, 444 bp, Homo sapiens
attttgttttttcgtagagacagggtttctccatgttggccaggctggtctcgaactcctgaccttaggtgatctgcctgcctcggcctctcaaagtgctgggattacaggcatgagccactgtgcccagctaggtttttttttttttttttttacctgtttagtcatgtcttaaataaacagtaagtgagaacttaacgaccttcagccttagtgccaactcgtctgtctgcatggtctcatacagtgcaaagaggatggggttcgggagtcagtctgatctgccttgttcactggttcctcagcctctctgagatcagtgttttcatctgtaaaatgaggatgaacacttaccttatattattttttgagcattgaaggagattgtacatgtagataagtagcacacgctcatcgagaaaagtttccatttttcctatcttt

SEQ ID NO: 250551 - DNA, 281 bp, Homo sapiens
tgctttcaatttggcatctgcaaaataagcattatgctaggtgtcgtgggagattcaaacaagtaaagatctagtcctttttcttgataaactaggctaggtgtggtagctcaaacttctgagagtttgacaacagtctgagaaacacagcgagaccccatctctaccaaaaaaaagtagctgggcatattggcatgcacctgtggtcctagttgcttcgggaagttgaagtgggaggatggcttgagagcaggagtttgagattacagtgagctgtgatc

SEQ ID NO: 250552 - DNA, 418 bp, Homo sapiens
gggactttaatattgtaccacagttagagaagatgtcaccattgggccgctgggagaagctgagtaaacagtaaatgagacctctctgtactatatttgtaacatcctgtgaacctacaattacttcaaaagaaaaagaaaaaaacgaaacaaaacaaccaaaaccctactctacacgtctatcaatagtaggcattcaataactattttattatatcatgagtccacctgaatttttctgttttctatagctttttttgagttgtcatcttgtgttgagtggatttccaccatgaaaacggttggccatgagttaataactgttataaagctggatatacagaagttcatttttacaattctttctacttttatatgcttacaactttccctagtaaaaatcaaagtaataaggcca

SEQ ID NO: 250553 - DNA, 485 bp, Homo sapiens
cagtgggaggagctcagggctgagccattaacaagacgaatgaaactgtcccctggctgcagagacctggggcccctttcaaagcgggctgcgtgggcagggacccaggggagtcatggccccatccccatgacccaggacaccccacaccctgtggtgaccctcgcccctcacggcttccctgcactccagagttggtccaggccgagagcctcatacccgggctcctgtggtcagagatgcagtccggcaccaagaaggcgggactcaggacactccagggcagtgcgtggttctgggcaagacaccctggactcagctccacagtgacatgctcacccacgacagacacacgcagagacagagacatgcagagacacacagagagatacagagatgcacacagatacacagtgagctgagatcacaccactcactgagctgagatcactccagcctgggcaacagagccaaactccggctca

SEQ ID NO: 250554 - DNA, 515 bp, Homo sapiens
tgcctatagatctttggaagctgaaacaactttctcctgatattgggagcttcaaatcaatgtgttccttctgtctggcaaagggtcactcagatttcagtggcagaactttaacttcaacctctgcttttgtagtcaagatgatgttgcgacattgaaatcactcttttaaggaaaatgcactatagtttcatgatctttaaggccaagtttacctaagaccaggaattggaaatatcacagcctcatccagtagaactttctgtgaaaaggaaaatctatatctgctctgtcttatatggtaactactagccacatgcagcaattgaacatctgaaacgtggcccatgtgatggaggaattgaattttaattgtttccttttaattaatttaaattcgaatttaaatagtaacatgtctcttgactactatattgaaccactgttcacagctcttaatatatatttatctgcaggtgttataccaggcaattaaaaatgtttgttttaattac

SEQ ID NO: 250555 - DNA, 798 bp, Homo sapiens
ccccgggtgaagaaaaaaaaaattaccttttgaaaaatccccgggagggggccaaattttagatgcgccttttatggaaatggaaagtccaataacctttctatatttctttgtttctgtttcattactaagaagagcttccctctgtgccatttagttgaaattcaatagagagggtctacgactggcccattcgccaagccacaccatacaagtccaaggctgctgaggagattgtggattagctacttatagatcagctgtccaggcatggtccatttagctatgggacagatagggccctgtcctgtgatacggaataagggccttcaaggcatccttgagatgaataagtcaatgaatgaataaatatcaaagcaatctggacagggcaggcaataacagggatctctatcacatctgctttctctccatcagcaagcagcattttataagagcctgtctcccctggatctcccttacactcaacatgtaatctgaaaaatcctttctgtggcctgcatttctttgcaagactcagttcatttggaacattagtgttctgacagttgtttttgtttccttctttctagttatatatcaacctttcgaaatctaaacccaatggcgtatgtcagtacaaccaggcaggtttttggtaggacttcactatcaaggtggcattatgactcttgtaagccctaggaacttttactttcataagccccatcctcaattaaaaaaacattacgactatgttggtataaggacaaatataatacaaaatagacagataca

SEQ ID NO: 250556 - DNA, 484 bp, Homo sapiens
cttctgtccagctagcaagaatggcacaggaggctcagggtacacttctcattacaaggccttaagggaagtgctgcttctccacacagagcagataggacaaaaattgggtgtttgcacaaagggagcaatgattccataaggaggtgaaagtaacacatagatttgtcaccttatttacattttctatcttcttgtctctaggcaaagggggtaacagaaacctgcttagtgtttttataaagtaaattctgcctagtatcattgaatttcctttagcacatccatagacatacaacagaacagataggagaaagaaacataaataacaggaagtgctgggcgtggtggctcacgcctgtaattccagcactttgggaggccgaggcgggcagatcacttgaggtcaggagtttaagaccaccctggccaacatggcaaaaccccgtctctaccaaaaatacaaaaaattagctgggcgtgg

SEQ ID NO: 250557 - DNA, 541 bp, Homo sapiens
caagagtttgctttctgttgacctttatcagtggaagaatttctcaatgctgagagcaatttttccaatactcttagatctaaaaatgctactgactggattattcatgtttgaacatgtaaaaatattttcttgttaaattaagtttaatcttatacttaaagttcgctgtgttatggagagaactttgaagcaagaatcagaaatcaaataacactaatgcttcctaattagagaaatctctattcaatgcaaactaaaaatatattggctggtgttctaatcagctgtgcttaattctaagcactaaattctgaacactgtgggtaaaacactttgttcatttcagaaatagctagacttttcctaaactctcattaggaaaaatagaagaaattaagaaaataaagctgggcacggtgacttacacctgtaatcccagcttctcaggaggttgaggcaggagggttgcttaaggccaggaattcaagactagtctgggcaacatagcaagatcccatctctaaaaacaaaaacaaac

SEQ ID NO: 250558 - DNA, 269 bp, Homo sapiens
gcctttttcaaatcaaacccaattttcagtctagttggatcacagtggggttaatccatagtgagaattaaaaggaaaaaaagcagcaaaaaaaaaaaatcagcataatcttgatctgtaatactgctgccagagtaatgtttcttagtgttacttcctatggttgttgttttgtttctttgtttgggatttttttttcttgaataaaaggtcagccagtttccctacacaaaaaaaggagatggaaagacgtataccagaggttacaa

SEQ ID NO: 250559 - DNA, 557 bp, Homo sapiens
tctttgtaagaggaaaaagtaaatgcagtccgaaaggatctgtagccacaccctagaaaaggtcctggtttactgctctgtgacagacttagaatagaccctgggcacactttcctgacagagagctgcaaagttatattgccctgctcacaatacacagataagccctcctacttcctgaaatagagcaaagcaggagaaaaggaagaatgcagtgaaggaccagcacagtgattcatgcctgtaatcccagcactttgggaggcccaggcaggtgggttacctgaagtcaggggttcgagaccagcctggccaacatggcaaaatcccgtctctactaaaaatacaaaaattagccaggcacggtggcatgcgcttgtagtccaaggtactcgggaagctgaggcacgagaattgcttgaacccaggaggcagaggttgcagtgagccaagatcacgccactgcactgcagcctgtgcaacagagatagactctgtctataaataaatacccaggagttccagaccagcctgagcaacagtgagccctcatctct

SEQ ID NO: 250560 - DNA, 488 bp, Homo sapiens
ggtgctctgcatctgccaccgtgcagattgttacagcaactcaccagaccacaacttgcagctcacaacacaacaggaagcttaaagatgctttgcttgctaaagtggaaggctgaaaggagcagaaccagaagagtgctggagagatggatgtgggtggcgtttgttttatgtacttacaaaagaagagctgcaagtagcatatgaatctccggttcaattagacaaacttgtagagaagaaaaagaacttcctcaagaaactgaccaccaccctggagtggttaagaattgaccactcaacaacgctggattatagcaaataaattttcacgttagattgttaaaaaaaaatagtgaacccttacacagcatttgttatgtgtcatgagtttttctgagtttttcatataatagcacagttaatctgtatcaaatctttgagttaggtactgtatatgatctctattttataaatgcagtaacggt

SEQ ID NO: 250561 - DNA, 380 bp, Homo sapiens
tatattcaacatacattttataatcagaaaaataatatatactatttcttaaaaattagttttggggctgatgacaaacatatttataagtcacatatttatttctgaaggttttaagtgagtaaacctggactttaaaaaatgttgggccatgtgtggtggctcatgcctgtaatcctaacacttggggagggtgaggagggaggattgcattaatccaggagtttgagaccagcctgggcaacacagtgtgacaccttgtctctacaaaaaactaaataatcagctgggagtggtggtgcatgcctgtagcccccgctattaaggaagctgggatgggaggattgattgagcccgtgaggttgaggctacagtgagct

SEQ ID NO: 250562 - DNA, 825 bp, Homo sapiens
tacaaaatcagtgtagcaaaataagtaacatttctaacatgcaagtgtgagattatcaacattataataagacagatagctgagagatttaatctctcccaagtcagcctccttctgacctcctatttttctctgaatggcaccatcaggtagcttctcttctgttgtttcccacatgaacacaccactcatagcctaattattccaatgttattatctttcacatgagtatttatttcaaactagacagccacagatagatgagaactgtgaaatacatagcatgagagattctaaaatatgtgggaaatgtagggcaggaggtagacagatgctgagcaatgcatacccagtattttttcctcattcttgatggtgaagaagtgagtaatgggctagctttgttattctgacagaggtccctccacatggaaacatgaaacaaagtaaaaacaggtttacctataacacaacagtgcttctactataaggaattccctcccgaggactttgtactcccttcccgtggcacaaagacccctacacttagggaatgataagtattttaaaatcattttttaactaaaatataaggagcatagcttaataaaaagaagaaataatttcaacactaaaggaaagagtacttctgactaggaggccagaaggttgggttttaattctggttctgcacttaaccactttgagtcttgtctcagtttcttcatctgtaaaacaaggagactggtagcatatctttaaagtttcttccaacttaaaatcctgtgattttgtgaaaagcaagtgaagaatcaatttatttaa

SEQ ID NO: 250563 - DNA, 218 bp, Homo sapiens
gcagtcttttcaacaaatgatattgttaaaatctgggtatccacatgcaaaaaattgaagttggagccttaccttacatagtactgatcttgaactcctggcctcaagcaatcctcctgactcatcttcccaaatgctgggattacacacatgagccactgagcccagccagaatccaggttttcatgtgagatctcatttctaactgttggaattaa

SEQ ID NO: 250564 - DNA, 516 bp, Homo sapiens
aatgggggtcagcgcggcggaaccgagtggcagaccgaaaagccaatcgagatagagtactgggatgatgggcgggataaagaagcaatcacagaaaagcagtcggacctagtcaagccggagcagccctctagcgtcccaaacgaggggttcctctccgccccgtggttcctatggatgctgtttcccctcccccgggccaggtgtgagcacccaactggattgatgtctgccgcctgaaatacacttgatctgcgtttccgaagccaagcctcgcaccctgcaacaccgcggttcccgccctcttgggagccggagcgaggaggcggcagggtgctggatcacagtccctgcacctgcagaatgcggatacctctcgctccagatagggcgactgcccccgacctgtgctgtaccctaagttggcccgtctggcctctgtgctccagccctcttattttgggaaacaggagctacttaaataaaagctaaagggacctcagaggttctgaagta

SEQ ID NO: 250565 - DNA, 416 bp, Homo sapiens
ctctttagggaaaataagaggtattagtgctatacattttaacaacacagcacatgatacttttcaacttattttctgagttcagcataccaaacctgacaatatactataagaaaggaaaattacagaccaacatctgtcatgaacatagacacaaatatcctagagaaaatattagcaaatgtccagtgatacatgaaatacataatcattcatggccaggtagtatttattccagaaattcaaggttgatttaccattggaaaaatcagtttaattgatgttagtagaatgagggaggaaaaaactctagatgattagctcagtagagaaagtgttctgttacttagttacattaaacactctgcaaaggaggaatagagaaaaactgttttaatttgatgaaggaaatctgc

SEQ ID NO: 250566 - DNA, 586 bp, Homo sapiens
ggggagaggacggaaggacagtcagtgtccagcttggttggtagatgggtaggtcagatggagatgagaaagaccttttcccctcatcactctcacgcagttaatccagagccccttagagaggtttacaactggagctgctatttaaaggcctagatgagaatgtaatagtaataatgatcctcatttttattctcagctgacagagcaagggaatgtgtgtgaatgctaatccatgcacatacatgtctataaatattctgcatggaaccatctgtgtctatgtcaagctaaactggggttcataccagggtctccaaccatagcccatccccactggggtccttccagctcactcggcttctggatgtacgactcccacaggtggaggaaggcccccagagaagtctgctgaaaattgttattcatgaatggaggttggacttcttcagatacacttcccgagtctgttaacatggtgatgtgacgtttgcccttcatgttactcatagggactattctgttagctaccaattctgctgctttaaataaaaacaccattaaaaaacaaaaggaaacaaaaaaa

SEQ ID NO: 250567 - DNA, 476 bp, Homo sapiens
tggggaaaagggggaacctgctaaaacccgagagataatgggcttgtaaaaaccagaggggtccgcttatgagtttagctccggttatagacaacagtgtcaggtaagctgatcagaaagacagacggcctctccctcaggtttgccgagggagggttcagaaaagaaacagggagcgccttcagcagtctatgcggttataggccattttcttgttttattagcgtttaaattaaactatgagaagaaagtctcatcttccctccctcgccactttgtctatttgttttggaaagagggtagaagaagcccctctgtcttcccgaaaagaagaaaggggaaaaaaattacctggtaggtccaggggcagagggctccctcccaaaacccaagcgcgatttgcatccaagctagtgggaaagcgcgcatctcatcatctgggactgttcctgattaaaactacagtaaaaataaat

SEQ ID NO: 250568 - DNA, 462 bp, Homo sapiens
catatcacaaaggttttaatatacttaaaatgtaacaagtctctaaatatagggaagaagactaccaacaatcacatgtaagcatgttagagacgtgaacaaacaatataaaggaaaaaacagaaatggcttttaatctcattgaaaaaattttaaaaatcacctcaataccactttagagacaaaattttagaagtttcacatgtaactatgttagtgtggctgtacacacattgttgctaagaaagccccattaggcacttgtggagaggaatttggcaacatttagcaaagttgcaaagcagtaacactttgacctacaatccaacatcttaaaatccatcctgaaggagactggcaaaaattgaaaagactggtgcacaagaccattggttgcaacattagaaaatgtagagcatacttctaaacttgaatgtcaataaaaatcataatgcaattaga

SEQ ID NO: 250569 - DNA, 551 bp, Homo sapiens
gtccacctctgccctgcccaccagcagccatgccagccagtgagctgtgggtgaaaacactgctgattgcaaaggaccactcaaccgtcaggaaagctctcggctcatagctttgtcttttgtccagctgtcctggacatcctatctttcctctagcccctagccctgacagagagcctcaaagttgttttcatcttatctgctgaggatctgactcaccccatcagacttctgggagggagagagcgagcgcgcctcgagcccggaggggagaaacccttagtgttgtcacggtttaggcacacgctcatagaaatccttgcagctcgagctcttcaaaatatgattagaccaattttacatgtctagtcactgaggctccagtagattgggactatttctatatgtgcaaagtgaagtggataattgaggcaattatcttcaggcaaatgaatctgggcactgtaatcagtccatcctgataactggggagaaatcggcgtcattcactgtagcattgctttgcgttaaagagaattctaaggtaaaag

SEQ ID NO: 250570 - DNA, 572 bp, Homo sapiens
ggctttgatgtcatgcagaataaatacaaaagcaatcaaaaatcatcatattttctaaaaacagttttccatttactccttcttatctatcctctatccttctcaaccctgctctgtgctctggaaaaacagtctttaaagaaaggcattaacaggctcccatgtcctctggcttctggtagagttagaagaattgggaaggccttaaatatagtagcttagtttgaaaaatgtgaaggactttcgtaacggaagtaattcaagatcaagagtaattaccaacttaatgtttttgcatgggactttgagttaagattattttttaaatcctgaggactagcattaattgacagctgacccaggtgctacacagaaggtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctagg

SEQ ID NO: 250571 - DNA, 465 bp, Homo sapiens
aaagggatggacaaggaaaggggcagggataaggtgctgtgagacccgggaaaagctagactctcaggagaggtggggaaagcctggggagactctgaggcaaactcagaactggtgaataggcaggacaattgtcccgagggttttggccacctgccacctgcctggggcagcacagcttggtgcaagagccactgtttgtggccaggtggaacccctgccctaccacctaccagctggtgaccttagcaggggatagcctttgcagagaccattcccctttctgagaaatgaaaataaccccttcctcacgctgatatggtgatggtaaatggaataaaatatataaagttgtatgaataaattaatttttaataaatatttatatataaataaatatatacagttccagtttagccccaaatagttgctgccatcccccaggaagcagagcatctcacaggg

SEQ ID NO: 250572 - DNA, 397 bp, Homo sapiens
ctttgtgtggtcactagtcagatggtttaaaggcaaatggaaaataggtgttaattttgatagttcattaaatcaagattggttaggaattatttttggtgttttataaccctcattaaaagttagataaaatgaaacagagagtttaagtagcatattcaaggacaaacaggtagtaaatagcaaatcaaaaagcaaacccaacccactagcaagagcccagccagcatccagctctttacatctgatggtgttctccaagaaagggaaggagggctcctggagaaatgactggttccagttcagaagcagaaaactcgcaagttgagcctggagcaccatttgccagaaattcagaaagtattcacaaaacaaaaaaatacaaggcaaatacaaa

SEQ ID NO: 250573 - DNA, 591 bp, Homo sapiens
tttatgagctacatgagtgtcattgcacgtatggggtggagtgaagggtgctcagacgcatgctaacacatacgttgcatgatcagaaaatggcagataagcccctccctgggtgaggactttagtattatcataagaccagggtcattctcctggccttgtgcacaagcaggtgatggagtcaactcccgtcagtaagacttatggcgggatgctgcttatcttagtttatttcagacagttggcaaggtctggccagcgagtatggcacctggagggtggtgctgcaaggtctagtggtcagcgggcacgtatggaacaatacgttagtgggggtgggccgagtcccatttatactctctcagcagggccatgctccctctgaaggcactagggaaggattagtttcaggcctctcttcagcttctgttagtttcttggcttgtgacaccaaagctgtaatctttcttttgttttgtttttgtgacggagttttgctcttgttgcccaggctggagtgcaatggcacaatctcggctcactgcaacctcctcctcccaggttcaagcaattcttctgcctcagcctttg

SEQ ID NO: 250574 - DNA, 602 bp, Homo sapiens
attctgattatcttggtggaatcttggaaaagctaagcagcttcactcttaataaacagaccttgatcagcaacaagtagtgcagagggagctccttacaactcgaccagtgaacccaatttgagaactgaaggagaaatcaatatctatgcagatcagttccacagggaagacatcctatggggactgtttcttcctgggatgagtagaatggaagccctatgcataattcagttcgtggagaagagcaaaggctggactcatggtcccaatttggaggtgaagcatggtgacaaacgtcaatgggaagcatacacattgcaaagtggcttctctcagcgtctgctgtaaacaccgggtcgtgagttgtctgtgagtgtatgaatgaaaacattccatagagattgtgtggccataatacacaaggagctggactccagcaaatggcccagatcaacattctgaaattgaacttagaaaactatcagatatctggaagtgaagtaaagcttatgaagaaaaaagcagtgtggaactgcagtgatttaaaagaaacaagatgggacccatacactcagcattaaaacatataaatctgtaaa

SEQ ID NO: 250575 - DNA, 320 bp, Homo sapiens
gctgatgctggaatgcttttctcaggactgcttcctgccatcttcctccacttcaatctcacaggtttagagcaggcagtgacatcttctttctgatgcaactgaaatgatcttaagatagaggctgcatttcagcaaaagtaccagacctcgaaagaagacagggcatacctagcatcatttggaagaacttagaaaactatcagatatctggaagtgaagtaaagcttatgaagaaaaaagcagtgtggaactgcagtgatttaaaagaaacaagatgggacccatacactcagcattaaaacatataaatctgtaaa

SEQ ID NO: 250576 - DNA, 141 bp, Homo sapiens
gcagaataaaaataaattttattaatctcagtgacttctaaaaaaataagtatttgatagatagatgagtaaagagtttgcccagctttcatagaatgatcaacaaagcaaaaagaaaggaggctgttgctgctctaccac

SEQ ID NO: 250577 - DNA, 694 bp, Homo sapiens
tatctctaacattatggtacagtgtggtacttaaaaaaaaatttttccccccaaagaaatgtccgtaacatttgagtaaacttatttttctcaaggatctgggagtataacctgaagactcaccttaaagaaatcctgttttgcactttatttcatgataaatctgtcgtgttttaatgttaaaatgtttttaatgaggataccctaatggttaagagtgtacgttttgagtctcacgaacctgatttgagtcctatttctcccattttttagtaatatagcttctaaaagtactagtacctatcttaataggattattgggaggattaaatggctgtttaatgtgctacctgatacacggtatgcctttgataaatgttaactattaactactgttgttactatcaagtaaagtatatgttcaggaaaggtgatgtttttattttttatttatttatttttttgagatgaagtctcactcttgtcccccaggctggagtgcaatagcacgatctcggctcactgcaacctccgcctcctgggttcaagccattctcctgcctcagctactggggaggctgaggggcagaggatcccttggacccagtagatggagattgcagtgagccaagatctcactgctgcacaccagcctgggtgacagagtgagactctgtctcaaaaaaaaaaaaga

SEQ ID NO: 250578 - DNA, 400 bp, Homo sapiens
ggattatacagtagtattcagtgaaaatgtaaatgtctccctccattttcttcccagagttaaccagcgctgtttaatggtctcgaactcaaagggaagtaggctttgctctgtattggatactgtcaagaagagggcatatgaagctgggtgcagtggctcatgcttgtaatcccagcactttggggggccaaggcaggtcgaattgcttgaggccaggagttcaagaccagcctgagcaatggcatggtggtacacacctgtagtcccagctactggggaggctgaggggcagaggatcccttggacccagtagatggagattgcagtgagccaagatctcactgctgcacaccagcctgggtgacagagtgagactctgtctcaaaaaaaaaaaaga

SEQ ID NO: 250579 - DNA, 533 bp, Homo sapiens
gtaacagggcctgttgcaatgtttgtattcaatacataaggtgaatatactttcacagttggaaaacgacatcaatctgaactttgttttatagctcctgaattaatatagagctactggctaaggaaagaaacagattttactattttatgcctttgtggaatgcacaagatcattctaaaggaacatttcaaccgcagtgtttaggatcaagtcagacattactgaagctgcatgagcacagacttcgctcccctcccccacgaagaccccggctcttctttgctgtttcctacaattttcttagaattacgtgctgcaaagtctcctcaaaagtcacaaagcactaagtagccaaaggagtcttcccatacccttgtttttctcagtttgacagggatcacagctccattcctccagtaatatccatccaaagttacagcttatttaaaaataccccattgaaagagatgcactttagtaatcaacacaagtgtgactgattccaaaggacttcgtagatgcctaccgta

SEQ ID NO: 250580 - DNA, 295 bp, Homo sapiens
ttgctggatggttttgctattattggttggtgggccctttgcctgtggaatgtatttcactcattctctcctgcacgctgttaggcagttctttcacctgcatgcttcttcttttacctttttgtctacctcatagtccctctctcccctcctttaaaagaattataaatattaggaaagcttgttgttataaattaaaagtttacatatgtatcttgagttcttcataggggaagtgttattttaaaaaattctaaaaatgaaataaatattgttattttattgagcatgaaac

SEQ ID NO: 250581 - DNA, 1008 bp, Homo sapiens
accctgtaggctaggggagaggcctccggatagctggagacaggagtcggccgcgaagaagttgaggtcgggaaggaaaggtgaatcctggcgccccgagaagacgtcttctgcagaaaaaaaggcgtttccccaaccagcttccaaaatcagccatagggagagaaagagagagagagacagaaaaaaaaaagacgctgttagcggccaggcctgaaccccagtgggatattctacttccccatcccaggaatggagggggactccagcgaaattacagggaattcgtggtcacgggaccggcctccgccaatcgctcgtctgggcctggtggaaaacagagagcattatttggtttaattgattcaaaaacaccagaggaccacgaccaggacaccatgagcccccattcctacaccagtgcctcacatgctctctccccaatgcctccgtttctccagaaaagctagaggaaccttttcctcatccccttcgaaggaaaagatgagtgaggatctccgcgttggaggaagagggagtcgaaagaggcttccactctttgaaaaagacccaatggtggttgggcttcgggtcacgtgacaccttctttgtggctccggaagaggattgtgaagtttaggtttcgtggaagaaaccgataattgaggaaaaaaaaaatcaagatttggggggaattacctacaaagatgtaaggtgtgttaatttgggcgcttcttggattctaccctgaggaggaggcgcgtggtgagaggagagatcttgatctgccgctcgctgaggttcagcaggttggccatctctacacggcgaggccggcacaggtagcggttaaaatggaactccttctccagctccaccagctgcgcgctcgtgtacgccgtccgcgcccgcttggacgccgccgccaccacagccctctgctggatccgagggggaggggtgggaaggggagaaaatgaaataaaagataattactgaacacgccga

SEQ ID NO: 250582 - DNA, 1002 bp, Homo sapiens
accctgtaggctaggggagaggcctccggatagctggagacaggagtcggccgcgaagaagttgaggtcgggaaggaaaggtgaatcctggcgccccgagaagacgtcttctgcagaaaaaaaggcgtttccccaaccagcttccaaaatcagccatagggagagaaagagagagagagacagaaaaaaaaaagacgctgttagcggccaggcctgaaccccagtgggatattctacttccccatcccaggaatggagggggactccagcgaaattacagggaattcgtggtcacgggaccggcctccgccaatcgctcgtctgggcctggtggaaaacagagagcattatttggtttaattgattcaaaaacaccagaggaccacgaccaggacaccatgagcccccattcctacaccagtgcctcacatgctctctccccaatgcctccgtttctccagaaaagctagaggaaccttttcctcatccccttcgaaggaaaagatgagtgaggatctccgcgttggaggaagagggagtcgaaagaggcttccactctttgaaaaagacccaatggtggttgggcttcgggtcacgtgacaccttctttgtggctccggaagaggattgtgaagtttaggtttcgtggaagaaaccgataattgaggaaaaaaaaaatcaagatttggggggaattacctacaaagatgtaaggtgtgttaatttgggcgcttcttggattctaccctgaggaggaggcgcgtggtgagaggagagctccaccagctgcgcgctcgtgtacgccgtccgcgcccgcttggacgccgccgaccccggggggctcttgtcccctcccccgccgccgccgccaccgcccccgctgccaccactgcctccgccgccgccgccaccgccgccgccaccacagccctctgctggatccgagggggaggggtgggaaggggagaaaatgaaataaaagataattactgaacacgccga

SEQ ID NO: 250583 - DNA, 578 bp, Homo sapiens
actgagcccggagctggaactagaaactttctgtcagtgtaacatctgcacccaatggtggttgggcttcgggtcacgtgacaccttctttgtggctccggaagaggattgtgaagtttaggtttcgtggaagaaaccgataattgaggaaaaaaaaaatcaagatttggggggaattacctacaaagatgtaaggtgtgttaatttgggcgcttcttggattctaccctgaggaggaggcgcgtggtgagaggagagatcttgatctgccgctcgctgaggttcagcaggttggccatctctacacggcgaggccggcacaggtagcggttaaaatggaactccttctccagctccaccagctgcgcgctcgtgtacgccgtccgcgcccgcttggacgccgccgaccccggggggctcttgtcccctcccccgccgccgccgccaccgcccccgctgccaccactgcctccgccgccgccgccaccgccgccgccaccacagccctctgctggatccgagggggaggggtgggaaggggagaaaatgaaataaaagataattactgaacacgccga

SEQ ID NO: 250584 - DNA, 425 bp, Homo sapiens
cggggggctgccggctggagatgggccccccgacgacgaggccaatcccttggccttctggtccttcttgtacttcatgcgccggttctggaaccagatcttgatctgccgctcgctgaggttcagcaggttggccatctctacacggcgaggccggcacaggtagcggttaaaatggaactccttctccagctccaccagctgcgcgctcgtgtacgccgtccgcgcccgcttggacgccgccgaccccggggggctcttgtcccctcccccgccgccgccgccaccgcccccgctgccaccactgcctccgccgccgccgccaccgccgccgccaccacagccctctgctggatccgagggggaggggtgggaaggggagaaaatgaaataaaagataattactgaacacgccgaaattgaat

SEQ ID NO: 250585 - DNA, 175 bp, Homo sapiens
ggctctaagagaaaataaaatagaaaaggattcctgtgaacctatttggattgtttttcagaacacaatccaaataggtttttcttaagtgaaaaagaaaaaagacaaagtgcaaaagaatatctattatgtgtcaacttctatgaaagagagaccaaaaaaaaaagaaaaagaa

SEQ ID NO: 250586 - DNA, 639 bp, Homo sapiens
atgaaggcatttaacattcataatttatattttaaaagtaaaatactcctggatataaaaaaaggaaaaaagatataaaaacaaatgagagaaaaggaaggaaatggattactcacaatatctaaggtatggaagcaacctaagtgtccatcaacaggttaataaataaagaaaatgtgatatatttgcacaatggaatgctactcagccctatggggtaaataagacggcacagaaaaaaactttcataatatcatttctatgtagagtataaaaaggtttaaactcatagaagcatagggtagaatgatgattgtctggggctgggagtggaggagatgttggtcagaagtaatggggctgattttgtgaagagacgaagactgagcggttgtggccacgttgccgacctcgagcagcagttggcttctccacgtagaacctgggagtaggagactcagaatcgaatctcttctccctccttcctcctgtttttggctttgtgggaaccttatcaaacacaatggccagcaatgttaccaacagaacagatcctcgctccatgaactcccatgtgttcactggaaatctcaacactcttgtggtcaagaagtgtgatgtggaggcaatcttttcgat

SEQ ID NO: 250587 - DNA, 339 bp, Homo sapiens
gctccgaccggggaaagagaggcagcggctggacaccagcacatgtaactgaccgcccagttgtcctctttcgccccaggatccccgtggcaggaagggttagctaactgctcgctttagcttacccagacctgccattgactgagggaccgacctcagtgaatgattaatgacgtgcgcgctggatttcaacctcaggaaacccgagaagggaaaatttccttgagaacagagaatttccctgtacgggcaacgtccccagactgttatttatctgggaaatacacctgacttgcatgcttggaatgtttctgtctaaaaacatatttgaaactttaa

SEQ ID NO: 250588 - DNA, 438 bp, Homo sapiens
ataacaaatagagaaactgcacaaaagtacagcttaatgaattatatataagtttacaaaggttaacacccttgtaatcactgcccatgtcaggagatggttcctggccagccagttcagaagcctaccacatttccctaccaattgcttccccatcagaggacctgcagtcttggcttttatggtgatcattttcttatttaacctaatggtttcattccttgatgatcattgcctcaatcagttatcttattaggagttgcaaaatggtgattttctaatttcctccctatcacactgaaatttcttctgtaaaaggaactttttcttcatcctccaagactgcttgatcaccctgatgtacagtttgtatagtaaaggcaagataattttttttctttttaatggacaatttttgtaaaaaggagttggcggtct

SEQ ID NO: 250589 - DNA, 420 bp, Homo sapiens
ataacaaatagagaaactgcacaaaagtacagcttaatgaattatatataagtttacaaaggttaacacccttgtaatcactgcccatgtcaggagatggttcctggccagccagttcagaagcctaccacatttccctaccaattgcttccccatcagaggacctgcagtcttggcttttatggtgatcattttcttactttatattttgtcattcacgtatgtaaacagtatttggttttgcctgtcttaaatctccataggctcctcttttatctctcttttttatttattttttattttttgagacggagtcttgctctgtcgcccaggctggaaggttgcagtgagctgagatcgcaccactggactccagcctgggtgacagagcaagactctgtctcaaaaaaaaaaaaaaaa

SEQ ID NO: 250590 - DNA, 363 bp, Homo sapiens
attccttgacaaatctatattttgtgatgaggaggaaaatagttctaaactttactatttatttggggaacctagaagcaagaactgttaatgaatcaaagtgcttggtggtgtgtgtgggccagggggagggtggattattttgtaagccattaaaagcactgtgtccagcagcttgggaactacctatctataaaagttagaaataaaatgcagctgacacccagcttctgtgtaatgaagaagtaaaaattaaacaagacctgtaaccccggcactttgggaggcttgaggcaggcggatcacctgaagtcaggagttcaagaccagcctggccaacatggtgaaaacccgtctctacta

SEQ ID NO: 250591 - DNA, 368 bp, Homo sapiens
tagaattatagcaagtatagcttgacctggtacctgatacacaggtgctcaataaatacgaattattattttctacaaatattttataatagcaaaaactgagtaaagtataaatgtagaatttgcaatctctgcttatgaaaataattttcaactaggtgacaagcctgagtgtgactcattgcactcagaagggtcaaatgtttgctatgttatttgtatggttttttattaactattacttaacttctagatggccttaacaatctgtttcttaatatccgaaagctgccaactatttagtcttcctcttatttcccattatattaggcctagatattaacaatacaagtgtataaaagacaaaa

SEQ ID NO: 250592 - DNA, 724 bp, Homo sapiens
agtgtccagaaggaaagttagccgccacattgtccgagaggaagaggctgctgtgcctgctcctggtactactggcatcacatcccatgggcacatctgtgctccaggtgctcctgctcagcaggtgtacctgcaagagactgggaactggaaggagggccaagagcagttgctcagataccagctggcaggccaaaatcagctgctgctgctatgcccagacttcagacaagagaggcagcagttgccagggcaaagtcggctgagtaagcaaagtggcagcttggggctttcccgagagaagaaagcctcctgcggggccactgaggcattctgccttcattcagtacacccggaaactattcaggagcaactgtgatcagggaagttgggggcatttggcctgaaaggcagaatgttcccagtatttctggataataagctggggaagtgaggactgtcctgctgggacaactaagaagagagaatgtggactctgaatccctttttcaactttaaaatggaaaacagtcatataaatgcttacagactgaaaaatgtctcatacatattttgcagctatcatgatcctagttcaatgctaggcaaataatggcacttgttaattatttaccagtttttaacttaagcctgattttaacaacttgataatggtgtaatactgacttataccagcaggggttattattaagcattctctgga

SEQ ID NO: 250593 - DNA, 554 bp, Homo sapiens
agtgtccagaaggaaagttagccgccacattgtccgagaggaagaggctgctgtgcctgctcctggtactactggcatcacatcccatgggcacatctgtgctccaggtgctcctgctcagcaggtgtacctgcaagagactgggaactggaaggagggccaagagcagttgctcagataccagctggcaggccaaaatcagctgctgctgctatgcccagacttcagacaagagaggcagcagttgccagggcaaagtcggctgagtaagcaaagtggcagcttggggctttcccgagagaagaaagcctcctgcggggccactgaggcattctgccttcattcagtacacccggaaactattcaggagcaactgtgatcagggaagttgggggcatttggcctgaaaggcagaatgttcccagtatttctggataataagctggggaagtgaggactgtcctgctgggacaactaagaagagagaatgtggactctgaatccctttttcaactttaaaatggaaaacagtcatataaatgcttacagactga

SEQ ID NO: 250594 - DNA, 231 bp, Homo sapiens
agatcacacgtgggcttggagaatgaatgcaaggttttattgagtgaaagtagctctcagcagatgcgggaaccagaaggaagatggttttcccctggagtctggctgctcggtggaccgggttctcccccagctaccctggccaaactccacctcgttctgctggtcgatggcctgctggcatgctggcatctgtcagtgtgcttttccgctggcatgctcccctcgatg

SEQ ID NO: 250595 - DNA, 589 bp, Homo sapiens
gatgtgaataatctttgacccagcaattccatgtttaaacctctacatagtctctcctcgtgtttcaaggagatacatatgatggtccattgcagaactgtgagaatgagaagttgaaagcaatctaaccattaggttaaatacaagatagaatgcaaactaaaatgaataactagagatatttctgtcaacatgggtaaacctcaaaaatagtattaatgaaattgaactacagactattttatataatacagtataacgtacaatttcaaaacatgcaaattagtgttatgtatttttgtcatggctaaatactatataaaaaggatctaaaagaattaataaaataatcatcagattcagaacagtggtgacctgcagggagaaagacaactgagattggggaaaggatgcaaatgaaaatacctttaattattcatttcttttaaaaataagcaaatactgtatagccaattcttaaaatttgataaagctggctgtgagtatatgagtcagttcttactctctgtatctttctgtataaactatttcataatgcaaaaaaataaagaatatttaaatgaaaaaa

SEQ ID NO: 250596 - DNA, 300 bp, Homo sapiens
cccacctcctagattcgagcgattcttgtgcctcagactcccaagtagctgggaccacaggcacataccaccttgcctggctaaattttgtatttttagtagagatggggtttcaccatcttggccaggcttgtcttgaactcctgacctcaagtgatccactcgcttcagcctcccaaaatgctgggattacaagcataagccaccaacacccgccctctgtaatgtgaacctatcttacctagacctgaagactgtattcagagatattttccagcaaataaaaccttcagaaatctt

SEQ ID NO: 250597 - DNA, 490 bp, Homo sapiens
gtctttttctttctttcccttaatatgagattacatagattttcgtaccatggaccatacttgaattccaggagtcaatcccacttgttcatggggtgtaatcctttaaatgcactcctttggtttgatagtattttgttgaagatttttgcattagcattcataagggatattggtctgtagttttcttgtggtgtctttttctggcttttgtatcagggtaatactggtgtcatagaataagtcaggaagtattacctcctcttcagttttttgaaagagcttgagaagacttggtggtaattctttaaatattggtagaattcaccagtgaagccatctggtccagggcttttctttgttgggagtttgtttttcttttcttttctttttttttttttggattaccaattcagtctctttgctgaatctctttgctaaatagatttatttaccttttctgtttcttcctgattcaatcgtggtaggt

SEQ ID NO: 250598 - DNA, 435 bp, Homo sapiens
cctgtaatcccagctactgaggaggttgaggcaggagaatcgcttgaacccaggaggtggaggttgcagtgagctgagatcacgccactgcactccagtctgggcgacagtgagactctgtatatataacatatatataatagtaagcttgagataccatatatatatgttatgatctgatgacgctaggtaatctagtaggtctcccttctacatacaagacatctaagggatttatacagggcaagcagcatttgttgccaaagctttatcatctggggccatctacaaagataaaacatttctgagattgcagtcagtacatcccacagaacttcaaagcttttacagcaatctgaggtaggagttttgtaatgattattttcttcagttacaagattaataaacattttgattagaacttaatggttgcag

SEQ ID NO: 250599 - DNA, 235 bp, Homo sapiens
tagattgaaaagttttttagaagaaaagtaccataggaatcttaccaacaacaacagaaatgtcccagtattggtggaaacaagtttctcagtgaactgagttaataggaaaaaaggagcatgtaatatttaaaatcatatttggccaccccgcccagccaggtttctttttattgttgttgttgagatggagtctcgctctgttgcccaggctggagtgcagtggcacaatcta

SEQ ID NO: 250600 - DNA, 292 bp, Homo sapiens
ctccctcctttggagcctacagtagcttgttcattgccaggaaatggtctacataagtctgtctgaaccatcagattaggagtgtctgcagggcgggttatgtgtcaccagtatgtagcacccagcacaggtcctccacactgtcaggcctcagaaaatgtgggtggatggaacgggatggaggtgggacaggggtcttctttgcccatgtgacagatgagcacatgggcccaggaggcaggggagggggacttccaaatgcagagcactgggcaggcattccctccgttcg

SEQ ID NO: 250601 - DNA, 554 bp, Homo sapiens
tgtgagctccagttctgggatgaaccctgaaaaggacagagtgagccacacgtggtggccggaccatgggtaaggggtgagcactgctgggctccattctgctggaaggacggacaatctccttctgcacaataactggtgtgagggggccggacgctgtgagggtcaggaaggggagggtccacccaaagtaggctaatggagcagttggtgaccccatttccccagctttcagccagagatatcccagatgtcatgggagagccattggatgctctcagctctgaattttcatgcctctgccacggttagcatcagagcagtgatttccatccaacatagcaaaaaacttttcatgggagaccaaaagcttgtggcttcagaatgaatccagaaaaaaaaaaaaatccctgtcatgagggtgaaaggagctgccagcctcaacagggctccttggagaagacatttgagacttacattccaggcaaagtggcacttcacattctgggttctgaccttcttggaataaatgtctccacctgcgggcagaacta

SEQ ID NO: 250602 - DNA, 515 bp, Homo sapiens
gttttaaagaatggtacaaagccactgtggtgaaaaaaatcggccaacacaacacaaaataaacaggaactgagaaagtttctaggttctgccaccacaagacaacgtgcagccgttcaaaaagtacacgacgcaaaatgtcaactagcttccaatgttaatgaagtgttttattttacaaagaagtatctggctttttatttttcggttaggaagtgaatcctaacaactgagaaatattaaggaaagactgacccaaaccaaaaccaaagcaggcacagcgctcttcaagaatccaagactgaaaacacggacgtcataactggttcagtcttcacctcccagtgggagggaaagagagaatggatcgtccccttgaaatacttggcggggaaagaaaatcaagtctaggtgaggaaagcaggaagagcagagcaggaagagctggcacgcagctgaaagtcttccctccccagagccgaacgagtccttccttcctcgcccccggcggccgc

SEQ ID NO: 250603 - DNA, 334 bp, Homo sapiens
ttttcaattataaatttataatgcataatttttgaaaatgcttttggctcaaaacttatgttaactctatgactatgatataattggactgtctacatcactcaaatttaatttttaacttttattaagtgaacataagtccctagaaaaggttctcttatacaagttaactttaataaatccaaactcaaacatttaccagctggataaaaattgatatgtgtaacactggaatacatagaaatttcagcctcatcttccagcctgggcagccgagattgcaacactgcactccagcctgggtgacagagggagactctgtctcaaaaaaaaa

SEQ ID NO: 250604 - DNA, 606 bp, Homo sapiens
tcatttttcagtctattttaatttataaaaactaatcttgacaatttgaagaatccacctaagtacaagtttgtaccacactggtgactagtgtttttccctagttaacaagtgaaagatcatgtatacccagcgggcctgggcccagccccaccatcccgagcgcacagcagcagtgttctgtagctggactgcctggatttgaatccaggtctagcacttaactctgcagccttgagcaattacctttctgtggctgtttcctcttctgtaaaatgggaacagtaccacctagattgtagtgttggttgatctgataaacacacaaaaggcttactctggctgggcgtggtgggtgacgcctataatcccagcactttgaggggccagaggcgggtggatggctagaactcaggagttcaagactatctggggcaacaaggcgaaaccctgactctaccaaaaataaaagaaactagctgggcacggtggcgtgtacctgtagtcttagctacccaggaggccaagttggaggggaggtaagaggttgcagtgaacccaaacgacaccactgtactccagtgagacctgatctcaggcaaaaaa

SEQ ID NO: 250605 - DNA, 839 bp, Homo sapiens
atagtacctagcacatgataagcctccacgtttttgttgaatgtgaaatataaagaattaagcagctgggcacagtggctcacacctgtaatcccagcactttgggaggtcgaggggggcagatcacgaggtcaggagttcgaaaccaggctgaccaacatggtgaaaccccgtctctactaaaaatacaaaaattagccagatgtggtggcgcacacctgtaatcccagctactcaggaggctgaggcaggagaattgcttgaaccccggaggcagaggttgcagtgagccgagatcgcaccgctgcactccagcctgggcaacagagtgagactctgtctaaaaaaaaaaaaaaaaaattaggtatgggtgtgattcaggtgaacatagaaatagcttgagttagggcacaatttcatagccatacaaattcatattgaagcaagtcagccaacgtggtgcatttcagatgaaacctcaacgtgaagatatatcagttttagaccaaagcagaagtttatataaaggatataagctcttgccctgtatactcaggaattaaactaaaaagaaatctacaaattcatttatagattatttcaatttgaggcctatagatatgtgagaaaggtttctttaaggtttaatgaccaagttccatgtgagctcttacttgggaaacaaaattctcacatggcattaatatactataaattgtgatttatcaaaacattctcatatcctatctagggtgaaatttaatattgccaataaactttccactcgaaaaaagtggtaaaagtgtgcatgctaagcatgttttgttttggaaaaaaaa

SEQ ID NO: 250606 - DNA, 393 bp, Homo sapiens
aaaattaaaacactgtcttcttctcttccattatgatctgtagcttttccccacactcagttgatgcgcctcagggtctgagcctttctttctctcttcccctcactccttcacctccagtgcacaacataatttttggctcattgcactatcatctttggtcaatgcataaccctcttttattcatgtgttcatgtatgtaattagctatatatttttgataatgtaacacctacgagatactgtccaccacaaaaactgggaccttaccaatagcccacaactgtattccaccccatcctttccactcatctcattctgactttgctgggctctaagcactttgtctttgtgagtcccttcctttattaaaaattatatttatatgcataa

SEQ ID NO: 250607 - DNA, 439 bp, Homo sapiens
gctttatcaagttgttcttccctgggcaccttctgaactttcctttagaatgtctaattctgctgtttttccctgttgtcaccgtaactgtcccttagattcaccttcctgtttctacatatccttacttaaattttttcttcacttgtttccattctatatttgtacttctgtatagttcttgtgaaaactgtcttgatccctaaaatacttgtgtaaatatctgtttaccaccatagaactgagaacccctagaaggtatttactggttttcttatttttatatttcctacatttcttagtatagtacattatatatcattggtgctctataaatagttgtctaattgattggaaaaatagaccttttggggagatgggaaagtggttctgcagtttttgtaaaaatgaaatgtttatcataaaattcaaaaaaaaa

SEQ ID NO: 250608 - DNA, 377 bp, Homo sapiens
agtttctgatacctagctaaggaatttagactttgctgtgagccatagaatgctcagagtgggggagtcaagtgatctgacggtttttggaagaccacccaagccactgtagggtggggagtgcagcaacagagaagagactgttgagatggaattgttgagcgaagaaaggctgactcagggagggtcaggacagcagccgctggggaggccaggtaaacatgagttggtgtaaagggttagatcaccaggggagggaaagaggcagtgagagaggaaaggtctggtgagcacagaataccaggtccttaatcagtgcagggagaagcaggctcatggtggaggggagatgcagagatgaactagctctgttaggc

SEQ ID NO: 250609 - DNA, 719 bp, Homo sapiens
tagtcggtcattgtttgtgtatatgaagctattggtttctgaaggttaattttatacccttttatattattgaattactttattgtttgagttagttttatcatttaacctcttgggttttacaggcatactaccatatcatctggaaatgtacatagttttacttctgctctttcaattcttatgcttcaaattgcttccttctgcctaactgcattggctgataccttctatactgtgttaaatagtagtagatatacttggcatccttgccatatgtctgactttagtgagaatgtcaccaattttttccaattaaataaaaagttggcttttgacttaagtatttttattatgttaaccatatatccatcctcctattttattaagaattttttatttgaaatgagtgttgatgtttatcaaaatccttttcaacttttatagaaattattatataactgttcttacattaatatgatgaattattttaatgaatttgctaatatcaaaccattcttgcattcctgaaataaactctacttgatcatgatgtatttctaaatgaggtattagattctgtttgtgaatgtttcatttgtttttttgcatcaatatttgtaggttagaatgatttatatttgtgtgtgcatgcactgtatttgttaggtttaagtataaatgttaatcctgctttataaaaaatttagaagcctttt

SEQ ID NO: 250610 - DNA, 225 bp, Homo sapiens
ccacagcctgcctgtctgtatgctcccctagaagtttgagcagtggggcactgaagaagtgagccactcccccatcgcacaccctgagagagggacaagggaacctttcctgtttcagaatcatcctttaaaccatagctctatttgtaggtcttctttctcaagccaccactatagaagtccattttctcatccttgggcgtagctttagaatccagtttggag

SEQ ID NO: 250611 - DNA, 521 bp, Homo sapiens
tagatcagttcagttaaacagctgtttcccatatcaggaggtggcattgcacacgggctaggcctctatacatgatgaagacaaacagatttttaatacgaggcatttctatggaaatataagaaaaacaaaagttaatgttgggcacaatttatccagatgtgaaactcaaaatacctttagttatagagcaggaaggcagtggtaatctgacatgtttttgccacctatattaaaagaataagcttcagcttacagggcctcaggaaaaaaggtagtagcaattttattgagtccaagtcagaaaagtggaagaaaaatgtgaaagcattagtttggaaaacattagtttggagcattagttaggtaagcttcaggacagccatagttaaaggtgtagtcaacaagaaaaactggttatctctgtgacacacaatttttaaaatctggtttaatttttttgaaacagggtctcactctgtcacgcaggctggagtgcagtggtgtgatcacagctcact

SEQ ID NO: 250612 - DNA, 453 bp, Homo sapiens
ctatgttcttaagagtgctagtttaacaggaaatctccaatgcattattatctagactcatctcaaaggctcacttttcatttgcatgggcccttgctatttgtagggtaggaggcagcacctcgttctggtggctgccaccttcatgaggagacactccttgttaacaggatggttagcccacggctcttcccagcccccttttccacacccagtaaattgttttagtttatggccctcagctgcagttgcaatcatcatcaaattccagttttgaatttaaaggtgaataatgaatgcaatgaactttctagaatttatgaagggcagtgatgttcctttttatctaataattctacatgtgtagcctttcagtatgctattctgtggactgaatttacaaattgtcatttgtttaatgaactgttaatataacatgatgactaactgaaa

SEQ ID NO: 250613 - DNA, 393 bp, Homo sapiens
ccagggaggccaggcttgtttatccattcattgtttctgtgcccaacatgtgtcaggcattgtgctgggtgctagggatgctggcacaagtaagactgaatcccgggagcaggtgctcccagccatgtgtatcctcacaatgcaatgcaggaaataccttggagggctggtggagggtgtgcgcacacagggaggatgcactggcgctggaaggctttcctgagggggtgaagatgttgcaaaccgcgcattttggactgatcactgtaaaattccccttggacaggtagaggcagctaggactctggggtcaggtgtgaatctgccctcccgttgagtggctctgtgtcctgacagtcagttccttctgaaactgtgtcccaaagagttaaa

SEQ ID NO: 250614 - DNA, 877 bp, Homo sapiens
tctgtgacaaggaaactatgatcttgtttttcttatgtcttaaaactggtatttgaagtcagttttgtctggaaaggattgatctgaggctttcaaggagaaccagaggaatgtatagtgtctcagaagccaagagtttggaattttaagatagagcatgatccccaaatgcacagaatcagtatcacctgggaaattatgaaaatgcatattctcaaactccacgtcagacttacagaatcagattctggaaatgggacctaacaatatgatttttttaaacagtccttcaaatgagtctttgagaaacccctgaggtaaaggaatccacctaaagtaacatgttaagaaatttttatggaatgaggactgaaagaatactgttaagggtggcatttaaggtgttaagagtggcatttaaggtgtttagtgaccattggcatggtagggaaagttaaaggtctgccaaatagttgaaagatattcaataaggtaaaattcaaataagcttgcagttaagagaaaggcttttcttgggtaagaggaaaccagttaagagggagagaatgaaggaagaattgaaaaataagggtgagtctcattaaacaacatctcggaaagttgggaattcaagcatatatatgaatacagttacattgagaacagtatataagagaacaaaaagaaggatgaagatggagaaaaattaataccgatttggatctaagacagtggtgctcaaccaagaaagattttgtgattgtcactatttgtggggaacatgctactggcatctagtgtgtagaggcgagagatgctgataaacatcctgcaatgtacagggctcaaacataccccgccctcaaccaagagaaag

SEQ ID NO: 250615 - DNA, 3904 bp, Homo sapiens
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacgcctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataa

SEQ ID NO: 250616 - DNA, 873 bp, Homo sapiens
agagttagggaacaggaatagcagatcctaataaaggaattacaatctgccacacattgtggaattagggcagtatagtctccatcaatcaaacagaagcagagaacctgtcactgtccagggcacataatttcagttatgttctaaacagcttcagattgtatttttgtcttttgcttacacaagaaatgtgataccaaatgtaagtcttgcaaaaaattcttaagaaatttcctattagctgggtgatagagtggaaagatacacagggaaactgctgactggtttttgagagaatgaggaatccaaaggaaacaaaaaaggagaaattacactttttgttttctaactttctatatagtttacagtttttttcttaccatttgcatatgtagtatactagcatgatatttatccaacttgacagtggcttaccattgtgaagaaaaaagggaaaccttttatttgctttatgcactattgatgcatttaaacttgagaatcagggaagctgtgtttttaatggacacataatttaattatatattttttcttacagatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaacttgtttttattccccactactcttgtctctatcagataccatttatgagacattcttgctataactaagtgcttctccaagaccccaactgagtccccagcacctgctacagtgagctgcca

SEQ ID NO: 250617 - DNA, 3622 bp, Homo sapiens
  misc_feature (3561)..(3561): n is a, c, g, or t
  misc_feature (3568)..(3568): n is a, c, g, or t
  misc_feature (3576)..(3577): n is a, c, g, or t
  misc_feature (3585)..(3585): n is a, c, g, or t
  misc_feature (3590)..(3590): n is a, c, g, or t
  misc_feature (3592)..(3592): n is a, c, g, or t
  misc_feature (3595)..(3596): n is a, c, g, or t
  misc_feature (3598)..(3598): n is a, c, g, or t
  misc_feature (3608)..(3609): n is a, c, g, or t
  misc_feature (3616)..(3616): n is a, c, g, or t
ccagttggtaccccgggagtatggatatcgtcgaccacgcgcctcgccgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacgcctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaaaaaaaaaaaaaaaaaaaanttgtggngggcggcnngggcccgnaaaangnttnnanaacccattcnngtggggngcgggg

SEQ ID NO: 250618 - DNA, 3172 bp, Homo sapiens
  misc_feature (3111)..(3111): n is a, c, g, or t
  misc_feature (3118)..(3118): n is a, c, g, or t
  misc_feature (3126)..(3127): n is a, c, g, or t
  misc_feature (3135)..(3135): n is a, c, g, or t
  misc_feature (3140)..(3140): n is a, c, g, or t
  misc_feature (3142)..(3142): n is a, c, g, or t
  misc_feature (3145)..(3146): n is a, c, g, or t
  misc_feature (3148)..(3148): n is a, c, g, or t
  misc_feature (3158)..(3159): n is a, c, g, or t
  misc_feature (3166)..(3166): n is a, c, g, or t
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagcccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaaaaaaaaaaaaaaaaaaaanttgtggngggcggcnngggcccgnaaaangnttnnanaacccattcnngtggggngcgggg

SEQ ID NO: 250619 - DNA, 2763 bp, Homo sapiens
  misc_feature (2702)..(2702): n is a, c, g, or t
  misc_feature (2709)..(2709): n is a, c, g, or t
  misc_feature (2717)..(2718): n is a, c, g, or t
  misc_feature (2726)..(2726): n is a, c, g, or t
  misc_feature (2731)..(2731): n is a, c, g, or t
  misc_feature (2733)..(2733): n is a, c, g, or t
  misc_feature (2736)..(2737): n is a, c, g, or t
  misc_feature (2739)..(2739): n is a, c, g, or t
  misc_feature (2749)..(2750): n is a, c, g, or t
  misc_feature (2757)..(2757): n is a, c, g, or t
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaaaaaaaaaaaaaaaaaaaanttgtggngggcggcnngggcccgnaaaangnttnnanaacccattcnngtggggngcgggg

SEQ ID NO: 250620 - DNA, 3939 bp, Homo sapiens
  misc_feature (3878)..(3878): n is a, c, g, or t
  misc_feature (3885)..(3885): n is a, c, g, or t
  misc_feature (3893)..(3894): n is a, c, g, or t
  misc_feature (3902)..(3902): n is a, c, g, or t
  misc_feature (3907)..(3907): n is a, c, g, or t
  misc_feature (3909)..(3909): n is a, c, g, or t
  misc_feature (3912)..(3913): n is a, c, g, or t
  misc_feature (3915)..(3915): n is a, c, g, or t
  misc_feature (3925)..(3926): n is a, c, g, or t
  misc_feature (3933)..(3933): n is a, c, g, or t
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgcctttgatgttgttttatttcaaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacgcctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaaaaaaaaaaaaaaaaaaaanttgtggngggcggcnngggcccgnaaaangnttnnanaacccattcnngtggggngcgggg

SEQ ID NO: 250621 - DNA, 1282 bp, Homo sapiens
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaaataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttca

SEQ ID NO: 250622 - DNA, 1161 bp, Homo sapiens
  misc_feature (1079)..(1079): n is a, c, g, or t
  misc_feature (1147)..(1148): n is a, c, g, or t
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttccaaagttttaaagtttggnttcccccccttcccctcctggaaaaaaaaaaaggttaagggttaaatttttttaaacaaattttaagnnaaaaaaaaggggg

SEQ ID NO: 250623 - DNA, 3994 bp, Homo sapiens
  misc_feature (3933)..(3933): n is a, c, g, or t
  misc_feature (3940)..(3940): n is a, c, g, or t
  misc_feature (3948)..(3949): n is a, c, g, or t
  misc_feature (3957)..(3957): n is a, c, g, or t
  misc_feature (3962)..(3962): n is a, c, g, or t
  misc_feature (3964)..(3964): n is a, c, g, or t
  misc_feature (3967)..(3968): n is a, c, g, or t
  misc_feature (3970)..(3970): n is a, c, g, or t
  misc_feature (3980)..(3981): n is a, c, g, or t
  misc_feature (3988)..(3988): n is a, c, g, or t
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacgcctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaaaaaaaaaaaaaaaaaaaanttgtggngggcggcnngggcccgnaaaangnttnnanaacccattcnngtggggngcgggg

SEQ ID NO: 250624 - DNA, 3463 bp, Homo sapiens
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacgcctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctggcactgtttggactctgggcactgtttggactctg

SEQ ID NO: 250625 - DNA, 3632 bp, Homo sapiens
  misc_feature (3571)..(3571): n is a, c, g, or t
  misc_feature (3578)..(3578): n is a, c, g, or t
  misc_feature (3586)..(3587): n is a, c, g, or t
  misc_feature (3595)..(3595): n is a, c, g, or t
  misc_feature (3600)..(3600): n is a, c, g, or t
  misc_feature (3602)..(3602): n is a, c, g, or t
  misc_feature (3605)..(3606): n is a, c, g, or t
  misc_feature (3608)..(3608): n is a, c, g, or t
  misc_feature (3618)..(3619): n is a, c, g, or t
  misc_feature (3626)..(3626): n is a, c, g, or t
gggtaaaggctgatacttcccaggacgcggaggcacgtaaaaaaatttgaagaagggcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacgcctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaaaaaaaaaaaaaaaaaaaanttgtggngggcggcnngggcccgnaaaangnttnnanaacccattcnngtggggngcgggg

SEQ ID NO: 250626 - DNA, 3572 bp, Homo sapiens
  misc_feature (3511)..(3511): n is a, c, g, or t
  misc_feature (3518)..(3518): n is a, c, g, or t
  misc_feature (3526)..(3527): n is a, c, g, or t
  misc_feature (3535)..(3535): n is a, c, g, or t
  misc_feature (3540)..(3540): n is a, c, g, or t
  misc_feature (3542)..(3542): n is a, c, g, or t
  misc_feature (3545)..(3546): n is a, c, g, or t
  misc_feature (3548)..(3548): n is a, c, g, or t
  misc_feature (3558)..(3559): n is a, c, g, or t
  misc_feature (3566)..(3566): n is a, c, g, or t
taaattcggtcacggggcctggagctatgcgtgtgctcgttagtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacgcctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataaaaaaaaaaaaaaaaaaaaaaaaaaaaaanttgtggngggcggcnngggcccgnaaaangnttnnanaacccattcnngtggggngcgggg

SEQ ID NO: 250627 - DNA, 1382 bp, Homo sapiens
cgatggccctgcccagtcccagacagaacctactacgtgcggcggcagctggggcgggaaggcgggcgctgggggcgctgcggccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcccggcgaggagcgcgaacccgcggccgcagttcccaggcgtctgcgggcgcgagcacgccgcgaccctgcgtgcgccggggcgggggggcggggcctcgcctgcacaaatagggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttca

SEQ ID NO: 250628 - DNA, 504 bp, Homo sapiens
ttttttcagttatctgactggatcaagattggagatctgacttccaaaaattgtcatctttttgtaaaccttcaatcaaaaggcttaaaagggggaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacacttttt

SEQ ID NO: 250629 - DNA, 357 bp, Homo sapiens
ttttttcagttatctgactggatcaagattggagatctgacttccaaaaattgtcatctttttgtaaaccttcaatcaaaaggcttaaaagggggaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggatgttccttgtatctttagtggtgaccaaatcgggatgctagatcctcatcaaacacttttt

SEQ ID NO: 250630 - DNA, 351 bp, Homo sapiens
gccacagacagggactgttgtgattttgcagatgaagaaactgaggcacagagaggggatactcacttgttgagggtcccacagccaggactttcaggggtgggcttggatcccagggagctggccctgagcctgtacttgtgagtaccacatagggctcctcagacctgctcagcttcctccaggctgatggccagatgcatcccaggctgttaacgacaggcgtgtcttcaacccacatagttcctaagagcatggctgataatcatggtcatttggggacagtggctttggccaggacaggagtgcatggccacattattttagttttctgtattaaaacaacttttc

SEQ ID NO: 250631 - DNA, 569 bp, Homo sapiens
tttagaatggaacattttaaatttttagcctcctttttaaaaatgtagagcatcttttaaatcttaaatatatttcagccagttccaaaagttggactgtttaagtatttttagtagataacactcaaaatatcagaagtgatgtgaaaatcaagaatttctaaagtgctgtgtatgtattatatcttagtaagttcattgcctcattctcattactttctgtgaatgctaaactgattcttttagtctttcacctgtatcatccacagttccttccatttaatgttgcccaattctggttctgccttatccatgaaactagatatgacctagtatacccattgtatattaggtgcatataaacttactaaatgacaggcagtaactactctggtaatacccaccttcaaacaagaacaaatccttcttccaaaagaaacaagttcttaaatgccaacctacatctttggcctgtgttttttactcccatgatctatttattgcaattttcttatttaaatatagaataagcttaaatatagagcaattttgtatatctttcctatagc

SEQ ID NO: 250632 - DNA, 401 bp, Homo sapiens
aagcctttgacttctctcttcctgcctctcaggcgagagtgaaggacctggcctgaggcaatgatgtaaatgaccagctacttatcaaaacaggcattggctactgaatcctgtgcataaaaacgtggtatccccaggtcctttgctaagccagtacagttcaggggaaaagttagttgagcccctgccagacacatcagggagtgatctggccacccagagagcaaatggaaagcagcagttcacaacaatgacttttcctcttttatatatattttggtgtccttattttgctatgggagagctaccatccagctacttcaaccaatacatatttgattagcatctaactagacatcattatcctagtgattttcaaaactaataaatatggggccaag

SEQ ID NO: 250633 - DNA, 242 bp, Homo sapiens
ttttatgagtgcctactatctacaaggcttttaaataggtatcacagaaaggcgtgtgtaagtgcattctaacctgcaaaagtgtgtagagattcaaggcaggactacagtataatgaaatactggatgattggtcttgtttcttcactcatttactattgcagaattatacttccacatcctttgctgtgggtttgcagtgcctccccctagggcatgtagaatataattctccatctatt

SEQ ID NO: 250634 - DNA, 301 bp, Homo sapiens
ggtaaataatagagcaaagggaggcagtatgttctagggcagtggttttcaaatgttggcatgtatcagaatcacctatagggcttattaaaacagattgtgaggccccctacacccagagtctctgatttagaaaatatggagtaggccttgagaattcgcatttctaacaaattcccaggtgatgccagtgctgctggcccagggaccatacttttgagaaccactcctgaaaagccaacaaaggctttggagtcagtcactcccaggtctacactctagctgtatgactgactgctgt

SEQ ID NO: 250635 - DNA, 372 bp, Homo sapiens
ttaacttagggaaaataacatctactctctagcattgttttgaaatgctgaaatgttcacctgaaatatctaggactagaaaaaggcctggaaatcattccctttatatcaatacttcttaattttcattcctacttttcagttaaaaaataactcagtgataagaatccatgaggaaataacacttaaaagtttacaactcagcagttatacaagaacaaaacaatccacaaaagtaaacctaaccgtaattgtaaaaatatatttaaaaagcaataggagtagaaattggaaaccatgatgaaggaaggaaggaaggaaggaaggaaggaaggaaggaaggaaggaaggaaagaaaagaaagaaagaaag

SEQ ID NO: 250636 - DNA, 423 bp, Homo sapiens
gcaaatggcaggttcttattaggccatgctccaaagtcactgtccggtttctaactgtgatggtgaagcatggtcacattggtgaatttgaaatcactgattatcacagagctgggaaaattgttgtgaacctcacagacaggccaaataattgtggagtgatcagccccaaatgtgacgtccacctcaaagatccagaaaaatcacaaaataatctgctcccatcctgccagtttggttttattgtactgacaacctcagctggcatcatggaccatgaaaaaggaagctgaaaacacacaggagagaaaatcctgggattctttttctagagacgtaatacatattgacaaataaaatgtctcagggacagaaaaaaaatctgaaaaaaccccaacatatacaggagtatgctgaaaactg

SEQ ID NO: 250637 - DNA, 372 bp, Homo sapiens
tctgtaatctgttaccatcacagatttttttcttccataagagaaatcagatgggtgggaagttgcattccatgtgattctttgccaaactggagaggcattgagcgtttggatgatctcttttatactctgaaatacataatcccaagaaggtttaaatcaatgtgttaattggtaagtgatactgtaattatatgcataatcagggaaaatttgaatccagattatttgcttgctctcagaaaattaatctgcagaggtcatatattagattgcttgtttattaagtggaacccctgtagtttcaaagtgccgactggctctgccctctacgaagcattcttctagatgttcccagcaggtgtcaacggc

SEQ ID NO: 250638 - DNA, 361 bp, Homo sapiens
gacggagtctcgctgttgccagactggagtgcagtggcacgatctcggctcactgcaacctccgtctcccaggttcaagcgattctcctgcctcagcctcccgagtagctgggactgcaggctgctccaccacacccggctgatttttgtatttttagtagagatggggttttaccatgttggccagactggtcttgacctccagacctttggtgatccgcccacctcggcctcccaaattgctggaattacaggtgtgagcccccgcggccggccagtgtttattcttcctttcctgtcttcctagaatcatcttgctgcttccctcagtacggtaaataaatcttttgacacatgctca

SEQ ID NO: 250639 - DNA, 148 bp, Homo sapiens
ggaggaacttcttttcccttcagctggaaactgcctgggaaggttattagttattaggtgatggtagcggactagccgacggagggcaggcaggggagggggagaggactttacagaaaaggaattctcggtcgagctctgcctggag

SEQ ID NO: 250640 - DNA, 376 bp, Homo sapiens
aatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaa

SEQ ID NO: 250641 - DNA, 428 bp, Homo sapiens
tcttaaatcacaaaattagcagctcccacagtgtgttctgtttatcacacaactaccattactgcttgttctccccttttaagtaatctctaggcagaggatcagagacctaggcttgcttctaaaatatattttctcttgacaattcagttgattaaaatgtttaagatcaggttttatttatttgtttacctgagaaatagatcactgtttctggggactttgagacatcttccaacatccctgactcttagtggttttaaaatagaaatgtttagtaatcctatcttaacattcacctattttattcttcaaaaggccagtttcttatcctctggacattttctaaatgcctgcttatatgactttttgctgtattaccttcttgatctaataaacactccaaaatgactcctactaatgagaac

SEQ ID NO: 250642 - DNA, 210 bp, Homo sapiens
ccctcatggaacttaacagtttagcagggaaacagactttcttaaaataatctatcacttaaacaattgtgaaactaccgctgtcactgtaatggaggattttgagtggatcaggggctttctctgaagatttggctaggattcatccctgtctcttcttaagcctttctttcactctttgcaacagatctgggcaacagggaagagggg

SEQ ID NO: 250643 - DNA, 453 bp, Homo sapiens
cagcttttgatggtcattagtacatctttttttatttgagacagggtcttactctgtgcccaggctggcatgcagtgatgtgatctctggtcactgcagccttgacctcctgggctcaggtgatcctcccacctcagcctcctgagtaattgaaacgacaggcacaagcttccaagcccaactactttttttttgtatttttgtagagacgggttttcaccgtgttgcccaggctggtctcaaactcctgggttcaggcagtctgcctgccttggcttcccaaagctctgggattacaggcatgaaccttccatgaatttttaatttgatttttgtttccaagtaaatctctaaaagaatactcattaaaaatgaatctttcaaatccttagtatttgtattgctaacatttacactccaggatgattttctattaaaatgtattgtcaagta

SEQ ID NO: 250644 - DNA, 362 bp, Homo sapiens
cacggctaatttttgtattttttgtagagatggagtttcaccctgttgcccaggctggtctcgaactcctgatctcaagtgatccacccacctcgacctcccaaagtgccaggattacaagcgtgaaccactgcacccggccttggcttgtgttgtttctaataagaaatctgaggtgaatcttattttggttcccttgtacataacacatttttttccctctgattgcttttaagatttttctcttcaccactggttttgaccagtctgctaataatgtgccctgatagagttgctcacgtgtttcctgtgcatgcagttcatcaaacttgttggatctatgtcttcatgatttttatcaa

SEQ ID NO: 250645 - DNA, 323 bp, Homo sapiens
aacagcaagctgacccaacgccctgctcgctgactcctttatgccggcaccggcaccgagtgccacgctgcgtttgcaagctattgttcagcaggcagattttctgctgggggttaacaggtgagagcagtgatccaagagcaaaatagagaggatgcttttagttaagctgccaatgcttagcaaacacttctgaaaatatcacagctcaatattgcatcattcatgaatggaagagctgcagggtggggggtgcttgtttcaaaatgatttaccaaagtaaggagagagtgcagaaatgcagaaataaaataatgtggctc

SEQ ID NO: 250646 - DNA, 696 bp, Homo sapiens
atttggcttctggtctactttccttagataaattccatgtgtaaatagacataatcaaatattttgtcaaaacatagcttgcaggcctggaaagtatgatcttctatatactggcttctgggcttcaccaatcctccctactaacttaatggtagctactttggggcaattcaaaattataggtttgggtaaaatgggaatgtaaccagtttccctttaggtttgctgtatggagaaggtgactgagaaatcctaggtacattgtcctgctaaaactatctctatttcttttataaatgttttatgattttcagtttacaagtccttcagctctgtggttaaatttatttctaaatatcttaatttatttttcatgctcttgtaagtggaatggtttccttgatttctttttcagatagtttgtttttagtgtatagaaacaccactaatttttgtatgttagttttatctcctgcagcattactgaattggtttattagttctaacaggtttttggtgaagtctttaggttttctctatataagatcatgttttctaccattggcaatctaacttctttcattttgatttggaggcccttgaattctttttcttgcctagttgctctggattaacagtgttatgttgatagcaatggtgagagtgggcattattgtcttgctcctgatcttaggg

SEQ ID NO: 250647 - DNA, 619 bp, Homo sapiens
aggaaaggtaatcctgttgacactagtggtctctaaagtactttcacattcatggactccccgcagtgggaggaagataccaccagaactgggacagaggagcatgctggagtccccacagccaccagcactcaggctgcgttctcagggcaggaacaccaggaccatcttcccttgttatcataagcccctggctggctgggacaagcctttgtttttcctcctgattgattgattggcattttacacttgtgtgtaactgggaaccatcgggctctaggtcacaaaacagggactgagttaaacccccacgagtaacaccctcatccatggaaatcacagaccaagcccttagcacctgcatcgtgtgcccagccagtgccaggctcaaggagatgcccaacaaatggtgctgaaataggtaagtgacccacaggggaaggagacttagatctgcgtagagatgctgaaatgctgacactattaagaaaagtttggagaaatagtggtttatcttaaacttatttgtatatatttagaaattcaacatggggactaccagaaaaatctgggataaataacatttccctttttttcctaattaaaaagtcttcagaaa

SEQ ID NO: 250648 - DNA, 297 bp, Homo sapiens
aaaccaggcaagtttttaataaatatgatcttatcattttgttaattataacaaaataagcaatgtagagagaactgggctgaataagaacaaggcagaaaatactcaagcatggattatattagtaggcagtagtcaaatacacattttccttcatccctgctctcctaagataacccagaaaggagtggtcatatactttggaggatagccatatagatacttatcagtggcctgtgattctttcctccagccccattcttcctagatgattggaaaaacacttaagggagcatt

SEQ ID NO: 250649 - DNA, 597 bp, Homo sapiens
atccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagacatacatggagcagtaaaaaagatgcagatgttctctgaggctgaataagaccatgctctgccttcttgtttcaactgttacacagagatgaccagaggatggggccactgcagtgcagttcaagaggctctggttcggggaagagctggatggagtatgaatcccaactctgggggtattagctagtggagtggccataggcaagttacttaacacttctgaacctccttttgtctttcataaaataaaagctactaggatgagttgttttaaggatttcagatta

SEQ ID NO: 250650 - DNA, 399 bp, Homo sapiens
gtcttacagggtgatacaaccttttgtaattcttaaggagacttgaatttttgaggcaaatgttgagtctatacgtggacatttgttgtgtaagagtggaagtggaagtcaaaattctgaacaaggttgctcccaataagatctgtcagctcacaagattgcttccctaggcttgaaatgtttcaagcacaaattcaattcataaggaaaatgagaatcatgaaaatgattatgaaatagcaagcagtctggaaagaggatgtagacgaatgccaaagcttctggaatttatgaaatatttccatttatggggccaggtgaaataagttgttctttcagaaatgtgtgacatggctattatatattatccccctaaaactatttgatcataaaacaaaa

SEQ ID NO: 250651 - DNA, 715 bp, Homo sapiens
gaatgacagaaactcaaagacatatgtgactatgaagacagcacaacctatgaatgacatgctaaggacaaaaaacaaaaataatggaaactgagagtggcactaaagccccgagttttggttacactgtgacctatgtaagaacttaaccaaacggggaattttttaaagaaaactattggaggccataattctggactgagcttatgcactaggtccaaacaaaccaaaccaaaatgagtcactcatgctggatgtgacataattaaactaaaaatttaaggcaacaggtagattctaaaactggccaggttttgtttttcttctctaaatagcagatttcaacacaaggaggtcccctgtactctaacactttaaaaaacaaataaaaataatttcaaaataataagctgaagtttttatttccactttacaaacccacagttctgctgtttcacagtgagattcgagtctaaataagtacatttttgatggtgacaaagtgatattaatgtctaaagttttggtctcaaacttgagaagatgacaaaagggagaaattgttaaattagttgtagcctaaagcttccctcttatgtttaattttggctaataggatttgttttttgttttttgtttttttacatagtaaacttaatgttcaaatgggacatatcttaagctgtaataaatctggctgtttctgtacctcact

SEQ ID NO: 250652 - DNA, 452 bp, Homo sapiens
agcggcgggtgagacgctgcgacgggaggcgctcggcgcgctggtacccgggaggggagggtccagggcaggccggaggcgtaggggtcctcgtccctgcgcccggggctggcagctccccaagctgtgggcgtcccgcaccccgagcccttcctggagctcccgcatccgaggctccgaggccggaggacctcggagctccttcctactcccaggggcgatgccccgggctgggggccgggcctgcccgcggcgctcccggcggggccctccattagcgtgggctttaacgggggtagtaaatggggtcggcatttgcggttctcgctgacagctttgctcctagttcatttttgttgggaggccgagtccttaagagacccgaggcgcccacagcccatacttaaagtctcgctgtgttcagagaactgacgcctcccggaattgaactg

SEQ ID NO: 250653 - DNA, 753 bp, Homo sapiens
atctatttatggggtacagtttgatgtttcaatacatgtgtatgttgtatagtctaatctgggtagttatttccgtcacctcatgtgtttatcatttcttcattcgaaaacttctaactattttgtaatatataatacctcattgggaagattgcttgagcctaggaggtcaaggctggaagctatgattgcaccagtctactccagcctgggctacagagagagaccccatctcgaaaacaaaacagaaaacaaaagacatttaacctggcccagtaggataagacaagaatgatgttgtttaatgactgatttccatttaacaagttgtactccttaatatagatgtttggtgtatttggtaaggggatatcagtttcagaaacatttacctcaaagtggagagaagccgactaggagctgctctggtttaatagcaggtattctactcccaacccctccaggagattcttgccccacccccttctgtcttcagctaggattcccattttcctatgaagacaggacagttttgttgttttaaaggaagaagctgctacttcctaatcaggatctcaggctggggaagaacagtgtgggaccacgttagcatccgcagatttccagcaaggctgtcctgcgtggacgctactccatggaccggcttcaaaccacacactgccctgtgcgcacctggggctctctcaccctctagctagtagttaattagggcagagccctatttacagtcac

SEQ ID NO: 250654 - DNA, 807 bp, Homo sapiens
atctatttatggggtacagtttgatgtttcaatacatgtgtatgttgtatagtctaatctgggtagttatttccgtcacctcatgtgtttatcatttcttcattcgaaaacttctaactattttgtaatatataatacctcattgggaagattgcttgagcctaggaggtcaaggctggaagctatgattgcaccagtctactccagcctgggctacagagagagaccccatctcgaaaacaaaacagaaaacaaaagacatttaacctggcccagtaggataagacaagaatgatgttgtttaatgactgatttccatttaacaagttgtactccttaatatagatgtttggtgtatttggtaaggggatatcagtttcagaaacatttacaaaagtgagtattctgggagatcttattacctggtaaccttagcatgctttgatctcaaagtggagagaagccgactaggagctgctctggtttaatagcaggtattctactcccaacccctccaggagattcttgccccacccccttctgtcttcagctaggattcccattttcctatgaagacaggacagttttgttgttttaaaggaagaagctgctacttcctaatcaggatctcaggctggggaagaacagtgtgggaccacgttagcatccgcagatttccagcaaggctgtcctgcgtggacgctactccatggaccggcttcaaaccacacactgccctgtgcgcacctggggctctctcaccctctagctagtagttaattagggcagagccctatttacagtcac

SEQ ID NO: 250655 - DNA, 336 bp, Homo sapiens
cgtcttcctggacgatctcgtcattttttttgttagagggggctcctcttatgtgttttatgaaaatagcccacctttatcctgaagccaaatctctcacctcaacttgttctcttctgtctcaccttacatatccaatgggtcaacaagttctaatagttcttcctccaaaacgtctttctatcaacagctttcaaggaagaaagagaaaaagagagagaaagagagaaagaaggaaagatggaaggaaggaaagaaagaaagaggaaagaaagagagagaaagaaagaaaagaaagaaaaaaaagaaaaaaggaaagaaagaaagaaagagaga

SEQ ID NO: 250656 - DNA, 255 bp, Homo sapiens
tttcaagtatgagcaagatgcaaagaaatgatgtgacaactatgaatacaccacaaatacaacacaaaacatgcaaaagaaactagttcataataaaacaagaaaacatcaaccaacgtgctatgatttgaatgcttgtcctctccaaaactcatgttaaaatttaactgccagctgggcgtggtggcttcgcttcacacctgtaatcccagcacattgcactccagcctgggtgacagagtgagactccttctc

SEQ ID NO: 250657 - DNA, 301 bp, Homo sapiens
tgcaggcagcaggattgctgagcctgagagcccccacccctctgaaccctcaaagaaagatgcaggtctgttcgttgcctggtctcccaggcttactgagcctgcgctggggtcacccctctaccagcagccctggggccacactggggccaatacaggcactcagggcccagaggctgccaggaagctctgtcaccaacatcttcccgaggcaggccggccccaaatgagtaaggacagggctcagcttttttctcccctgtgctaagcaagggaggttcacttccctagtgagaacaat

SEQ ID NO: 250658 - DNA, 429 bp, Homo sapiens
tagaagatgagtaataacatggaagttaagattttattttcctaacagaaatcatcaaggaagttctgaggttgaagagatattcttaagagacaaatatatctccatgaaaaaaaataagactttgaggcccatttcctcttcctgtctctgctgcaaaccttgatgattaaaatatttaggaagtaaaagatttcacgactgtgagacttcttgatgacctatgaaatcaagacgtccgagagctaaataaaatttaaaaatcatgtcttgcatcacctgaagggtgtcctccccaccctttaaccctcaatcagatcttgaatgctagctagagttttaaaaattggtggatggagctgtgtgttgtttcatcatttgcaccccaactgtatatccatctgatgaagcttggaaaatatacttgtt

SEQ ID NO: 250659 - DNA, 322 bp, Homo sapiens
gacttcatccttctcaccaaaactttcttgcccttcctcctgttttcctcctttatattaacagcatccgtatcttccagccacccacagtggagactttggggtctcttccagggactctttttcactccctacttctaaatgatcaccaggacttgccaattctaacttgaatgtcattcaagtctgtcacttcttcccagtttccagtgctaccacccttgtttgggctctcatctgtgctcaatttaatgcctagcagtctcctcctgactggttttcctgactgaatctttccttctttaaaccacccacccaaccc

SEQ ID NO: 250660 - DNA, 740 bp, Homo sapiens
ccatgttggtcaggctggtctcgaactcctgacctcgtgatccgcctgcctcggcctcccaaagtgctgggattataggcgtgagccaccacgcctgacctaatttttgtatttttagcagagatggggtttcaccatgttggccaggctggttttggacttctgacctcaaatgatctgcctgcctcggcctcccaaagtgctgggatgacaggcgtgagccaccacacccagcctgagactttttattggtctataatatatatggcctgaaatatacactacaatgaggagaaaattttaagtcatcatttatgaaaccaagtatttaggttctggataacattgtctctaatctcatacaagattttaaaaagtaaataagtggtaaaaacctcatgaatcttatctaaaattatatgtacacttccctctctactttctaacttggctaaacaatagaagaaaacttgaaatgtacagcgctcaataaaggaaaggcagtttagagggaatggcattgactattaagagcaaagaatatgataatttagttcaaagtcagttcattcagtgaaataaccaatcttttaatacaactgcattaattttctacttaagaagaatttgaacgctcttaatgtaatgaaacatcttggtcttattaagtgcaatactgctaagacttggaaaaaattggtttcctcctccccattccctggcttaatagaaaaaaaaaa

SEQ ID NO: 250661 - DNA, 794 bp, Homo sapiens
ccatgttggtcaggctggtctcgaactcctgacctcgtgatccgcctgcctcggcctcccaaagtgctgggattataggcgtgagccaccacgcctgacctaatttttgtatttttagcagagatggggtttcaccatgttggccaggctggttttggacttctgacctcaaatgatctgcctgcctcggcctcccaaagtgctgggatgacaggcgtgagccaccacacccagcctgagactttttattggtctataatatatatggcctgaaatatacactacaatgaggagaaaattttaagtcatcatttatgaaaccaagtatttaggttctggataacattgtctctaatctcatacaagattttaaaaagtaaataagtggtaaaaacctcatgaatcttatctaaaattatatgtacacttccctctctactttctaacttggctaaacaatagaagaaaacttgaaatgtacagcgctcaataaaggaaaggcagtttagagggaatggcattgactattaagagcaaagaatatgataatttagttcaaagtcagttcattcagtgaaaatatcaactggttttccttatcacatcaacttggtagctctctgaatttacaaataaccaatcttttaatacaactgcattaattttctacttaagaagaatttgaacgctcttaatgtaatgaaacatcttggtcttattaagtgcaatactgctaagacttggaaaaaattggtttcctcctccccattccctggcttaatagaaaaaaaaaa

SEQ ID NO: 250662 - DNA, 483 bp, Homo sapiens
gaacttaaaaagcaaaaaacaagttaaaaaatgggcaaaggaaatgaacagacacttctcaaaagaaggcatacatgtggtcaacaaacatttgaaaaaatgctcaacatcactgatcatcagagaaatgcaaatcaaaactttaatgagataccatctcacacaagtcagaatagctattattaaaatgacaaaaaacaacagatgctggtgaagctatgaagaaaaggaatgcttatacactgctggtggaaatgtaaatcagttcaaccactgtgatttctcaaggaactaaaacagaactaccatttgactcagcaattccattctcaaggaattaaaacagaactaccatttgactcagcagttccattattagatatatatccaaaggtaaataaatcactgtataagacacatgcactcgtatgttcattgcagcactattcacaatagcaaagacatggaatcgattaggtgtcc

SEQ ID NO: 250663 - DNA, 913 bp, Homo sapiens
tgcaccttgttgggtcacgtggcttaacttaaaaaaattttaatcactgtggtgcatatgtagtgattattaatgattatctcataattttattttcttgatgattaatgatgttgagtgtattccatttgtattttagtttgcaaatgttcaaattcttcacccgtttttaatgaagacataagacttatttttgtgttctgaacataagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctatgactcaactggtccttcactgccaaacatacctggggttggatcattggcctgacgtttgcaaattgaggaaccttagggcaaatcagtgaacttctgaactgccttcgtcttcagttatatggggatttccccacttttgagatacttgtaaggattatatgagatgaagagatgagacaaggtatataaaagtcctagcacagagcgtgtcatataatatggcttcacaagtaccctcatctcctttccagtcgtttttttttttttttttgagaccatctcactctgttgcccaggctggagtgcctcttcatttttatttctttattcagcaagtattgatcaaatgtgctttgtaccaggtactgagctctacgttgggatataatggtgatcaaggagattgtagattctggcagggaaaactgacat

SEQ ID NO: 250664 - DNA, 815 bp, Homo sapiens
ggccagcactttgagtaacatgggtttaaagcagtctgttattagaaaaattaaattcgattacattaaatgaatttaccaaacactagttaacgcaagaaaaaattagcacctatgtctacattctattactttgggcattgaatagtaactataaatgcagaataaaaatatctatggattgaatgggaaccaactaattgaacatgaagccaaggaaatgatttctttatgagtgttggctgcagaagattaaagtacttttgcagacggaatcgctcttttcttaaattactcttgaaattcctcagaggagaaaaatactaacaataatttttggtcatgtctatccttttgctcaacattttaaaggaagtggtcttaaatctcccacatatctacatcacaataacaacctctattcacaaaccgattcctattaaatacatttccatttacattacagagaattatgagactccttatttctagctgaacatcatttgttattttcaactcgacattttgaattatagaagcacctaacataagtactttttcagcatatattctaaccatggactagtttgcaattttctaagagctttcaacaaatgttactcttcgactaatttaaaagtatggatgttaaaaagcattcaaaaagtccatacaagcctagtttgtaaataactatggaattgatttcccaaagaaaatacaaacttttccccataagaattcatactttaagaaaaacttacttccatttaaatttactgtatgaagtttggctcatgaaggctttttcctaa

SEQ ID NO: 250665 - DNA, 564 bp, Homo sapiens
caatagagaattctctattgttgagtgtctgtgagtcccagtttttgctattgtaaattatgctaaacaaaaatctgtgtgcataaatctctgagtttaagattatttcgttaagatagacttctataacaagaattactaggttcatataatacttctaatgcttttgaaatatattgtcgtattgattttagcagttttcagtccaagcagcaatagatgaagagagctgttctctcctaatgcctctagtcatagtgactgataccacagccaaaacaaaaaaaaaaaacaacaacaaaaaaaacaaatcttttctaatttgataggctaaagaaaagatcttgttgttttatttgtattttgggagggctactgccattgaacagcttttccagatgttcattagccattttctcttttgtgaactatctattactgtcctttgcctgtttttctattgaggccttaatttttttaactgtatttatataaaccccacgtatcagccctttgttgtaattgtggcagttttttcccattttactttttgcattttaatgt

SEQ ID NO: 250666 - DNA, 701 bp, Homo sapiens
agatattattacttctgtaacatcttcaaagaaacaaaatgttatttatttcttctcttagagaccctacacttgtagaatatatactgggcaaaaaaagcaataagacaacgagagtctcactgctgaaagagagagaaaaaaatagccaaagattacatatgaaagagacagagggaaatacaggaagaatacataggtattaaaagtttatacatccatatatctaatagatattcatagatatagataaggtcataatgtgattaattttttactaaaatatgtgaatgtgtccatctattttatatagctccattctggaatgcaaatattgttttaatttttactcaatactgaggcataaaatgctataaaatttttacaaagttgttttgaagttttaaaaagtatcaatagcactattcaaatgtttaatgtgcattaaatagtacttctatgcaatcattttgtatttctagtagatttaacatgtagtatgcttagagttatgattcttccagacatactattttcttgaagcaattcctttggttttaaaacattgttttccaataataaaaatggaaaactttttttttgtttcctataatttacaatttccaatctggcatttaaatagggatacacaattcaaaatatgttctcattacatggtttaggtttcaagtataagccgt

SEQ ID NO: 250667 - DNA, 391 bp, Homo sapiens
ctgcgccagaggcaggatctgacagcttttcctgaactcatgtggtcctaatcagctcaagaagaaaagccaccttggtgccagtttgaaaggatttttagtgtgtaataaattagagaacttgaaaaacacagaaaaaacttttttgattctcttcaatccagtggctgttgttttttattttcaagttttaggtttaagcagtgagaaaggagagaatatttgaataagtttatttcataaaattccttttgcgggaataacaaaaataagcaccacgtgagttacttgatatgaaagtccttaaaaagagttaattgtcccttgaaaagagatagatactcatcacacaatgagcttaggagtaaagtcataaccatgtctacaaact

SEQ ID NO: 250668 - DNA, 455 bp, Homo sapiens
gcagtaaaaaaaagtaaacagaagaacgaatgtgacaatagacaagggggagacaagtatctctctcattgtgaaaacttttacaggcataacttgttccactttggaaggccagcgatgtctgtgtttaaagtttactttactgtttgtcttgagtgggatcagtgttgtagtgaataatttatagccagcatgaatgagctcattagtcaccttttcagactttaaatgagttttgtggttgtcattactcgagccttctgttcagccgcggagcaaaatgacagtttggcagttgttgctggggccgcctgttccccttcaggtctgtgttggcttttgtatttcgttgaatccttccctggctaacccttcgctggtccaggcagcaactctcccacttcacatgccttttgcaccccaagtttaaatgagaagtttttcaggcttcaaaa

SEQ ID NO: 250669 - DNA, 856 bp, Homo sapiens
atcagcagataggacaacaaacacacagtttttatccattagaaattggcccatttgaagcaaggggctagaaaatgtatacattttaatggcccccacaggcattctgtgaaattagcctttgaatatgaccttttagctacctaataaaatgtaaagatgaaatcaagtattattcatgccaggcttattaaatttgctgttcacgttactgttagaggatttgtaacaaaataaaataaaaccattacctattgtgaggtggttttgatgaatgtacaagcacaattccatcttcaatgttttgctttcccaggtttcaaggaaaggcattttcaaacccgaaacatttcagattctcagttctgcagcacaaatttatcctactaaagggctgtgaccttcatttcctatagtcagtcttgcatgatagttgaaattgaattcccattttcctcttctttatcagctttcactttttagcatattcttttaaactgtagcatgtgaatctctttagcaacatattatgaaattatggggctgcagtgaaagcctctatttgcatatcttctttccccgttgtattagaatacttgcgggtttataatctgaactgataatgatctttaattgtaggcattgttttaagacaaaacagactataatctatatggtggtttcccacaccaggtttctagaatgtgccttggggctgctatagagacacagtcttacagactggggtctcagcccggtaccttttctcccaccagagcaagtctgcatttgttgattttatataatggagatctatattcactattctgtgaaaaaagagtccctcttattacca

SEQ ID NO: 250670 - DNA, 472 bp, Homo sapiens
tgtttttttctcttttgagacagaatcttgctctgttgcccaggccagagtgtggtggcatgatcatgtctcactcactgcagcttaacctccctggctctagcaacccccccacctcagccgcccacgtagctgggcctacaagtgcatgccaccacacctggctaattttttatttgcttgtaaagataggttttccctatgttgcccaggctggtctcgaattcctgggctgaagccctcctcctaccttgacctcccaaagtgctagaattacaggcatgagtcactgtacctgaccctgggggcattcttttacatgcagctgaaactgtcctagctgagaaggctttccaccatgcacagtctttcattgcccaataatgaactgcattcagcataccccaatgcagccatcacccctagttctcttactttgtttctgctttgaatccccttcttgaaatttctc

SEQ ID NO: 250671 - DNA, 2923 bp, Homo sapiens
agctaagagggtcagggctagagccgtgagtgtcagcctgggatgggctacataaggcccagctctggcaccagagcttcattctttgttgcacagcaaactgcagaggtcactccaggctgtggctccacatcccgaggaacaaaagcgggcctgctcagctgtctgcaaggacggccgttccagaccaagtggcctgctgctccgaggacccagctcgctccaggctgtgactccacatcccgaggtcgctgcctggcgaccgggcagcgaggaccggccaccccagacttcctgtcccgcagccccaaagacagagctgcgaccgctgggacagcgacgcctgcacagctctggtgagatggcggcagggtccactacgctgcacgcagtggagaagctgcaggtgcgtctggccactaagacggagccgaaaaagctagagaaatatttgcagaaactctccgccttgcccatgaccgcagacatcctggcggagactggaatcagaaagacggtgaagctcctgcggaagcaccagcacgtgggcgactttgccagagacttagcggcccggtggaagaagctggtgctcgtggaccgaaacacccggcctggcccacaggaccctgaggagagcgcttcccgacagcgcttcggggaggctcttcaggaccaggaaaaggcctggggcttcccagaaaacgcgacggcccccaggagcccatctcacagccctgagcacagacggacagcacgcagaacacctccggggcaacagagacctcacccgaggtctcacagtcgcgagcccagagctgagagaaagtgccccagaatagccccagctgattccggccgctatcgggcctctccaacgcgcacagctcccctcccgatgcccgagggccctgagcccgctgcgcccgggaagcaacccggaagaggccacactcacgcggctcagggcgggcctctgctgtgtccaggctgccagggccaaccccaggggaaagccgttgtgagccacagcaaggggcacaaatcgtctcgccaggaaaaacgcctcttgtgtgcccagggagattggcactcccctactttgatcagggagaaatcattcggggcctgcttaagagaggaaaccccaaggatgccctcctgggcaagtgccagggacaggcagccttcggacttcaagacagacaaggaaggggggcaagctggcagcggccagcgtgtccctgccttggaggaggctccagacagtcaccagaagaggcctcagcacagtcactcgaacaagaagaggcccagtctagacggccgggacccaggaaatgggacacacggcctgtcgcccgaggagaaagagcagctttccaacgaccgagagactcaagaggggaagccaccgactgctcatttggacagaacgtccgtgagctccctctctgaggtggaggaggtagatatggctgaggaattcgagcagcccactctgtcatgtgaaaaatacctcacctacgatcagttgcggaagcaaaagaaaaagactggaaaatcttccaccactgcacttggagataaacaaaggaaagcaaacgaatccaagggcactcgtgagtcctgggattcggctaagaaattgcctcctgtccaggaaagccagtcagagaggctgcaggcggccggcactgattccgccgggccgaaaacggtgcccagccatgtcttctcagagctctgggacctctcagaggcctggatgcaggccaactacgatccgctttcggattctgactccatgacctcccaggcaaagccagaagcactctcttcaccaaagttccgggaggaagctgctttccctggacgcagagtgaatgctaagatgccggtgtactcgggctccaggcctgcctgccagctccaggtgccgacgctgcgccagcagtgtgcccaggtgcttagaaacaatccggacgccctcagcgacgtgggagaggtcccctactgggttcttgaacctgttctggaagggtggaggcccgatcagctgtatcgcagaaagaaagacaatcacgcactcgttagagagacagacgaattacggaggaatcattgtttccaggacttcaaggaagaaaagccacaggaaaacaaaacttggagggagcagtacctgcggcttccggacgccccagagcagcggctgagagtaatgacaacgaatatccgatctgcacgtggaaacaaccccaacggcagagaggcaaagatgatctgtttcaaatctgtggccaagacgccttatgatacttcaaggaggcaagagaagtctgcaggagacgctgaccccgaaaatggggagatcaagccagcctccaagcccgcgggaagcagccacactccctccagccagagcagcagcggcggtggcagagacagcagcagcagcatccttcgctggctccctgagaagcgggccaacccctgcctgagcagcagcaatgagcacgcggcgcccgcggccaaaacccggaaacaggctgccaagaaagtggccccgctgatggccaaggcaattcgagactacaagagaagattctcccgacgataaactcaggacttgccttgcagataaaatctggggggatttttgcattggcaaagtcaatgcgggttggggaacgaaacttccaatggacaccagaacctttaacttggtgcaaagttgagcctttgaattctgcaggtgtcatgtgctggccctgtgattttgcctcccacacccagccactacctcccagcttggagaacacctcagaattcagaagatatgaacgcattgggaacaattctattttggatgttcactgataatttttaaaaacaccctagttgtaattataaataagga

SEQ ID NO: 250672 - DNA, 186 bp, Homo sapiens
aaagtatggccagtggccaggactggcctgctgcctgtttttgtttaacccgtgagctaagaatagtttttacctattttaagtagttgaaaaaaaaatcaagagaagaatactatttcgtgatatgtgaaaaatcacatgaaattcaaatgtaagtgtccataaataaagtcttactggaagaca

SEQ ID NO: 250673 - DNA, 911 bp, Homo sapiens
agaccccaggaagcaacccagggactcgaacacacgaacagcactcctccgcgcactgcgcaggcacgcctgcgtccggctcaccctgaaacatcgcgagatccggcttcaaggccgggctgctgcctttacgcctaaagactatgtttcccggaagacactgcggcgccggccctatcatggcgcagcatcggtgtgctttgtgcgtctgcgccatcttccggctgcgcacggcgaatccaccggtaccgtggtggaagcgcgccctgggctgccgggggcgcggccgcggtggcacttggacccgaggaggcggcagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccaggagctaaagggcagaggggcagagatgctggctgtgcttgctgtaaaagaacagaacagaaccccggtcaattatggaaaatgactgagtctggcctgtttttcatgcactaaacatgtgggaatcccactgttttttccagattatactgtgtatgtagacagtggagagggctaacctcattaagggtgcaagaggggctggttttacagggggcctctactacgaaggcctaatggttttgaaaatgaactcaaataaaagattattaccaaaaaga

SEQ ID NO: 250674 - DNA, 1133 bp, Homo sapiens
agaccccaggaagcaacccagggactcgaacacacgaacagcactcctccgcgcactgcgcaggcacgcctgcgtccggctcaccctgaaacatcgcgagatccggcttcaaggccgggctgctgcctttacgcctaaagactatgtttcccggaagacactgcggcgccggccctatcatggcgcagcatcggtgtgctttgtgcgtctgcgccatcttccggctgcgcacggcgaatccaccggtaccgtggtggaagcgcgccctgggctgccgggggcgcggccgcggtggcacttggacccgaggaggcggcaggtgagaggttccggagctttccaggcgctctggggtccagcaggagctggtgcccgggccggttgggtctcaggcctgagaagaacgcagacgtctcgcctcatcgtcgctctgtggctttaccggcgtgagactacatttcccgccggccctcgcggcgtgcgctttctggcgccccctttctgcttccagcctcatagcccaggtgcatggaccccttagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccaggagctaaagggcagaggggcagagatgctggctgtgcttgctgtaaaagaacagaacagaaccccggtcaattatggaaaatgactgagtctggcctgtttttcatgcactaaacatgtgggaatcccactgttttttccagattatactgtgtatgtagacagtggagagggctaacctcattaagggtgcaagaggggctggttttacagggggcctctactacgaaggcctaatggttttgaaaatgaactcaaataaaagattattaccaaaaaga

SEQ ID NO: 250675 - DNA, 943 bp, Homo sapiens
agaccccaggaagcaacccagggactcgaacacacgaacagcactcctccgcgcactgcgcaggcacgcctgcgtccggctcaccctgaaacatcgcgagatccggcttcaaggccgggctgctgcctttacgcctaaagactatgtttcccggaagacactgcggcgccggccctatcatggcgcagcatcggtgtgctttgtgcgtctgcgccatcttccggctgcgcacggcgaatccaccggtaccgtggtggaagcgcgccctgggctgccgggggcgcggccgcggtggcacttggacccgaggaggcggcagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaagacttctggc

SEQ ID NO: 250676 - DNA, 1165 bp, Homo sapiens
agaccccaggaagcaacccagggactcgaacacacgaacagcactcctccgcgcactgcgcaggcacgcctgcgtccggctcaccctgaaacatcgcgagatccggcttcaaggccgggctgctgcctttacgcctaaagactatgtttcccggaagacactgcggcgccggccctatcatggcgcagcatcggtgtgctttgtgcgtctgcgccatcttccggctgcgcacggcgaatccaccggtaccgtggtggaagcgcgccctgggctgccgggggcgcggccgcggtggcacttggacccgaggaggcggcaggtgagaggttccggagctttccaggcgctctggggtccagcaggagctggtgcccgggccggttgggtctcaggcctgagaagaacgcagacgtctcgcctcatcgtcgctctgtggctttaccggcgtgagactacatttcccgccggccctcgcggcgtgcgctttctggcgccccctttctgcttccagcctcatagcccaggtgcatggaccccttagctctaccgtcgcaggactctgcccttccccaagagaggaaccagaaggaggacctatcagcccttgaaattctaaaagtcatgtcccttgggtcagaattgttcagggatgtggccatagtcttctcccaagaagaatggcagtggttggcacctgctcagagggatttgtacagagacgtgatgttggagacctacagcaacctggtctcactgggtcttgccgtttccaaacctgatgtgatctccttcctagagcaaggcaaagagccctggatggtggagagagtggtgtctggaggcctgtgtccagtattggagtccagatatgataccaaggaattatttccaaagcagcatgtttatgaagtcgaatcaccccaatgggagataatggaaagccttacaagttatggtcttgagtgttcaagtttccaagatgattgggaatgcagaaaccagtttgacagacaacagggaaatccagacagacatttccatcagatgatcatcagacatgaagaaatgcccacttttgaccagcatgcatcccttactttttatcagaaaattcatactagagaaaaaccttttgggtataataaatgtagaaaagacttctggc

SEQ ID NO: 250677 - DNA, 1090 bp, Homo sapiens
ctccagtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactggcccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttgggcatggactagcccaagggaaagacctgcgggagcatctgaagagagaagggatgattttctcctgcccgccggtgtttgtgtgtttataatgcacaactcgcaaatataaattgcacatgcagaaggcacagaccccgtagcgcatgccaacttgcagggactcggtttaatcttgtctcatgaatttccagatggcccactctcttccatatcacaaggacataaacactccttctttcagccccacctccccagggccctggaggagacccccaccctgcaatccacaccccatcctctgctgcagaagctatggtctgtgtggtgacagccagattctctactcttatgttttgtatttgttacatattctatttttataaagggaatttaaaaaaataaatgtgttttgcacaaagctgtttattacaaaaccca

SEQ ID NO: 250678 - DNA, 469 bp, Homo sapiens
cagagttagtgcgagaaaagcagatccataaggtctgttcaatttatatttctaggaggatgagctgggtttggattccttctaacatgtaacttggatatattgttctataaaactttactgaaattgggggaagtctttccaaattaggtaaagtgttttagagggcttagtgcttaaatttcatgaattggtctcagtgctgatctgtgctttagtggcatatgataactacttcaggcattttctatggccagaattgatgttgtatgtgcttctgtgatttgtagtgttatgtcatatcactggattacaggtaattcatttcccattgaaatatgtagccatgaccaaccacagtggctcatgcgtgtaatgccagctctttggaaggccgaagcgagcagattgcttgagctcaggagtatgaaaccaacctggccaacatggtgaaaccctatctctacta

SEQ ID NO: 250679 - DNA, 806 bp, Homo sapiens
agtctgggccggggcgctggaagtcttactcacttctcaagaacccgcaagggatcaggcctgaccctttgcaagtgacagaatccaaagctttgagctcatgggaaagtggctggaaagaaggtcactgtagggccgcacaggtctctggcgaggctacccaagaacatttaaatccctgcccagagaagaagaggctccagctgtcctgcaccttcctgggaactggcagtccctccgcgcaggggttctgcagcgaccggcagcgcgaggagacaaggatggtggccagttaacagaaaatcaaggcagcgggaaaggtctggaaaacaccacctactatcacctctggagcctgggattatgggataagttttcgatttttaaatgtattgtcaaatagctaaagtacacggaaagtgcgaaataatagtaaattgaacacctgtgtattcaccacacagcttaagcaataacattagcaatatttgggtacccagctggtctcattccctcattccacttgtcccctactcacctgatagccagtacaattttatgaatttaaagttactaattcccatgcaactgtttatacttttagtaaatgtgtttatgtccctcatcaacacatgacactgattcaacacatgtatatgcgtttaagctgcatgtaaatggcatcatgttggccaggtgcagttactcacgactgtaattccagcactttggaaggctgagagggaagacggcttgaggcccagagtttgagaccagcctgggcaacatagcaagaccctatctct

SEQ ID NO: 250680 - DNA, 296 bp, Homo sapiens
cagggtgaaggaggtgggtgtcctacacatgcatatgaaaaaaaatatggcaaaatggcacagctggtgcaggaaaatgaaaaaggaatagcattccagttctccgtgaagcagctgaattctctatctgcagcagcattcccattatcttttccatcactaagaaaaaaaaatgggctgggcacggtggctcatgcctgtaatcccagcactttgggaggctgaggcgagaggatcgcttgagcccaggagtttgagaccaccctggccaacatagcaggacttcatctctccca

SEQ ID NO: 250681 - DNA, 352 bp, Homo sapiens
aagaaaatgtagtggttgggtcaggctaacccaaagcataaaaggacattgccacctgtgatcagaagggaggttagccacatgcttattgttttgcaatttagaaaaagagcttggaaagaagtgtgttttctgaattggctactattggtggtagttggcaagatgctgtagaggtgaattgagcggggaaaaagttaccagctagcaattagaaatcaaaaggggccaggcgcggtggctcacgcctgtaatcccagcactttgggaggctgaggtgggcggatcacaaggtcaggagatcgagaccatcctggctaacacggtgaaaccctgtctctactaaaaatac

SEQ ID NO: 250682 - DNA, 435 bp, Homo sapiens
ttgtgtgcccaaggcccatgctatatgagcttgacttctggaaggctggagactgagtaaattcaggagttaagttcagtcacccaggcaccatggacaccagcattcagacgagattacctgtttggcactactttgcacatgctggcacacaccatggtgggaagaattaagtgctgttgccatgcaattctaatggaaggggaaaactggaagcttgtgcctcgtctctcctggactttgtccagtgccttctcccattgttcattgttgcctgcatccttcgccttgagtttgagtatggcagctcttctggatcccaggagtccttccagcaaatcattgagcctgagtggtcctggagaccagtggcacacctttgttcaagataatggttcacttctcaatcaataaaaatgtacttgtagacgcatt

SEQ ID NO: 250683 - DNA, 227 bp, Homo sapiens
agtaggtttaaattcctaatggcagctgatcacagggattacattcaccccagtccctcagccttggcaagtgctggtcccaggaatccaggcttggccataccacaacagttgccatcagcctcccctacatcaagtggaggaccagcagctcagaccctcactctcacataaatgtatacaggttttactggtgaattatacctcaataaaactgcgggaaaaga

SEQ ID NO: 250684 - DNA, 401 bp, Homo sapiens
ctattacaaaggtcatctctttaattcacatccaataactgatagtctcttgactaatctacatcctctcattctctcctaattcacctttcatactgttgccaggtgacttttcctaaaagacaactttcatgatgtcactctacttcataaattcttataatggtttctttttgcttttagtccaaactcctcaggttcgttttcaaggcttttcataattgaatttcttttatatacctaagatgatttctctgtgttcccaaatgtacaattgacagtccttcctcctgatgttctctccagtaggaaatgtttgctctatgtaaattcagtatagcttttagtctctattcaagttctaccttcttcataaacttctcctgaatagaatcagccta

SEQ ID NO: 250685 - DNA, 439 bp, Homo sapiens
tgcatttctcaccccacacacaccttccatttcccagtggctacatacatcatgtgcgattatgcctgtctttcatgacctgcctctgaccagaaatccctgagtcatcttccctaaacccactccttcaaatccaccttccaaatcctggtgaatggactgctgtccctgctccagaggactgtgtgcctcaaacagggctccccacagtgggcctgtattagcagggattccccagtgcatgtttcctgccttggagaccatgaactccagggaggctggagagctgtctgctctgctttctgtcttctgcctgcccaagacagtactttatgtaggtgttaatttcctaaaaatatgtctaacatgcttgaattgctgatagctattgattaaagcccagcttctaatataaatatgcatttctgatgaatctcac

SEQ ID NO: 250686 - DNA, 386 bp, Homo sapiens
ccttaaaatgcacttatggttttgtcagggagttttaaaatataaattcaacagttctgtctagtttgaatgtttagaatgtgtttaatgtgattttctcctgctaagaatgttctttatttcgccaagtacatggcagattttccataatataaactattatatagtgaaactttgtattttcttacaggttcttgagaaatctacatgaaaaaatggatagacaatagtcctaagataataatgttcctataacattaaaaaaatcccctttaagccattgtaagatttactttattgttaacaactagttgtttcattaattattgaatacctatcttttatatggagtataagaaattataaattgttactttaaaaactta

SEQ ID NO: 250687 - DNA, 484 bp, Homo sapiens
caaaacagataaacaaggatgagggctgagtttacctgtgggatagctgaatggttggtgattccattagccaagaaagacaacaatcccagcagtttggggggtgggattagttcactttggacttgtcaggtttgtggtacctactggacatttagagagcattgctctgtagttaatttttctttctttctttctttctttctttctttctttctttcttctttctttctttctttctttctttccttctttctttctttctttctttctttccttccttccttccttccttccttcctttctttccttccttccttccttccttcctttctttccttctttctttctttacttctttctttctttttttgtagggaggacagaatcttgctttgtcacccaggctgcagtgcaatggtgcaatctcaactcagtgcaacttccacctcccagggttcaagtgattctcctgcctcagctt

SEQ ID NO: 250688 - DNA, 408 bp, Homo sapiens
tacttttttctagcaagcttgttgaatatccataatctacaggccactggggaaagaggctagggattctgttattaattaaatgttacatttaattatagctcatcctaggagtgagttttctcttttctgaaagtaagtgactcattcttacacatggtgaaataaagctatttagcatatgttacaggcataagtggcccaaagagcaagatcgtatttgttttgagagctccttttagcatcactttaacaaatttgaatatttatattcttttttcttttctttaccttttttttttttttttttttttaaaagacggagtctcgctcttgtcgcccagcctggagtgagctgagatcacaccactgcactccagcctgggtgacagagcaaaactcagtccc

SEQ ID NO: 250689 - DNA, 598 bp, Homo sapiens
aagccacgaggagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccttttctaccaataaaaggcccttttcagggccaccctaaaaaaaaaaaaaaaaaaaaaaaaaaaaaaaaaaaaaaaaaaaaaacaggcgcagcaagagagaagaggaaaaaaagggaaacgaaacagcaaaagagcaaagagaggcacagacaaaagaaagaaaggaccaaaggagaagaaaacaaagaaaccacaaaaaagagacaaacaaaaaaacaagaaaaaccaagacagacagagaaaagaagag

SEQ ID NO: 250690 - DNA, 385 bp, Homo sapiens
aagccacgaggagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccttttctaccaataaaaggcccttttcagggccacccta

SEQ ID NO: 250691 - DNA, 384 bp, Homo sapiens
caagggcgaaaagtctgtccaaaaaaaaaaaaaaaaaaaaagcaacagcttttgggcaatgatctaccattactacacctcccttcccttcattttcaaaaaaaattttcatgcatttaacaaacattattaagattacattctttcttctcatgttaagtctttgaaatctggggtatattttatacttaaaagcatgtcttaatttggactagacacatttcaagtgctcagtagctacacgtggatagtggtcactgtattagatgcatagcactagtatgtcccaaaataactgttgaggctggacacagtggcttacacctataatcccagcactctgggaggttgaagtcagaggatcattccacgctgcagtgagct

SEQ ID NO: 250692 - DNA, 622 bp, Homo sapiens
taaataatctaatgatgggaaccattcttccattccctggtccaaagtataagctcgtgagtgcacaaaccatgttttcttccttttcacatagtgtaacaaacattgtttattacattgaataattgaaagatgattataaaactggttctggtgccctcctttaaaaacttagaattctttatagaggaaccattcgtggagtcagtcatcagacatgatttcccccaaaatgttaaccactaaataattctgtgctttctgtctttaagagtaggaaaataggatgggaagggtagagtttctctcttagagcttctttgttgatgcatttcatagattgtgtcttgtgactggtatcagatggttttaggattaggctggaactataagtttcctgtttccgatgccccctcgccatcgactctgccccacttctctaagctcccagctacctgcatgcccctcagcctggtcactaaggctgcctccctggcagtcgttctcccgtggatattggatgggtcagatgagcaggatgcatgagaggcacagtcagccctccatctgtggcctccacatctacgggttcaaccacaccatcaatatattttaaaaaaaa

SEQ ID NO: 250693 - DNA, 750 bp, Homo sapiens
tgttccaaatagaagtaaaatagaagttaattagttaatcaagccaatagggttaccctactccagtctgacttggtgcccttattttttgagatagatcttgctctgtcgcccaagactggagtgcagttccactgaggacgcccaagcgggacagccggggatctcaccgcggcgggcccggctgtcccgcttgggcgtcctcagtggaaccgcacaccctttctcagcgcgccggtcgtttggtcctgtagggccgaggggaattcgtgcggtgttgagcacgcgggaagcacttaacgaaagggagctgcccctcagccctcgtgagtccgatgtaaaggagtgaaggagacgaagaactgaatcagtagttgaccgcctgtgagctggcgagctgtgccctggtagggccttaaatcccagccccagaagtcggaggcagggcaggcaccccaaagcgtggaagagatgcacctgcggagtgaaaatgctgctattgcttctagggtcagccttggttcctggaacaaaggagccgcatgactcgggtctggcgatgatgttgggctctgcagtgtcctcatccttccccctctctggttctggaggctgcaagcccaggttcaaggcatcagcaggtgtggtttcctccgaggcctctccccgtggcttgcagatggctgccttcttcctgcatcctcacgtggtccctcctctgcactccagcatccttaatgtctctttgtg

SEQ ID NO: 250694 - DNA, 1088 bp, Homo sapiens
atctcaggctccacgaatggagggaggagcgaacttctgcgacacggattggtcttttgcactgccaatcgtagccgcgctggccgcgcccattggttctgatcgttctggaaatttccacctctcccattgggctgccggactccatgtcggaaccgccttcagaatgagagcgattccaattgggcggagggttgccaactctttgcgctgattggtttaaatcgctgcccttcaaaaggccgggtttcgccccgcccctgatatatgggagtaccggctgcagtcggggtctgtagctgtgtcgccggcggctgcggggcctctgggttgctttccctctcgctcccgagtgccgcgagttccaggcggtccccgggatcgccagcggcacagggccccagcccttcgcccgcgcatcgggatgggggtcctagccggtgggagctgcctgtccctcgagcgccagctacccgcgttgtccagcgctccggcctcggcccggccctcctgcctcctggctgttaggttctgaatgttccggaaatgccacgtgaccgcgagggcgcttgggcttgggctggacaggccggggatctcaccgcggcgggcccggctgtcccgcttgggcgtcctcagtggaaccgcacaccctttctcagcgcgccggtcgtttggtcctgtagggccgaggggaattcgtgcggtgttgagcacgcgggaagcacttaacgaaagggagctgcccctcagccctcgtgagtccgatgtaaaggagtgaaggagacgaagaactgaatcagtagttgaccgcctgtgagctggcgagctgtgccctggtagggccttaaatcccagccccagaagtcggaggcagggcaggcaccccaaagcgtggaagagatgcacctgcggagtgaaaatgctgctattgcttctagggtcagccttggttcctggaacaaaggagccgcatgactcgggtctggcgatgatgttgggctctgcagtgtcctcatccttccccctctctgggtaatgatatcttcccagggtttaaagtgtgtcctctctgccagtaaaaagtc

SEQ ID NO: 250695 - DNA, 452 bp, Homo sapiens
taggggttcttattcccattctataaatgagttattccagaattgatgttgcagacggggcccctgctacctcaagcatccagaagtgaattgactggtaatgaaaacaatttgcccttttcattccggccaaccggaggatatgcaaaaaggagagcaaaatatcatctcaagtctgcgaaaatgcactgttccctgtaaacacagctatgcaacctctcaaaagaatgttccagcaggaggaaggctcaggactgtgattgaataagaataatattgggagtgcattcacttctctgcttctgcctggggccaaatagacaatgaaacttaccttctttatgtttcaactaattaaacccaagcatttggctgccccctcactgcaaaggtggctgaggggaaacccaggaggctctgaaagccttacttgcctggctgttgcttgtaat

SEQ ID NO: 250696 - DNA, 404 bp, Homo sapiens
gttctcctcaaacatggcgccaaggggagcccgttacctgccatgggagctggggcagaagcagcactgacggccgcggaaggctgtaccagaaaggccctcagcctagatgtgcacagctcccgctcagaaccgcaggcagccctgcgcctccgcccccaatctgcgcctgtgagggaggggaaggaggggcaggagtcgaaggagagagcctcctctgccagcatccacgctcggttgccaggttactgcttgctggtctccatgtcgcctggggttgcgttcccggcttacaaatccagggattctctaaaaagaagaaaaggaagaaacgtttttacaagatttgattgtcatgttattgagctttaccatttaagaaacaagtgtcattggttttcaaa

SEQ ID NO: 250697 - DNA, 368 bp, Homo sapiens
gttcctagagcaggcaacgcacgtgggaggcagaaggagtactggacttgggcagcctgccattgggccacttctctgaaccgcccttctacctaatcagcaagtggtgctgttaaggatttgcttctcaaagtgcagcgggagggaccagcagcatccccaccacctgggtgtttgttagaaatgcagaatattgggccccatcccaccctactaaatcagaatctgcattttaacaggatccctaggagacgtttctgcatattaagtttgaaaagcacttacctataccagagtgagtgaggtgatgcttatggaaacaacttctaaattaagcaccaatttaaaaataaatgtgatttttaaaa

SEQ ID NO: 250698 - DNA, 550 bp, Homo sapiens
taggtctccacctcaggccatctttctctcaaatgctgcctcctgtcatatacccaaagcttctgccacatggactctttggcccagtaacaacattttcttttgtgtttctttgcctttatacatcctattctgaccataatgtactttcttccctcagttccacaggaaaaattcctagtcatccttgtagaaccagttcactgttccattccctcctgaagcttccccacatcctccgtgctccccatcccccttcagcatttggtccccatctccatttcagaacaccttcgacggtgttctgaagataaatgccaaaaatttcagctcttattttaatggagtgttaaaattctgattcatatagtcttaaattatcaactccttaaatgtgcttttgaaccaatttgcagaagctcacatagcaagttcataaggttccaaaaaggaagcccatacataacagtggaggtgtatagtctaaccatcacaatgtttgagacttttttttaaacatttctgagttcgaaggttatactgacagatt

SEQ ID NO: 250699 - DNA, 476 bp, Homo sapiens
tctactgaatattctcccatgggctggtggtggagtgagagtggtgtattgtttttgagttgtcttgctgtttgggcaatgagtttgaactacttgttaaccaggtaaggagcagccaaaggtccatgccagagggaaggttcaaggccacactggtttggatgatataacatgaatgactttgagggggaaaatgtggatttgatgccctgcagctatcccaaatggcatcttcgagcaactttgaaaaagccactacttcctctagagccactctacccaacagagtgttccaccagcaacatctggctactgaacaattgaaatgcgactggtataaaatacacaccagatttcaaagacttgatacctttcgaaaggcagagaatatctcaataataattttatattgattgttcgttaaaatgataatacttttgatatattgagttaaagcaaatatatttattattaaa

SEQ ID NO: 250700 - DNA, 271 bp, Homo sapiens
agtggtattgtaaatgttctctattttaatttcaacttcgaattgttgattgctagtgtatatacataaattgatttttgtatattgatcttataacctgcaaacttactaaattttttctagtagcactttaaaatagattaaactggattctccacatagacaatcatgctgtctgaaaatacagttaaacctcttccttttgaacttgaatgcctttttttccttgactcactgtcgagcggccgcgaatttagtagtaggcggccgc

SEQ ID NO: 250701 - DNA, 335 bp, Homo sapiens
cccctgtaaaagttaacagttaaatctattaaggcttaagtactaacctgtgcatgtcacagatttgaattctgaagaaaagaaacccagagggcaagtctttgccttgaaagtagcacaataattttgccgtcactttaaaaattctgctttaaattattcagatttcaatattcttgtttcttttcagtttgtaattaccattaggattctatcaacaacaatattttagccaattatactactgaatgctgtgtttttaaaaaaacaattacagatggcaacccactttgcaaatctcctctgtaaaaataaaataatatttaatgttggtt

SEQ ID NO: 250702 - DNA, 548 bp, Homo sapiens
gtgaatcattgaccagtatttggtaatctttttgtcatagagatttatttttggtttaatcaacttccatcaacattaaaaaaaaataactaacatgggttgggcacttctggcatcatttaaatgctttatgagtattaactcattaacacactaaacactatgaagtttacagatgatgaaattgaggcacagaacagcgaaattacttggctcaaggtaataagaaagtgacagtcctaggagagtaagtgtttaactatagagcccaagtttttagccattacgtatgttgtgtgagtttcagtacagtttgaccagaaaagcactattatggtggtaaagtttctgtgtctgaggggaaagcatgtcatgttctattttgatttagaaaaagttgcttagtgaagttcccataatagtcatatccacatgtagttaagaaacagctggcttgtactcagctctgcagatgttttattgagcacatactgcaggccaagcagtgctttaggtgtcagggatattacagtagacaaaaaaaaaca

SEQ ID NO: 250703 - DNA, 482 bp, Homo sapiens
ccagaatgcaggtattcgtgttggtattatactttattattgttattacttatcataataagtgtttcaggttagtttttctatcatagaaaaactattagtgggagcctagttagccatatcttcagccccatctacaatactgattttcacataaaagttatttgctacaaatttggtacataggtttcaaataaggaaagatctatataagcacttagttttgaaatttttctgctctgtgtcttgaccgtttactcacaaacaagagaaaaggtgtttgtatctcctctgatgcaatttgtaaatgggaaagtgcatatttctatgtttcaaattttgtgttgctatctttatggtttgaattgttaaacatgatttatgacttaataaagctgcttttgaaaaatatacttagaaaaatagtatagctgtttcaaagtaaaaacaaatttaaaaataaaacttgctactattgatga

SEQ ID NO: 250704 - DNA, 433 bp, Homo sapiens
gcagggtgagaacccctgctttatggtgagtaggatggagtatttttctagtaggggttgctcccaaatgccagcccatggaagatttagtacctccatgtgggtggtcgtagtacccacatcttagcttttaccagacattctattccatttctttggataacagccttctctttttttcctagggaaagtacctgggtggttgtgttctggagagggagagggcagagagaatttgttgtaacagctttgtctgttttttgtagaattttaattcattctcatttatagccccatttctcacactgtacctaagcccaccctttagagcataacttcctttttgtctatcagaaatttgactcttaattcctgatgaatgcacttcatgcctcccatacacacacacacacacacacaaaacacaacacac

SEQ ID NO: 250705 - DNA, 738 bp, Homo sapiens
atcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgtgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcagcaggacaaactggacacatggagttacagtgtgtacacggcagtcccgccacccagcccccttgtaaactctagtcactataaacacacccgtacgcctaaaatgtcca

SEQ ID NO: 250706 - DNA, 391 bp, Homo sapiens
tattaatacagctggtgctggagatagaataaaggaggtacaaacagactataatggagagaggatagagaaagagaagcttaggtaaaggcagaaagtggagggaggaagaaaagattgcaactagattcttcctgtgagacaaggactttggaagggttctcgggtctctgcattgtttgtaccttcaagaaaaatggggccttggagagggagttgctgaaaggtcacaaagcctgttggccagcaggtttaaaagtcaaatttccattcctggaccagcctttgaaccagcttggttgatggctgctcggtgggaggatcgcttgagtcccgaagtttgagaccagcctggacaaaatagggagaccctgtctctacaatttctggg

SEQ ID NO: 250707 - DNA, 472 bp, Homo sapiens
cagcctcttccagaggctgctggagtccccggcgacagcacttggtgactctggggccagcacccaggggacgacgttcaaccctagcctgaagggacccgctcccagctcagaagccgtctctgacttctcgtgcgtattttgaccctgatttcaatcttctacccttgggagttctggcgtttggcacaaagtcccctctgcctgtttggagctcagtgctagaccaggtcccctgccccgagctttgtttttggggttatttattgaaacaaagtgtggggagctggttgtgggtgtgagtgggggtgtggggtccaggctgggcccagtgaaaaggaggaaggggttcccatgcgggggaggctctggggctgaggggaacaattctcacgtgtttggtgcttagagacctgcccggggcgttgggcaggccctccgggggctgaattaaaaatgctttatttccaaa

SEQ ID NO: 250708 - DNA, 255 bp, Homo sapiens
gctttctttgcatagattattattgtatccttctgacaggttcacaaatgattccatcttttccttctgcaaattattccagagtcattttctaaaatacagatatgatctccatatatgtcagggtaaaactcaaaatcctcacttgatgtacaaggcctctaggagtcaagacttgcctgaggcttcggcctcatcggtctcactaaactactgcatatatcagagtgcaacattaaaccttttttgcagaaa

SEQ ID NO: 250709 - DNA, 503 bp, Homo sapiens
cactcttcacacagtgcttacgagtttctgaagtctttattggtactctgcacaccttcacacctccgtgagaagaaaacagtagatttatattagaaactgtattgaaaaatgtctacttcaaacacactcaaaggactttccggttgttttattgctatgccagaataccttcatgtaactgaagtaacttggactaagcaagagagaaaaacgttaacaggccaggcctgggtccaacagtgaagaacgagaagattgttcttgaggcctagtcaatatcaatgtaagcatcacaatgaaggaaaacatgactacataaaaaattaacaacaaggaggctgatttccttttgagaggaaaaaattttgaaaacctgaagaattgagagcatagaaagaaacccatgtaatcatgtaagtacagtgcctgccacaaagttaacactatctgttcaatccatactgaaagaaaaaataaatgttgagacagtatctttgaat

SEQ ID NO: 250710 - DNA, 399 bp, Homo sapiens
catatagaggtgccagcccttcactcaatgcctaatcaaaacagttccgatgacagagcctctcctcataggctttacatttgcaaaatgatttgctaagaccaagtagagttgatgcacgtgcccatgacctagcaattccactcccaggtattcaccgaagacgctctcccaactgtgcaccaggaagcacctgccaggatgttccaagcattatttgcacggaaaaacctgaaaacaatccaaatacacaccaaaaggaaagtgggcaaatcgtggtaatgccacataatagtgaaaaatgcatgaaccacagtccacatcatcatggatgaatttcagaaatgtaatactgagtccaaaaaaataaaaaataaaaccagcctcttacaaaggaaa

SEQ ID NO: 250711 - DNA, 1053 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250712 - DNA, 865 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250713 - DNA, 507 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaattccatgacacccagagacacttgcattagaggggccg

SEQ ID NO: 250714 - DNA, 332 bp, Homo sapiens
aatagaactagcgctataccaggtcttttcccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250715 - DNA, 1229 bp, Homo sapiens
aggatatacaaggcctgggtttactctaaggtttctgcacagagaccataacttgtgaggcttctctgaagctcattgcattctatattcattgcctattttctgatccttctggccactgccggtgtgattccccagcaggccctctccatcaatatccctgtcccagaaataggaattgacggtgcacaaataacttcctggaatgcaggaccattcctaagttatcactaacaccctaccaagagactgtatctagagacattaacctgaaatctaggactcagcagcttctctccacagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250716 - DNA, 950 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250717 - DNA, 1227 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattaggtaatgggagagggagggaagcctggctggggctgactaccttccctctgcagcggggtcctataatttccttttatccccatcagttgctctcaactcacagggcactgggcacaggtgtgcctcggatataaactatcacgctttctcacaactgtctctttgacctcacagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250718 - DNA, 1485 bp, Homo sapiens
aggatatacaaggcctgggtttactctaaggtttctgcacagagaccataacttgtgaggcttctctgaagctcattgcattctatattcattgcctattttctgatccttctggccactgccggtgtgattccccagcaggccctctccatcaatatccctgtcccagaaataggaattgacggtgcacaaataacttcctggaatgcaggaccattcctaagttatcactaacaccctaccaagagactgtatctagagacattaacctgaaatctaggactcagcagcttctctccacagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacaggtgactgcctaaccctgagggccaggggctgaggtaggatgagcctcacctccaccacaaggcttgttctctccctttcagaaggtgctatagggctgcgcattgcactggccatctcagctatagccgtcttcctggtcttggtgtctgcctgtatccttcgatttggcaccaggtctctctgcaactccatcatctccttgaacactacaattaggtaatgggagagggagggaagcctggctggggctgactaccttccctctgcagcggggtcctataatttccttttatccccatcagttgctctcaactcacagggcactgggcacaggtgtgcctcggatataaactatcacgctttctcacaactgtctctttgacctcacagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250719 - DNA, 891 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattaggtaatgggagagggagggaagcctggctggggctgactaccttccctctgcagcggggtcctataatttccttttatccccatcagttgctctcaactcacagggcactgggcacaggtgtgcctcggatataaactatcacgctttctcacaactgtctctttgacctcacagctgttctgaagcccagaaaattccatggacaccccctggaactgctctgcagttttactccaacctacacaatgctgaagtgagacccaaggataggaggaaaaactgacataaatatctgtagctgtgtgggtgctcaccagtgtattgtgagcttggcctaccagtgagaggagctgaaggggttgtcagcttaaaattcagcagttcagagtggtgtgtgggtgggaaggactggatttgaaatggtcccactcctgacgatcc

SEQ ID NO: 250720 - DNA, 974 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250721 - DNA, 1129 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacattatttctcctgggccattgatccatctacccttttaatccttttcttctaggggcgttgccctgttatccctattttgcctctttttctaagtctcctggtattactatttttcctcggtccattcatttttggtcatactctctcatttacctggtgttaactccccttgtgtatgaatacccctctactcatacgttgcatcttggcctggtccctttttttgcctctttggattctctcacacgtggtgtttcaaattcttctcctcattatctctccttcttttcctcaaatttaatacaattctcct

SEQ ID NO: 250722 - DNA, 1011 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaaaatggttg

SEQ ID NO: 250723 - DNA, 717 bp, Homo sapiens
ggcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaagtgagacccaaggataggaggaaaaactgacataaatatctgtagctgtgtgggtgctcaccagtgtattgtgagcttggcctaccagtgagaggagctgaaggggttgtcagcttaaaattcagcagttcagagtggtgtgtgggtgggaaggactggatttgaaatggtcccactcctgacgatcc

SEQ ID NO: 250724 - DNA, 425 bp, Homo sapiens
gagaatcagttcttgagttaagaggctgtgtgcaggctacgcactcccagggtacggaatctttcgcacacaatgttctcagctgtcactcccgtggttggacacacatgtttctctctccaggccaccctctcctgtgatttgcagacatgcatattggtctcctgtgcatctccccctggaagccctgcaagaatctctcgctcaacacattcagaatgttcagcatctttcccaggaaatgtttcctcccatcttccaaacagtctgtaagtcagaaagcagggagtcagtctgagcttttccataaagctctccttatccttcaccatcttctcaaactcccattcccatgaaaacctttcaagacctaagctgtactagtccattctcatactgctatgaagaaatacccaagactgggt

SEQ ID NO: 250725 - DNA, 344 bp, Homo sapiens
tcctgaatcaggagtttgtagttccaattaagagtttttcaacagcttgtagttatagggacattatttgactatggttattatttgctttacctaaccactcacctggtacaacgacctccatcctggaagagggataggaaacaataatgatggtgctgactctcaccaggaaaggccatgggggacacgggatagaggttgtaaactgagtgagggtcaaaagtaacagataacttttgtgcacacggatggtaacttgtggtgtctttttttttttctttgctttgggcaaaggtcttcacagttcttaggatcaagtgcactttgaagatgaggatgta

SEQ ID NO: 250726 - DNA, 777 bp, Homo sapiens
  misc_feature (11)..(11): n is a, c, g, or t
  misc_feature (34)..(34): n is a, c, g, or t
  misc_feature (64)..(65): n is a, c, g, or t
  misc_feature (125)..(125): n is a, c, g, or t
  misc_feature (297)..(297): n is a, c, g, or t
gacagattatnatgaataaagttatataagcttncctaagcaggctatgtgtgaacattagttnncaactcagttgagtaaatgcttaggaacttggttactgcattctgtggtgaaactatgtntagatttataagaaactgtaaaactgtagtccaaagtggctataccattttaccattatttccaccaacaatgcatgaacgttcccatcactccactttcttgccaatatttggtattatcagtcttatggatttagctatcctaataggtatatactggtatgtcattgtnttaatttgtaatcccctaatgacatatgatgttaatattttctaccattctgtgacttgtcctttcattctcttaacagtattgtataaagcctaggaccatggttctcactttttgtgttaaagacatagttttgtataatgttagaatttttgatagtacattaaagaattaaaggtaaatgtcatttatttttaaaaaagcaagtttcagaaaattgaagaacctgttcgtgattatttacactattgttcaccctctggtgtgttactgtttgaacagtattgtttgcagccctgaccttgttctcttatatcctttgaggtaaagttcatatatgttcctctgaacatgcaatctttattttattttcagcaaattgtatcatgggcaatattttggcttagtgtctgatagaaatccctgtaaaattgtggattgttagttgaacaaaaataaattctatatattgtttaaaat

SEQ ID NO: 250727 - DNA, 428 bp, Homo sapiens
tgcatgggcatctcaaattcagatgttcatagagaatgtctgagcctgtaaggacagcacctagcccactagggcaaaggtgggaaaggggtgcttgtgagtgagcatcagccggaacagcatagtcagacatagaaagcagccgaacaaggagactctttgcttttgttttgcaaatatattatggaacaagaaaatacgaataaagcctctgcatagggaaggtagtattaatttgcttgcttaaccaaatatttattgggtacccattatatgttgagcactcttgtaggtataggagatgccataggtagcaaaacaaaaatctatccccatagaacttaaagggcatgaagaagcagtagaaaaaataaccatagtaaggaagtaaaattctttaactgttaggtggtggtggatgctatgga

SEQ ID NO: 250728 - DNA, 416 bp, Homo sapiens
tcacaaatttgatataaaacaatctatatatttaacaagctactccaaacaggataaacttaaagagatccaaatctagacacaataaccaaactgtcacaagagaagacaaagagaaaatcttcaaagcaacaatggagaacccactcattgtgcacaagggatcctcaaaaaggtcaatatctgatttctcatgagaaaccatgaaagccagagtggagcagggtgggaatagataatatattcaaagttctgaaattaaaaaagacaatcaaccaagaattctgtatgtaacaaaactattcaccaaaaacaaaagagaacttaagatattaccagataaatgaaaaacaacagtcctttgggttgaaatgaaaggacactgtacaacagctcaaatccacatgaagaaataa

SEQ ID NO: 250729 - DNA, 175 bp, Homo sapiens
cattgtagtacatacatttattagcatctctgatgattttcttaggataaattttgtaagtgaatttactaggtcaaagggtggtgaacattgatattctcttgactatgtcacctatttgttatggtttggggaatgctagtaagaagagttacaataaaaccttaaaaaaaaa

SEQ ID NO: 250730 - DNA, 953 bp, Homo sapiens
gactttagtgtactatctaagaaatatttgcctactccaaggtcatgaaaatattcaaaaaacaatttacaatattagcatgggtttatatatgtactttctatgctataccattgatctatttgtctacccttatgctggtaagattttgccttaaatatcatggcttaacaaaagtcttgaagtcaattagaaaagattggcttggattttctagattctttgcttttatacattatcttttcaaatcagtttgtcaatttcttcaagaaaaaactttaggacttttttttggatttgaattgaagctacagataaatttgggggagatgacaacaacattgagcttccaatctgttaacattgtatatctctccatttacttacatgtgtttaattttacccagcactgcttatagtttttagaagtcatgtacatctttcattaaatttattcctctccaaaaacctattgaaataaaaaatttaatttaattaaatttaaaaaataataaatttattcctagttattttattgttttggtgttactttaaatgataatgcttttcaaattccttattactattatatgaaaatataattggtttgaaacatattaaccatgaatttatggcattgctaaattcatgtagtatttctagtaaattatttatagatttcctttgtattttaaagaaaataattatatcatgaacaaatagactgacttactgtttctttccaaacaattacttctattttttggtctcatttcactggttaggagtttgaatacaatgttgaagagaagtgatgagagtggacttccttgccttatttccaatttcaaggaagaagcacttagcagcaccattaagtgtgatgtttgctatacctttatacatattcctgcgtctttctttccttccttccttctttcctttctaaaaaa

SEQ ID NO: 250731 - DNA, 580 bp, Homo sapiens
ctgaaggtgcagtgcagagggagatggaaatttaaacttctcagaaacacagtaatgataagtaaccaaggacttccaccaaagctcagtcccacgatgacgatggtcagccagtcacaaaaggacaaatactgtatgattctacttatgtgaggtactagagtagtcaaattcagagagacagaaagtctagtgctagttgccaggggctaggggtaggggacaatgagcagctattgtttaatgggtacagagtttcagttttgcaagataaagggttctggacattggtggtaatggtggcaacagcaatgtgaatgtacttaatgccactgagctgtacacttaaaaatgataagatgataaattttgtattctgtacattttatgacagttttttttttttaaacctcacttggtaaaggttagtaattggtcttgctcatatttctaacccaagagaaaagacaggatggaatctccacagccatgaatgattatggaatattctctcagtgacatgtaaggacctgaggcaatgaagttgcacagagctggaagacatgcctgctgcttcgct

SEQ ID NO: 250732 - DNA, 617 bp, Homo sapiens
gagagagaacctccatgaacccagtttctccaacaataaagtgcataaaaaagacaaagatggtgagattaagagaccataaattaaaaaggagactttgagttcacatcaatcaatcaatcgcaatgtgtggaccttgtaatagttgattccaggtgtcaacctgactggattaagggatacccagatagctggtgaaagcattaattatcctcagtggttcagacagcactgagctcgtccctcttctgctgaaaggaaaacccgggcggtcaggcatttgattagaatgactgggctgtcccagtgcctgtgagggtatttcctgaagagactggcatttgagttagtagactgataggggaagtttcactctcaatgtgggtgggcagcattcaataagctggggcccagatggaacaaaaagaggaggcaagagtaattcttgctgtcagaactccagattctatggtcttcggattccaggacttgcaccagcactgctgccctttccccccatgatcacgttggcaagtgtgataatggtatcgtgtttttaaaaagaattcctatattttaaataacatacatattcttaataacaaaaaagtaggaca

SEQ ID NO: 250733 - DNA, 740 bp, Homo sapiens
tgacttgatatgagaactaacccaatatggcaggaagccactgacatgtgggagccgtgcatggcagtggccagcgtccttgtcctgcgggggctctgtggacatcactcgccttcagaacactgagccctcctacctcctgatatccagggctgccgatgggaaatcccaggctgccgcggctcctgtgtgctttgaagggtgcgcgactctgctctcaagaccccctggaggcccgccccctgccccccaccagctcattcgttagatgattggaagtgactgcctacgtcttctttcaggataaagcctcaagtcctgcaactattccttgtgtgataacgtttcaaatcccttcctggttctggcaaagctcctcaaacatgctccagtgtgctggggctctgcatgtgtgagcctggggccagcagggcgcacgttcatgtcagggcaccagtatgatcctgatgacacatgactggtgtggagccccgggtgtttccacgggaactgctgtcggccggattgctgtgctctgcagctgtgcccaagtccccaagccaccctttcgttgctgctcgatgtcaccatttgcttttgttgttttttttttgtttttgagatggagtctcactctgtcgcccaggctggagtgcagtggcgtgatctcggctcactgcaagctccgcctcccgggttcacgccattctcctgcctcagcctcccgagtagctgggatt

SEQ ID NO: 250734 - DNA, 814 bp, Homo sapiens
tgacttgatatgagaactaacccaatatggcaggaagccactgacatgtgggagccgtgcatggcagtggccagcgtccttgtcctgcgggggctctgtggacatcactcgccttcagaacactgagccctcctacctcctgatatccagggctgccgatgggaaatcccaggctgccgcggctcctgtgtgctttgaagttttcaggatttttgtcaaacatccggggacccttagctggagaggatggcatgggtgacacgcagctggccagggtgcgcgactctgctctcaagaccccctggaggcccgccccctgccccccaccagctcattcgttagatgattggaagtgactgcctacgtcttctttcaggataaagcctcaagtcctgcaactattccttgtgtgataacgtttcaaatcccttcctggttctggcaaagctcctcaaacatgctccagtgtgctggggctctgcatgtgtgagcctggggccagcagggcgcacgttcatgtcagggcaccagtatgatcctgatgacacatgactggtgtggagccccgggtgtttccacgggaactgctgtcggccggattgctgtgctctgcagctgtgcccaagtccccaagccaccctttcgttgctgctcgatgtcaccatttgcttttgttgttttttttttgtttttgagatggagtctcactctgtcgcccaggctggagtgcagtggcgtgatctcggctcactgcaagctccgcctcccgggttcacgccattctcctgcctcagcctcccgagtagctgggatt

SEQ ID NO: 250735 - DNA, 1109 bp, Homo sapiens
tgacttgatatgagaactaacccaatatggcaggaagccactgacatgtgggagccgtgcatggcagtggccagcgtccttgtcctgcgggggctctgtggacatcactcgccttcagaacactgagccctcctacctcctgatatccagggctgccgatgggaaatcccaggctgccgcggctcctgtgtgctttgaagttttcaggatttttgtcaaacatccggggacccttagctggagaggatggcatgggtgacacgcagctggccaggtacgctctggggcactggggcatcttgagcaccttggtgcagtgtcgtgaagaagacactgtaaattggacttggtgttatcacaggggctttaggatcacggtgttggtagatctaggatgataatctccaaaacgcactccccaacccactgcagggatcctttctcttgtcacctcactttgtgatttagaatgcaggacctccaggacagcagcctctccgtggcacaacagctgttaggagaccttgcctagttgacgagaaagtcacttgtggtgcctttccatccagggtgcgcgactctgctctcaagaccccctggaggcccgccccctgccccccaccagctcattcgttagatgattggaagtgactgcctacgtcttctttcaggataaagcctcaagtcctgcaactattccttgtgtgataacgtttcaaatcccttcctggttctggcaaagctcctcaaacatgctccagtgtgctggggctctgcatgtgtgagcctggggccagcagggcgcacgttcatgtcagggcaccagtatgatcctgatgacacatgactggtgtggagccccgggtgtttccacgggaactgctgtcggccggattgctgtgctctgcagctgtgcccaagtccccaagccaccctttcgttgctgctcgatgtcaccatttgcttttgttgttttttttttgtttttgagatggagtctcactctgtcgcccaggctggagtgcagtggcgtgatctcggctcactgcaagctccgcctcccgggttcacgccattctcctgcctcagcctcccgagtagctgggatt

SEQ ID NO: 250736 - DNA, 439 bp, Homo sapiens
gggaaatcccaggctgccgcggctcctgtgtgctttgaaggtaactttcctttgctctcgcgctccttgggctcagcgccctttcagtctgatgagatctgggcggttttcttcaagccttctctgacaattccatcactgtcctcaccctcttcttttttttctagaactttggttagccagatacagactctcctggtttgattctgtctcttttcattctacattctagaagatactcttaactttatatttcagtcatgttaatgaatgtcttcttttaatgccagcaattgcatttttaatgtccaagctctctgtctcattagtagcattttttatttcgtaagtgcagtatcatcttgaatacttctgaagacaagtataacttaaaaaaattcctttctgtttctagagctagctcagtttctttcagcct

SEQ ID NO: 250737 - DNA, 411 bp, Homo sapiens
ctctggggcactggggcatcttgagcaccttggtgcagtgtcgtgaagaagacactgtaaattggacttggtgttatcacaggggctttaggatcacggtgttggtagatctaggatgataatctccaaaacgcactccccaacccactgcagggatcctttctcttgtcacctcactttgtgatttagaatgcaggacctccaggacagcagcctctccgtggcacaacagctgttaggagaccttgcctagttgacgagaaagtcacttgtggtgcctttccatccagggtgcgcgactctgctctcaagaccccctggaggcccgccccctgccccccaccagctcattcgttagatgattggaagtgactgcctacgtcttctttcaggataaagcctcaagtcctg

SEQ ID NO: 250738 - DNA, 400 bp, Homo sapiens
tttttgggggagtatcaattacttgtataaacagtgaaatgaaaacaattcttattcatctgaactacagactttcaaatttgggacacaagacttcaaaaacaaaaaaacaaacaaacaaaaaaaatcaaggcatgagagaatgaaactctggttcttattcccattctgcccttaaccaggcaaacttgtttgcccaagcacaagaaaaggaacttagacttagaacccttctaactctaaaatttgattctactttgccaaggaaaacgaagattgggaacataattttcaataatatggacagaaaatccttataattactctggagattaaagtctctaaagtctctaagcaactcactttcagatagatgctgccccagcaaaaaaaaaaaaaa

SEQ ID NO: 250739 - DNA, 307 bp, Homo sapiens
tatgaataaataataaaatgtgtgcaaactgaaaattgtgagatgcagcaaagagcattatgtgagagcaatctataagcttagttgtttacgctggaaactcagaaaggctgaaagttaattaagcatacaactcaagttagaaaaaagtagcatcagaataaatgcagataatgtaatggaaggataacagatgagaagagaaattgatgaaatagaaaataaggacaatactagggagaagtaacaaagccaacagttgttttccagaaaagtctaatacaaaagtcattagtgagatttatca

SEQ ID NO: 250740 - DNA, 339 bp, Homo sapiens
agtcccaggaggggagcaggtctagcaggaatgcccttgtgcctgtgcaggagagcagcaggactaggaggctgcagacagacagtgggtaactgaaaggtgaactttctactagacagcaaatccctggatgtcatcctgatggatctaagatgaaaaataccccaccatgaaaatgccttacgtggtcccaaccatgaagcgtaaaattgccttttcacctgaaaacgacctgcagcttggtttagcattttatgcttcggatgtcatctaacatccagaagcaataccctcccccgttgcaagtcaaggtaaaatcagaaaatgctcggtggaaag

SEQ ID NO: 250741 - DNA, 464 bp, Homo sapiens
tccattcttcaagtagcaactggaatgtgctagcagccactttcacattaatgggagaactgttatagcccttgagtgaaagcatggcttatttcacctagtttccctggtgccaggcttagagcagaaggtcaaaaagttagcagatcagaagttttgcttgtaaattattctgcttcttttttcatccagtcttagagccccccaaaatgcactcttggatctggtgcactgttgttggtacgaacagtaaatcacaggctctacctaaacagctaatgaatgaacaaaacatcttatataaaagctccatcttaacagaagtttaaaaaagttctgtgttggtgagagttggaggaaaaagtgtactcccaaacatattattggggaaatgtaaattgtttaagtcctgtgtaatttggcaatgaccattacaattaaaaatgtatataccctgtgaccca

SEQ ID NO: 250742 - DNA, 636 bp, Homo sapiens
aaatcttctgtaataaaataaccttccaactcttattccatctattagctaattcagaacaagtgaattaacatcaaacaaaaatgtggatagatattttgttcttaatgtaaggcaaatcttttgaattatttttcttgactggaggctaagtcagtgccattattttcataatttaaggactgtggaacatcctacacaatatttcatagaaattttatttgaccttgaaagatctgtgataatctggagcattttccctctgaaagtaaataaagatatgatatcattatagaagcatttatacatataaagatgtctctttgtataatgtttataaaaggcaatctctataaagatgtttttaatgaaaggcatctatcagtgtaactaaagattttgtgactggacttaagggtttaccaaaggaatcagagattacatattaaacacctaccctgggctgctcttacttgccctagaagaggagggagcatttttttttttttttttttggatacctagaacaacagttcctgacatagataatcaatgtttttaaaaagcatgaatgtgctgcacccattaactcgtcatttagcattaggtatatctcctaatgctatccctccccaa

SEQ ID NO: 250743 - DNA, 574 bp, Homo sapiens
aaatcttctgtaataaaataaccttccaactcttattccatctattagctaattcagaacaagtgaattaacatcaaacaaaaatgtggatagatattttgttcttaatgtaaggcaaatcttttgaattatttttcttgactggaggctaagtcagtgccattattttcataatttaaggactgtggaacatcctacacaatatttcatagaaattttatttgaccttgaaagatctgtgataatctggagcattttccctctgaaagtaaataaagatatgatatcattatagaagcatttatacatataaagatgtctctttgtataatgtttataaaaggcaatctctataaagatgtttttaatgaaaggcatctatcagtgtaactaaagattttgtgactggacttaagggtttaccaaaggaatcagagattacatattttttttggatacctagaacaacagttcctgacatagataatcaatgtttttaaaaagcatgaatgtgctgcacccattaactcgtcatttagcattaggtatatctcctaatgctatccctccccaa

SEQ ID NO: 250744 - DNA, 511 bp, Homo sapiens
gcttaggacctgtccccctgggtagctcacaacacctcaaacatagcagtcagaggccacccgcgaaggccctcccacgctccagccaacttctccgcacttcccaacatcagactttggtcccatcttctttgtttcctttcacttccctttcccctgcatcattcattcaacaggtacgtgttgagcatctattatgcaccaggtgctgtttaagatgctggtaatactggagtgaacaagacagacatggtctctgctctcacggagcttacattccagtgggaggttacagaccgaacaaataacccaataaattggatcattgcagattctcagaagtatttcgcagaaaatagacagccttggccgggtgtagcggttcacacctgtgatcccagcactgtgggaggctgaggcgagaggattgcttgagcccaggagtttgagaccagcctggccaatatagtgagaccctgtctctacaaaaaataagaaattagctgggtgt

SEQ ID NO: 250745 - DNA, 577 bp, Homo sapiens
gcttaggacctgtccccctgggtagctcacaacacctcaaacatagcagtcagaggccacccgcgaaggccctcccacgctccagccaacttctccgcacttcccaacatcagactttggtcccatcttctttgtttcctttcacttccctttcccctgcatcattcattcaacaggtacgtgttgagcatctattatgcaccaggtgctgtttaagatgctggtaatactggagtgaacaagacagacatggtctctgctctcacggagcttacattccagtgggaggttacagaccgaacaaataacccaataaattggatcacctgagccaaggaggtcgacgctgcagtgagttggattgtgacactgcacttcagcctgggtgataaagcaagattctgtgtcaaaaaaaaaaaaaaaagagagggaaggaaagaaggaagggaaggaagaaagaaaaagagaaagaaggaaaaaaaggaaagagcgagaaagaagaaagaaaaggaaggaaggaaagaaagaaaagaaaggaaagaaaaagaaaaagtgacacccagtcgaaagaagaaag

SEQ ID NO: 250746 - DNA, 369 bp, Homo sapiens
  misc_feature (46)..(46): n is a, c, g, or t
gaggattaatagtataatgtaaaagctggcagcactgaaaaccctngcacttacccagctttcacatcagtatttgggaaatattgttaagctcatttgtcaggcggggattctgaggctcagagcagttccagaactttctacagattattttgccttgtttgcacttcagcctgggtgataaagcaagattctgtgtcaaaaaaaaaaaaaaaagagagggaaggaaagaaggaagggaaggaagaaagaaaaagagaaagaaggaaaaaaaggaaagagcgagaaagaagaaagaaaaggaaggaaggaaagaaagaaaagaaaggaaagaaaaagaaaaagtgacacccagtcgaaagaagaaag

SEQ ID NO: 250747 - DNA, 224 bp, Homo sapiens
tgattgagatgaggaggagctggtttttattggggtgaaatataaagatattagttgagttttgagcatttgttagaggttcctatgggatattcaggtggaggtgcattttagtctggagttcagagagagcaggctggagttagaagtttgcatatagataagtaattaaagctacaagggagaatggaccagctcacattggagtaatgagtagaaaagaa

SEQ ID NO: 250748 - DNA, 345 bp, Homo sapiens
ggaacttctggaaataaaaaaaaattggatggtgttaacaacagattagatactgcaaaaaaaaaaggtcaatcaacttgaagacatagcaatagaaactatccaaaatgaagctcaaagagaaagacagatggcggggtgaaagtgaacagagcctaacacggtgaaaacccatctctactaaaaatacaaaaaattagttgggcatggtggcacgtgcctgtagtcccagttactcaggaggctgaggcaagaaaatcacttgaacctgggaggcagaggttgcagtgagctgagatcatgccactgtactccagcctgggcaacagagcgagactctgtctc

SEQ ID NO: 250749 - DNA, 534 bp, Homo sapiens
atgtagtcccttctttccaggtgtcttcctgaagagagaaaaatttgtagatcagagagatgcaattgggagctccgtagtgaatctagttagaaatgagtagcagaaaaaataggaaagacccgtctctcaatattatggttgcttcccaaaacaaaaccagttgatacagcatgaaggcaatttaaaatgatagatatggacatgctgccttacatttcatatcacctctttactaaatgagaattttttggatgcatagggaaagtttgcataatattgaaaagtttgactttctggaatctatgtgagctcaggaatatatttggggatcttagcagaggccagtggtagcctattaaatctaaaacaattggctttgtttttaaaaccagctgctattttgtagtttcatttaaagaaaaagtaccttctattcatttgcagaagttgctttattggattctatggtcattgtatatcataactatatcttttttgttacctgaaataaacatgtggcaattttcctga

SEQ ID NO: 250750 - DNA, 990 bp, Homo sapiens
ggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaagctggaaagatttagccagctcttaaaagtgtttctaggattttaatgtagtctttttcccgctgattttattatcactctgtattcttctctggtcatgagattgaaccataaaagtcatgtagatgcttgttataagtatttgccaaagtcatcattgtcagtgattttattggcatgtgtgaaattagagattaaacttgcttttaaatcttg

SEQ ID NO: 250751 - DNA, 302 bp, Homo sapiens
atggttagcgtgctgggtatagatattatttcaaattcagtaagtctaatactgaactcattatctctctactcccaacttgttcctcaccctccttgctccacaatccaactcctactgatctttcacttttcagttcaaatattacttacactgggtgcagtggcttcacacctgtaattctagcactttggggaggccaaggcaggaggatcacttgagcccaggaggtccgggctgcagtgagctgatatatccccactgtactccagcctgagcaacagaacgagactctgtctcaa

SEQ ID NO: 250752 - DNA, 402 bp, Homo sapiens
caaactatagttcattggtcaaaagcacagataatgatctgcttcttgatactgatagtcttgtgggacggagcccttaacctgtggggtctgcattcactccagttagtgtcacaatcgaattgaattgtaggatacgcagctggaatcagttcctgtaagaaagcaccctcccgtatttggtggccggaagtgtgagtgtgagtatggaggagaagagctgatgtttcctcgactgggagaaagaaatttctgttgtttcggctactcatttgtggtattttgttatagcagcctgagcagattactacagtggcctacagcattcctctttctcattaacaatatattttggtaatattccatgccagtagcaagggatcaaccgtacttttttgcatt

SEQ ID NO: 250753 - DNA, 919 bp, Homo sapiens
atctcatattatggaaaattttttaaatccttggaaataaatgaacattctgaagcatctatatgccagatcctgtattcagttctgaaatgagaattctaatgccttaaattacaatggagcttacagaactgtccgttcagtgccatggtgacagcgggagtctctaaagcaaagatcgaagtggtttcacagcaacgattctcagacaattttccaattagttatttgattttttaatgatactatttattccttttcactattatagaattgactatactaaaatacatgtttctggccgggccgtggctcacgcctgtaattgggaggccaggtcaggtggatcatttgaggtcaggagttcaagaccagcctggccaacatggtaaaaccctgtctctactaaaaacacaaaaaaataagccgggcatggtgggacatgcctgtaatcccagctactcaggaggctgaggcacgagaatcgcttgaacccaggaggtggaggttgtagtgaaccaagatcatgccattgcactcccgcctgggtgacagaatgagaccctgtctcaaaaaaataataaaataaaataaaataaaaaatatgtttcttataagactttttaagggccctgggaagtgaaccttacaggcttttagtgatatacgttttaaagcataacacacccattatgacacatatgaccactaacacctacatttcagtctgcgcttatcttctacaggctcagtcctctgtcagaaatactttcctttaaggtcatacacttatgggaaaaaataattaaagaaatataactataaataaaataataatattcatttacatttattatggttaaaccacattactttccttttactctaggccttttgaccccttcccattactactttg

SEQ ID NO: 250754 - DNA, 800 bp, Homo sapiens
aggaaatcagatatttactgtttatgccttttgtatatgggcaggttaacgttggatgaatttaattacctatctatgctatggttagcatggataggagtttaagcatatcaggtgtttcagtttttcttcagtagtacagcaggcctcccagtgctgatgtaaatatttgagcagtgtttagtaccattcttagtgcatattaatttttttatatatccttataattttagttttttaagatctttgctttttcaaagtgttcagatataaaatggtgctaactgtaggatttataacaaggctataactgatgtccttttggatgttcagtatgagatatgcatgacatgttttgatagtcttttgcatttttaatggcttgattcatttgtgcttattaaaaatgttagtgattacgccaatgttaacatccaaaaatcatcagaatggcctgtgttatgcttttcatggttcctgaatagtgatttaaagaaagttacacttttgatcttctttcttcttgtgctagatattacatgtctttcttaaaaacagaaatatatgcattaaatataaagcactaggcagttatgcattactttgtacatttcttaggtaactgaatattttaaggttattgaggaaaactggaactcgatgtttacttgagtaatagttctaagttgagttctactttgattaaagaaatgatcttttaaagcaaaattgtttgctgtagccagtgacagcttatttaaagaaagtgtttaacttatttgattttagcatgttttagt

SEQ ID NO: 250755 - DNA, 204 bp, Homo sapiens
tggggaaaaggaaataaacatatattttggggatcaccatataacccattccaattgtatccagttccttctggaggctctagaggaggatccttcctgcctctcccagctcctgggggctccaggcatccctgggcttgtggccacatcactgcagtctctgcctctgtctacacgtggccttctcctctgtgtctgcgtctc

SEQ ID NO: 250756 - DNA, 616 bp, Homo sapiens
ctttgccagagaattcttagcaattcaactgtagtctaagcaataactcagggctaaattcagggaactgttagcccaatcagatatcactaaaaatgtacttcaccatctattttggagtttataattttggcatttgctaaaagtaggaaaaacagtaacatattactgtgcccagattctaataaatatagctcaattgaaaccaaaactgttacattaaacaaattacactctggcactatgctaaatcaccacagatgttttaggtgtttgatttccaagcaggatggtatatcatttgtttggttcaatatatgaggcaccatttgtagtcttttaggaaataaattagcttttatcacagatttaggaaacttgtctaaaaaaactgtgatcatcagttacagagggaaggaaacatattgaacacaaggcatcatagtagctggaggccttaaaaattatgcacgaccaaaaagaatgatttggtgagagatgtgtagctgattgacaattttagtgtgaattcatattcatttaacccagcagcaatctacataagctatgctttttcccgcctgtagaattctatttctaagcaaataagagaatc

SEQ ID NO: 250757 - DNA, 648 bp, Homo sapiens
  misc_feature (634)..(634): n is a, c, g, or t
  misc_feature (648)..(648): n is a, c, g, or t
ctttgccagagaattcttagcaattcaactgtagtctaagcaataactcagggctaaattcagggaactgttagcccaatcagatatcactaaaaatgtacttcaccatctattttggagtttataattttggcatttgctaaaagtaggaaaaacagtaacatattactgtgcccagattctaataaatatagctcaattgaaaccaaaactgttacattaaacaaattacactctggcactatgctaaatcaccacagatgttttaggtgtttgatttccaagcaggatggtatatcatttgtttggttcaatatatgaggcaccatttgtagtcttttaggaaataaattagcttttatcacagatttaggaaacttgtctaaaaaaactgtgatcatcagttacagagggaaggaaacatattgaacacaaggcatcatagtagctggaggccttaaaaattatgcacgaccacatattcatttaacccagcagcaatctacataagctatgctttttcccgcctgtatttatgtttcttagcttataaagtcccaatatattatatcttttgttgctttggcagttttaatttagagctctgcgttcacagagatgccacctatagcanaaactatctttaan

SEQ ID NO: 250758 - DNA, 2333 bp, Homo sapiens
ttttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaagggccactagatttgtgtttacaggggtatctctgtgatgcttgtcacatcactcttgaccacctctgttaataaattccgacagtgcagtggcgatcggagtgtgaacttatgttcccagcatatggaaagctatcttaggtttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggagcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtgg

SEQ ID NO: 250759 - DNA, 101 bp, Homo sapiens
ttttgttcagcgctttgccaacaggtgttgacaacttcagaaagtcatggtattggcagcaaggccaggttcagattgagccctgccaccctgcctgttcc

SEQ ID NO: 250760 - DNA, 597 bp, Homo sapiens
ctacaggcgcccaccaccatacccagctaatttttgtacttttagtaagagacaagagtttcaccatgttggccaggctggtctcgaactcctgacctcaagtgatccactcacctcagcctcccaaagtgctgggattacaggcgtgagccaccgtgcctgccctgagacttactgttctaatgttcattgtgaacgttagaaattggtgtgctttttatttattttgttagtttgcccattctagttaaattctgaagtgtttttataccaggttaaaaaaaagaaccttctagtagtttagtaaggttgtttgtatgaaggaagaaaaactttatagagttggttggggaagtatttgaaaatatgcatgttgactttagaagaaaattgggccagatcagttttgatttggacctcaaaatcatctgttcaattgtatactaaaaaagaattaataatgtgttgggcatttagggctgtggttgcctattgtggatgtgtattaggacctagaaatgcattgtaagaagacagagcacagttgtggagacaaatctcagcaatatatgttggctgcttgttttataagcttgg

SEQ ID NO: 250761 - DNA, 516 bp, Homo sapiens
tagaagagcaaagttgacctctccaggtcaaatgtttattttactcatttaaaataaaaaattcatttagaaatatatttcatattttccatgttccttaagtagactctatggaatataattagatcctagcttaatgatttaccacccacaatagtactgtctggccagtatttatgcttgggtacaacaatcctcttccgtctaatgagcagtctctaactatacggcacatttgctgtcatctaagaaatcagataaccctgattactagaactgtatttaaagtaagagtcaacatgacatgagtacgtgtcttcgaaaataatgtaattgagttttaatgaatgagtttcacaactgttctttcagctactgaatggctctgggtcaaagttctcaaagaccctggtgaggctgagaagtctaaccttgaactgtgtgaagtatttctgtacctaaaaatacctattcaaatatatttgaaacaagttattaaagatattaaacataaaa

SEQ ID NO: 250762 - DNA, 431 bp, Homo sapiens
acttttgtccagcattatgaatgtgatgactgtggcatggcttttgggcatgtgtcacaacttactggacatcagaaaatccataaggtaggggaaacccacgaatatggtgaaaatacaaggggctttaggcatcgctcatcatttacaatgctccagagaatatgtacactatataaacactttgaatgtaaccaatgtggtgaaacttttaacagaccttcaaaggttattcaacatcagagcatgcacagtggactgaagccatacaaatgtgatgtatgtcaaaaggcctttaggtttctctcatccctctctatacatcagagatttcatgttggcaacagagtaaacctgactcggcatcaaaaaactcatactcaaaggaagcccttttcctgtaacttttgtggaaaaacctttcaccgttt

SEQ ID NO: 250763 - DNA, 585 bp, Homo sapiens
tctgactctacccccagcagcaagggagcttccccaccaaagcaggagatctggctctcagcattcactttactttcctgtgtgaccttgagcaagtggcccaccctctctgggcttccagagtctgtggcaacacagaggaaagtgaggtgcttgctcagagactcgccagctgtgactggccaggggtttgatcccagtcatttctgctctgtggtgggggacttgtcgggaggggcaggtagaggtgagctcagtagaaccaagagcccccaggacacagggcatccaggaggcctgtgcttccacagcctgttcactccttcatgcacccgcctccccctccccactgcactcctgcccacactgcccactccccaaccccctcctctctctagggctgaaagcaagaggctcccatgggggctggcccgatgattggcagagtcgataaaggccacttggaaaccctcctgctccaggtggttccccgctggcatttgtagctgggattccgaggccagagctgaacccagagatcatttatcacacagcctcaaatggaggcttttctggaaaaaaaaa

SEQ ID NO: 250764 - DNA, 774 bp, Homo sapiens
agactttcttagagccgtgtagagctacttagtagtgatttaaaagaaccaatgctttttttcataccacacaaaccttaaaaattctagttcagtggttttcataatttgttttagaagtggaaccctttcccagtcccccttccccaaagaaaatcttgtacacacacaatcccagaatatagaatagaagaacggagctatacttgtgtttaagggcagatctccactcaacatagcgttttcccttccatagctagaaatctacctatgtagtgtaggtttagattatattatgtaggtagtctttggacgtagtttgaaaactggaaatacagtgaattttttttctttttaagagatatgccccatgtagtatataattgcagtggggaagttagtgaagaaaaggaaggtcataaatcttggtagagacttttgggacttgttctagcagttctctaacaccaacccatgtggtccaaacatggatggctcctagttctttaggactcatttctgtttttgctaagtttgctgtgttcaggtagggaacaccaggtctaatatctttgtgtttagacgtgtgacaaggccacaatatcagatttcttcctagttttctggttttaatataggaaagtcttgcatcagattgatgagatcatgccaaaattatttgcgacatgattcccagtgtcttggtttgaggagagtccatcacagacataccgtgctgtgaggaggccactctcactagttctgcctgagccc

SEQ ID NO: 250765 - DNA, 354 bp, Homo sapiens
ggctgctgttattatccaggatacaaagcacctggcgcagtgcctgcacgtggaatcagggttgtatttatgccccgacgctcgggctgctttgagtcaatgcggaagctctccctgcactccttggggccctccaaccccacagcagtcagagctagttgtgggccagcgcagcggggaggaagtgtggccgtgtggcatggcagcagagcctctttcggttcctgggcctattttaagggttgtgggttccggcctctacccgttcctgggactggagcagcccaggaggccctctcctgaggctgagactctgtgtccttccggacggaacctgaggacgctggaccctac

SEQ ID NO: 250766 - DNA, 809 bp, Homo sapiens
aaagatttggatagccagatgaaaagaaaaaagaggggaaatgcaaaaattaaaggcactttctctttcatggaaaccttctcctcctttctctgctgttcctgctccctctgcttcccctgcatgtccttatgcttctttgcttctaactgactgtagtggctcccaggcaagggggaggtgatgatcttttagagaggtggctcccttcatgaatagatttccctgtaaagggagatgaaggtacaactttctaccgctacctgctgtatttgaggatacaagtttgtgtgcctggtggcctagctctaagtctactttatgttttagaccagattccacctccaggaggtcttatcatctacacaccacacaacacacaactagaaaggcagaaataataaagagacaggatcatgggatgattgagaacttggataaaagactgtgctttggtttgaatgtgtcctccaaatttcatgtgttggaaacttaatccccaaattcatatttgatagtatttggaggtggggcctttgggaggtagttaggattagataatttcgttagggtggggcccccatgatgggacgggtggctttataagaagaggaagagagacctgaactgacatgctcttactctcttgccatgtgataccttctagcacgttatgtcacagcaagaaggccctcaccagatgctggcaccttgatattgtacttcccagcctccagaaataaacctctgttctttatagattactcagtctgtggtattcaattatagcaacaaaaaattggctaaga

SEQ ID NO: 250767 - DNA, 1047 bp, Homo sapiens
tataaaagtttttaattttgattgttagtttattcttttttcccttacacttttggtgtgatgtctaacccagggtcacaaagatttactactatgttttgtaagtgttttgtagttttagctcttagatttaggtataattcgatctgagttcattttttgtatggtgtgaggtaggggtctaaaatcatccctttagagaaaaacaaagtcatccttttacgtgttgatagtccattgttccagcaccacttattgaaaacacctctttcccatcaaattgcattctaataactcttatcaaaaatctatgaccagctgtttttgtgccatcaaaatggtgcacattgaatgtcctgaccattgctcttaagagcatcaacaatgtcaaaacaagaggcaaacatcaggttcttagaaggctgtgcccagtgttattgtccagtttctgactgatgatgaagcatggttacaatggcgaatttgaagtcatttgagatcacagagctggggaaattgttgtgaacctcacaggcaagttaaacaagtgtgatcatcctcagatttcatgtgcaactcaaagatctagaaaagtggcagaattatctgcttccacgtcatcagtttggtttcattatactgacaacttcggctggcatcacagaccatgaagaagcaagatgaaaacacacatgagggaaaaccctgggattcatgttcttggggatataatacatgcaaataaaatgcctcaacagacaaaaacaaaaccaattgataataagtgtaaaggtttatttctgttctctcagttacattccgtgagccactgcgcacgccttggggtaaatttaagtttagttaccaaacttttttgacagcacataaatttgccaggtatttgggtgagatagattgttgggagatttatttatttgtgccaaagtgttttcctatttatttgtttggttccttagactttctctgagtggtagaagtgcaggcctggagaagcctgtatggacttttaggagcactaacagaaat

SEQ ID NO: 250768 - DNA, 399 bp, Homo sapiens
gcgagcactcaccccacgcgcacactcatgaaaccatcccgaacgtcacggcggcgagcactcaccccacgcgcacactcatgaaaccaccccgaacgtcacggcggcgagcactcaccccacgcgcacactcatgaaaccaccccgaacgtcacggcggcgagcactcaccccacgcgcacactcatgaaaccaccccgaacgtcacggcggcgagcactcaccccacgcgcacactcatgaaaccaccccgaacgtcacggcggcgagcactcaccccacgcgcacactcatgaaaccatcccgaccgtcacggcggcgagcactcaccctcaaaggtttatagtcttttattcaaagcagttggaacaacttaaaatgtgatagccttggataggg

SEQ ID NO: 250769 - DNA, 199 bp, Homo sapiens
cccattcctcaaaatggaactgaggaaatcagccttccttattagattcctggcttcagtttttatccacggctgggaaacgagcaacctgcaagactgctttaaacacccttcggcgtggcctgaagacaaaggcacgcccacactggagtgcagttgtctcaaatgtgaactcacttcctgagggcaggcacatcga

SEQ ID NO: 250770 - DNA, 264 bp, Homo sapiens
cagagcggaatgcatacttatgtgttgtctttcaaatgatgatcactctctttgtagaaacccctcagcaattcttttttttggggatggagtctcattctgttgtccaggctagagggctggagtgcagtggtgcagtcttggctctctgcagcctccgcatcccaggagaatcgcttgacctgggaggcggaggttgcaatgagccgagatcgccccattgcactccagcctgggcaacaagagtgaaactccatcttaaaa

SEQ ID NO: 250771 - DNA, 486 bp, Homo sapiens
gatgaaatctttcaagtgtggcgaataacacattgtaagctcctgaaccatgcatgaagtgaaaaataacatttttgctttttgaataagcaatatagttttattgtcaaaccagatatgaaatgctgcaccttaaaatccttgctattaagtaatcctccttactcaagtaatagtgacattgttttcaatagttggtaattgaaatcaacaaagcctgctagaatagactccactaacagctctgttgacatttttatgatatataatcatattttaccatcttaaaaccaagccatagtaaacattaattaggtaccttaattgaatatgccttatgttcatttatggctctgctgctcaaacttttccacaaagtatatagaggaacaaatcccacggggcctggcaccatagtccaaaacattcttcttcaagtgtgtagtgttcctattcgtatcttgaataaagtttgtgcttatgaaa

SEQ ID NO: 250772 - DNA, 671 bp, Homo sapiens
ccctccagcagctgtgtcaagcaggtattattaccctcattttgcagatgagaaaacaatgtcagagaggtcaggagactctcgcacaaacccaggtctctgtggctccaaagcccaggccttatcctgggctgagaaaacagctctgagtcaaggcaaagcagcgcctcctaatatggagacagctggcatgttgctgaggctgagcagtggggaacttcagggatcatgcaatcccgttctttgagaccgaaaaactgaggcccggggtcacgtggccggcttctgattcccagtctagtgctcttccaccacaacagtggtagtgacgctgttctgtaaaactccctcaaagaccactgcagacaggagaaggctgagagggtggaagtcactggggagggcagggcaagagagcaagcaggtgtgcctctgtgctctcatcctatttcaaaaatgcaagtctaatttggtttatttgatgcttctaaataggaattagattgcgtaaaagattctactacttgagagacagagagagaaagagagagagcacatgggcgaacacacccggggctcttcctagccctattgaatgggctgccccagtgggcatatttgtgtcatacaacttagcccttcccatcaaaactggccagccaatgaccaat

SEQ ID NO: 250773 - DNA, 664 bp, Homo sapiens
tattgccagggcatggcatattatgaatattggacgtatctctgggactgacacctaggggatgagaggttcctgccttggccctgcccacaggaggctttgtggcatgtctctggcctcattacctagaaagatgtgactcttctcttctacctgcattcttcccacagagaagattgtgacatcactggatccagcaattagaaaatgtttctctcctgcctgagccttgcccacaggaatattgtgacatatccttgggctcagcacccaggtgatggaactctgccacctgtgccctgtctacttaggctattgtgaagctggtttcaatacccaggtgatgtaacattcctgccaggccactgccttccagggatattgttacgtacctttgtgccaatcaccaaggtgatgtgaatcttttcacctgcctagtccttgttcactaggggataatgatatctattgctggtttcagcaccaagctgatgttacttgcctcttcttcacagattctgctcacagaaaaactaacacatcactaggcccatcagcgaaattattttgcctggccctgcccttaaaagacattgtgacatactacagtgcccagcatcaatgtaatttgtctcctgcctaaaccctgcctactgggggcatt

SEQ ID NO: 250774 - DNA, 421 bp, Homo sapiens
tctaccgttcagaaaagctggtgtgtccaaggaagaaaaaacaggctgtgactacaaacctaaaagtaaaggcaaacaactgccagacagaggcaggaaaacggggaagagcccttggtaaatattgcatgcctcctggggaccccatgggctttgactcaagggggagatgaagggaatttgttaaagaaagaagtcactgagacagacaaaagcttccggcacaggaagttagttcgactaaggataccgaaatgtaggaatttgaatgggttcctgggtgtgaggttgaagtgaaacttgattgaaaagaagctgctggtggtgagtctctccttaagctattcctggcttctgggtagttggtgtaaactctgtggtccttgaataaagtgtccttgagaaatttagaaggttaaat

SEQ ID NO: 250775 - DNA, 894 bp, Homo sapiens
atttttatgattcatgttcatcctgttttattccaaagcaccaaagcactttaccgaaaagccccttggcccagccaaaaagttcagggccaggagccaggacacctggactccagatctgcatgtggaagatttggaacgttattggtggggggggggtctcaagttctctgtaatgtggcaagtgccatctgtggaggactttacaattttacatacatcatctcatttggccttctgatccctggtgagagaagcaaattaaacaggattgctattctaactttacagatacgaaactgggaccagggaaggttaataaggcactcagattcacacactattaagaaggtggggaagttgggacttttgattccaaaccctttgctctttcctagtcaaaacaataaagtcagttctatgcctcacttttcctttttttttttttttttttgacatattataatagggggtgtgtgtgtttgtagaggcagcatcttgctatgttgtctaagctgatctcgaactcctgggcttaatcacttaagacctcctgtcttggtctcccaaagtgctgggattacaggtgtgagccagtgcgcctagcccaccatgcctcacttttagcgcagtgtgatcctacacaaattgccctgtgtatattccaagggacgatctgggtttgtagggccagaaacacgtgcagttctggggtagcggggaggtggtcggtggctcttttaacaaaaaaataccaaatgatgaaaacaaaattaagttcagggccttgggcaggtcctgcaagttaggggcctagaagctgaaatttcattaacatctactagtggtaaatccgcttctcctacatgccagtgccctctgggaaaaaaaaaa

SEQ ID NO: 250776 - DNA, 1012 bp, Homo sapiens
accatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttacaaaacaggatgggccaccagccacctcctccaactcaacaacattctataactgataactccctgagcctcaagacacctcccgagtgtctggtcactccccttccaccctcagcggatgataatctcaagacacctcccgagtgtctggtcactccccttccaccctcagcggatgataatctcaagacacctcccgagtgtctggtcactccccttccaccctcagcggatgataatctcaagacacctcccgagtgtctgttcactccccttccaccctcagcggatgataatctcaagacacctcccgagtgtctggtcactccccttccaccctcagcggatgataatttccaccctcagcggatgataatctcaagacacgtgccgagtgtctgctccatccccttccaccctcagcggatgataat

SEQ ID NO: 250777 - DNA, 384 bp, Homo sapiens
ctttattctgccttagtgtttctgaaatctggagtctcctttgcgctcctgctgaacagttgtaaaaactttttaatggtttttcagtctttgcttccagtggagttcagcttaagcccattctccatgatgaatgcaaaatcatccatctgaacgcaaatctgacctgtttaaaaccttcggtggctttacatttgcctcctacattgtaggaatactccaaggctggcaggggccccacaggtatatgaatgcttaacaaaagaataagacaattagtgcttgtattgcaaggaaacgtaactcccatctagttgtattcattgccttttccctattacatagaaaaagacaaaaataaaccactatcttggccagacaaaa

SEQ ID NO: 250778 - DNA, 256 bp, Homo sapiens
gaaaggtgaaccttagcagcagcaaggcagccatcacctttgctctctgaagcctgcggtagggatggatatgaattagctgtggcgggaggggctgagtaagctctgggaccacgtgactctgctggacacagcaggggaaggcagtggtccaggcttcccaaaaaccagccttgaggaataaagataacgctcccaattttcagaactgctctgctcactctgagtcagagtggaaaatactgactgctgcatc

SEQ ID NO: 250779 - DNA, 285 bp, Homo sapiens
cacccctccaccctaacctgtgccatggttttttccccttattgtttaagggaagaacagatttgtaagtatcccaaaaaggcttatttcctaaaggacaaaggtttatttttttgtttcacagaggtggaattttcaaaagataacgtttacaatagtttacaaaatatcaaatagtcaattctcagtagttgtaatagttatttctataaaattgccacacactctgaaagagctaatactgaaccactgcttctaggagaaatacaagtttagattgctgca

SEQ ID NO: 250780 - DNA, 427 bp, Homo sapiens
catcattataagtcttctccagatggttatttctcatgtaaaactaatggtagatattcatagaatttgagattctttcatatgtagtaaagtctggtcttttacaaaattattgtgtatattatattgcttagaattttccaacatgaattattatccagttatttaatatgtttaaaatcctaatgatttctttttccttctttttaatttagccttttatatttacataactaccataagatgttaacagatggattctttttcctgtgaaatgtctatcctcccaattatgttatttagagaatcatgagccagtgtttaaactagaatgttatccaaggtactgtctcactcgtactgtattttaaaagtagtttgaaaagtgtggaatatggatttgccaatagacttgggtctactaaga

SEQ ID NO: 250781 - DNA, 219 bp, Homo sapiens
tctctgtcatttaagttttcattctagaatgaagttctgatgtggattcccctctcaaactctatatctaaacctgtagtcccactactgtagtctcagctactcgggaggctgaagcaggaggatggcttgagcccaggaggttgaggctgcagtgagcccaaaaatcaggccactgcactccagcctgggcaacagagaccctgtttgaagaaaaaa

SEQ ID NO: 250782 - DNA, 340 bp, Homo sapiens
ggtaaaagtgccagcacgacgcagggcgcgaggattctggaagatgtagttcctctatgaggcgatgcctaagatggctgctccgggtcacagggtcacgtgacgggggaggcgctgggtcggggagtcccttcccttcagaggaatgcctcgaagccggctttcataacgttttgtttttgtttttaaatcaaatgaggtaataagcgggagggccgcaggaactgagactgccattcagtaagcgctcaatttattcttaccaaagtgtttgcttaatgagtaaatctcccaaaccatgtatacatttaatttagaaataaactgtacttttcctaag

SEQ ID NO: 250783 - DNA, 249 bp, Homo sapiens
tggatgtgtaaaagcatgtgacttttcatgcctcttctagatctaaacgctataatttgaatccaaatttattatctgtttaacgtataatcttctcagtgaagaagcatactcctaaggttaatttgttcagtaagaaaatgttaactctgcatttagcccagtaggtggcaccaaccacatccaggcttcaagtccacagagtggtaattcaggaaccatgaaatgctgtgggagagatcggtcttc

SEQ ID NO: 250784 - DNA, 444 bp, Homo sapiens
ttaaagtgagacaaaagacaatgggaaatgttatggacaaaaaaaaaaaaaaaaatgcttattggacaggggaaccagagagcagataatcgtactatcctcaactctgatgctgccaagtgatcctgtaagggaatcacaatttctcttcagtttctctactgacattatttgacaattagttgacagaatactttttaatctagggatataatcaactgttctgtacaataggggcggtcacagagaactcttattgcttgaccaacagtaggtttaacatttgaatgaacagtaagcattgaatcttgatagcatcaactatttcataatacttcaataaataaggacagtgacagtgattttatgtttgcataaaacagggaaaggctaggggttatctctcaatactttctcccaaaacatttaaaccacttctgtttg

SEQ ID NO: 250785 - DNA, 234 bp, Homo sapiens
acccagcctgtttctgattttagtgtcctatctaagaaactgtggcataatctaaagtcactaagatttatacttatgttttattctaagagttttatagttttcagtcttacatttaggtcttttaaccattttgagttacattcatttttttttacatgtggatatctagttgtcccagtgccatttatttaaaatactattttctaattgaagggtcttagtacctttgta

SEQ ID NO: 250786 - DNA, 407 bp, Homo sapiens
cttgtttatagagtggaaaaaggaggtcctgagtctgttgactacagtttcaattacgttagcgcaaagcccaagttagcatagggaaaatgatggctgtccactggaattaggaaacagccccccatagaggcaatttccagtctcaatgcactctgtttttttgttgtttcagtaaataaatcaattagtcgattaggtatcagatgctctgaattttttaagttggttttctgcatttgagtggagtttttatttttttgcattaacatttgtaagaccctatgagacactatgaaaagctaaatattcgtatccagtctttgtgattcttaccatcattttcccttggtaacttgaaattgggaacaaaatgtttcaattggaagaagtaaaggaattttggg

SEQ ID NO: 250787 - DNA, 478 bp, Homo sapiens
atggacaaggagttagagttctgggggttggccctggattccagtcctggcatagccaccacttagctgtgtgaccgttggcaaatcatatatcaacttggatcttaattgcctcatttggaaaatgagaggtctaaactagcttttcctcttctgacttcacaattcggtaatttgtgactattgtgatttcttaagacatatgcctccacatttcaaagcaattaaatacacttaaacacaaaactctgtgaaaccaaaactgagtcatacccttaagaaggtacctctttggctaagtgttaaaagatacattaggatcttgcaggaccctcaaggatatcattatgaataagttattttaacataggaccaagaaaatgttctacctggttttttgtttgtttgtttgtttgttttttgagatggagtttcgctctgcactccagtctgggtgacagagagagacttaatctcc

SEQ ID NO: 250788 - DNA, 525 bp, Homo sapiens
attgtgtgcttgtaggatgaaattgataaacaattattttaccaactttcaaaattacatcatagagataatgtcctttgactattgggtgttcacatatttggcatgttatgaacaactttctggaagataaaggccttttatctcatacttaatattaagacaggaaccagtgtgctagcaatggcttttgggtttgatgtgatatatttgtatgtaatgattttttaaaagttagggtgaaaaatcctctcatacaaaacaaaatagtttttactgttatgagaaagtagttattaattacttataaaacatgcaagtatctttatgatatttggtgatttatttttctccagccatcttgtcttgttgttagtggggaaaaaaatagggatgctctttatctatgaaaatgtgaaaagtatatacacattttaactatacatggtttccctaaaaattcttcttctgtttttaatcctctaaaatgatcattgatatgtacaaataaatattgatgatagc

SEQ ID NO: 250789 - DNA, 380 bp, Homo sapiens
tgggtaacagagtgagactccgcttcaaaaaaacaaaaaacaaagaataataataataacgataaatcctatatgttacggtaaaaatcttcatgagaacaaatttactatcattttttctactgaatggatgatcatgaaaaggaatttatttttatttcgtatgatggactgagcatcatgaaaaaaaatactaccttttggattgttgaacttccatcctgagaaatttactattgtgctgcatgctgcagtgatgatcttgtgatctcagcaatgcccatggggcaatttacatcgggactcgtttcatctctagaccttcacttacctgagaaagacaagtgtcttttgataaataaaatattgttaaatgcaat

SEQ ID NO: 250790 - DNA, 867 bp, Homo sapiens
ggaagggagagaaatcacacactttgatcttcgcaaaaagcaagccatggaagacagctctgttcctcactgcccctgagctccctgccggccacctactgcagcttccggcagatctcaaccagcagcctccacgtcctcacttgaagtcatcctcacccaggttcactctggggaggccgcccttgggcctttctctacggctgcagctgacacttgtccagctggtttctcttcctcactctaccaggaaatgctttccttaaacgctttctgcagggcagggtctcatttcctcggcttggagagtagctggtgggtgggacccaagctctcactttcatcccctttctgggacagcgccccgaaggagtgtgactcacacagcagtggatgtgcttggtcttgcaaagtgtgaagtgcgtcctggctcttcctgcccaaagacgggccacagagtctccccgtgctcccttccaacctgttcccattgacgccaactttcaccatgctggacctgaaccagcccgaaacagtctccagggaagctatgcaccagggagaggaggcaagtccaaggcctaccagatggggaaagcagcagcagcggcagttgagtgatcagacacttgagtctcccgggaccctgacaccgtcctgggaatcaccttcttatgtggccacactgtggactgtcaactatacctgcctggattaaacaagcatcttttgaggacttgcaacctgggaggcagggattatcacgtccccattttacagacgaggagcactgagccccagagaagtgcagtggcttgcccaagtccatgtaattgaggtaggatacaaatcctggtagaatcctga

SEQ ID NO: 250791 - DNA, 481 bp, Homo sapiens
cactgttttgggaagaagggcctgtagggcctatctgatgagggccttactgtcatctccccatcatgccaagcagcctttcctttgacccagggctcccacccccactttcagattagctgccagcctctaacactctgctgttttcccttcctgagaagcagccgctgtgaaagctgtttttctgagcatcaggcctgagcataatctgctttagcagctgaagtggtctgctcttcttttactgacaacactttaatacagaaattctgatggccttttagatttatatatgcttctccctcccctctgggcttttcctggaagtaggttggcaaggaacagtatggctcctacctccacaccagccaggaccttgagaagggagaaggtgctgagccactcaagcacatggccaggggagcttagaaaaacagggacttccaacctgcctgggcaatatagcgagaccccgttctcc

SEQ ID NO: 250792 - DNA, 625 bp, Homo sapiens
ggtcaaagggccgcatctggtgcgggccttctagctgcagcatttcagggtgtagggcatcctaggcccagagggcaaaagcatggcctaaaagagttgtttttttcccagatgagaataaattgttaattctttcccaaatcagtaattttggtaggttgactaaaatgttttctgattgcatcagagaaaagatataaatattgatatttagagtgccttttgaccttgagccagtatcatctttaaggtccagttatgtgaaattcaaagtgtcagtgataatggccttcctaatgtacattctttactgtcacttaaactttctgcactcaaaaccatgtggcacatcgctgtttaatatgacagtccagcacgaggccttacattcacaaccttcagtagcaacagcgtcaaatttctatcatcaaaattgtagcatgtaaatatgtcacatgaagataggtttcaatacagaatgtacgtgagagataagtaatgtctacaaacattaaaaattcctcttgactatgtttcaagtttctagaaaatgaagtatgatatttgcaaaaatatagcttcaatgtgttatgcatagaacttaatgtgtgtgaggctatgaaca

SEQ ID NO: 250793 - DNA, 215 bp, Homo sapiens
cccgggaaacagccaaggttccgccgccctccttggcgctctgccccggccggcctgccgggatctcctccccggcgcggtctgcggctcccggggcctcgcaaaccttccaggcccgaggccatccagacgtgcacaccaggcccggcccgcgaggggagacacaggggccggggctgcggcggctgagctccctgggcggctcggaacgcaag

SEQ ID NO: 250794 - DNA, 184 bp, Homo sapiens
cttttcctaaaatggaataagtacagaattagaccccaataaaaatggacatatgatagagatggcaggattaatttaagaagaggtattggaacaaccaactaaccatttataattttaaaattggattcctacttccctcctcactccaaaataaactccagatagagcaaagattttaata

SEQ ID NO: 250795 - DNA, 457 bp, Homo sapiens
aagatggagactaaaatttgtctggaggatgttttgcatgtcatcccaatctttgctattgccccctttaaaacacccgaaaaataattctgcagaattaaagagtgaggggaaggatttgaaattgttcacagaacaataatggggttggggacgccaattttccacacagtcgaaaatctgggtgtaacttatgattccccaaaacataactaccagagcttactgtagaacagaagctttcctggtaacataaacagtcaattaacacatattttgtatgttccatatataatatattgctgtattctgacaataaagtaagctagaggaaatgaaatgttattaagaatatcataaggaagacaaaatatatttactcttcattaagtggaaatgactcatcatcgttctttacattgagtaggctgagaaggtggaggaaagggaggggttg

SEQ ID NO: 250796 - DNA, 616 bp, Homo sapiens
atgaccaggaagatcttcacaaataccagggagcggtggaggcagcagaatgtcaacagcgcctttgccaagctgaggaagctcatccccactcaccctccagacaaaaagctgagcaaaaatgaaacgcttcgcctggcaatgaggtatatcaacttcttggtcaaggtcttgggggagcaaagcctgcaacaaacgggagtggctgctcaggggaacattctggggctcttccctcaaggaccccacctgccaggcctggaggacagaactctgcttgagaactaccaggttccttcacctggtccaagccaccacattccttagtgtggctctggctgtcatctcccagggcagcacttgcccagaaatcactgcctgtggacagacttttgcatgttccagagttgacctgatgataactcgtgaagcatgaattctagcttcctgggaggtggctcagagacagctgcagggagctgaaagaagccatgaggaatgtcacttgtgggccgccaccccccagggatgtcaggtagagcggcctacctctgcctattttaaatccaggttctgcataagacttttggagaaaaaattctaaataaaaaaaaaa

SEQ ID NO: 250797 - DNA, 702 bp, Homo sapiens
tgtgctccagcctgggtgacagagtgagactccgtctcaaaaaaaaaaagttattaacaaaggagactggagtgagacctgcttatgtttgtttccttggtgagctgccacttctttctgacagtccctgaaatctgtgagtcccttgaagccagtgtggttcaagacaggatgcagttataggtgtggttctagagcccaccttctcagcttccagtcccaaccctgcactttctacctgggtgatcttaggcaaatgaatccacctctctgtagaagtggaatggcctagtgccagcccaaagagtttttgagaggatttagtgtgtgccattgttgtaacatgggatgggggaagagggggcctcgaacaagagcccagcaacttctacgtggggaaatacgggatgatgcagatgcttcccagagcagccagtcagctgcatcgtcgcagaattcgagcccattcaagaccttctagtcctagagaaagtagagttacatttctgcttcagatacacagagggttgggagcaggttttaaatatccttgtccatctacagagttcacttgaattctgtttgaaggtctgctatccaaatgtgtctgaccttcaaatgtgggttcagggagtgtatatttggggcaacttaaatctatgctcccaggttgaaaaaaaaaaaaaaagaaagaaaagaaaa

SEQ ID NO: 250798 - DNA, 298 bp, Homo sapiens
gtatcctaagtacctttaggactctgggctctggatgctatgtggcaacagaaaattgaaaagtgaagtgaaaggatgccaaagaaaactttgaaacactttaccctttggcttggagataccctagattacgcctgacattcatactgagtgtattcttccttatactttctgctgatttgctgtatttgattatacaggttgagtatcctttatcctaaatgcttgagatcagaagtagttcagattttagacttttggattagggatattcaacttgtatgaactaacatcagta

SEQ ID NO: 250799 - DNA, 768 bp, Homo sapiens
gaggaaaggataaataggtagaacacaaaattttgggggcaataaatttcctccggatgataataaatggtggatacgtgtcatcatacatttttcatattttttattccttcttatactacaaagtattttggcttctctttttgaatacctttcaacatttttaaatacaaaaaacagataatacatactaatgagttgtttaataacatggtacaaaaatatgatcaatggatcctcaatatgttttaaaattaaaaatgtgagttaagtgttatgattctaaagtccttatgaatagagtgatagagggactgataatgtgtagacataagaacaaaacatcccatcagtttctataactgcatataacaacacaaagtgttagttgttcaataagacacacatgaatctgagatcttattaaatataaaaatttactaataattttaggaccgtggtgtagggacaagagtgactttattaaatgctaatctgccatttaacatctgactaactccagtccaggaatgccgccaaaatgtctagttgatgtattattgctccttatgtaagaacacctattcacagaaagtttcctccaaaacaacccttatagtcacagaaattataggctgaaatgtctgcaaccacttacacgttccttctagcatacataggcttttcccccaagatgtaacccgtgggtctgagagttcacggtgtaaaaatctacctgtgttgtggttgcccaaggccactattctt

SEQ ID NO: 250800 - DNA, 595 bp, Homo sapiens
gacagggtctcactcttgcccaggctagagtgcagtggtgtgatcatggctcatggcagcctcaacctccctggacttaaacgatcctcccacctcagcctcctgagtagctgggaccacaggagcgtgccactatgcccagctaactttttcttattttgggggtctcctatgttgcccaggctgatctggaactcctgggctcaatgatcctcctgcctcagcctcctgagtagctgggactacaggtacaccaccatgcccagctaatttgtttgttcttgtagacatgggatcttgctatgttgcccaggctgaccttgaattccaagtgatcctcccacctccgcctcccaaagcactgggatgacagttgcagtccaccacactcagtcaattctcaatcttgacatcatctaaccccaaaacctgggcttatcaccactctgctctactatctcccctaactttgggacttgggaatgtaaaagacacagctcctagttcgattttgttgttttgggaaaggagagtactgagttgaggccacttttgtgtgagtccagggtcctgaacatccaccctctgccagcct

SEQ ID NO: 250801 - DNA, 395 bp, Homo sapiens
ctcagagagcctgcccaaggctacacagaagttcagcctggattaaaacccagacctgacttcagagcctgtgctcttaaccacaccactgattttccttagaaagtcccagtggagtgcagttgtgctcagttaaaccatgtgagtatttgacagaggtgagctgcaggagccacagggcccagggagtctgaggatattttgcaatcccttttcaacctatgtctgctttgtttttatttttatttatttatttatgggtttttttttttttttttttttgagacaagagttttgctgttgttgcccaggctagagtgcagtgagctgagatcacgccactgcactccagcccgggcggcagagggagactccgtttcaaaaaaaaggaagag

SEQ ID NO: 250802 - DNA, 488 bp, Homo sapiens
ctttctacctaattggttagacatactggcagcacagtgtaatgaactggcctggagttgggaaatgggaatttgaccttcattcctgacaggaagtagaggaaccccagcaaagtcgtatctcagagcttcattttcctcatctgtaaagttttaaaggttgattaaattatctgtgaggtctaattctgttcaaatagccagtggtgataatctcatttgtatactgtcctctgtattcatggctcaactttggcttttatatttagtccctaaatagaatacatcatttaatgtgtagcttccagacaagctgtgtcttgcggccatgacctgattgttgttaagtgtgaggttttctgaacccttagcagaaggacttttaatgtttttacaacacactattgtattgctataaattgtgaattgctttaaaagtacatgtttactaataaaaagaagtacaggccccctttattttattgtgc

SEQ ID NO: 250803 - DNA, 338 bp, Homo sapiens
ccacagtgattagatgaaaaaattatttgtagataggataatctattgactgaattatcttttgcagatatcagctggttggatttctcaccaggattgtctatagaagttaactgatttatgattgttaacacataaatatggccacttatccatttgcctcaacttccatggatgctacctgaattgtttgttcatttatttactttttcaacaaatatgtgctgggtgctgggcttggtgctgagtgcatagtggaaaacaaagcagaacagtctctcatttagatttcttaatctagtgggaaagaaacaataaatacatagtagcaatgagtt

SEQ ID NO: 250804 - DNA, 440 bp, Homo sapiens
tatcaaaataatcagtggtctccatgttgatagagccaatggggaattctcagttcttatcttccttggtgagtcattagctaacaagttgatcactcctatctcactgtaaaactctcttcactggctgccagtgcactacattccctcatctcctggccattctgcttcagtctctgagtcagtaccttctcatctccctgacatccaaatattgggtgttttaaagctcaatttctggaattcctctcttgtgtagccacagtctctgggatttcattccatttcatagttctcaatatctgtatgttttagcatttatatctccaacttgtttttctttctttagctctaaatagtaataatatcagctggcatccaacaagcttcacatgtctgaaactgagttcctgtttgcaattcaacaacaccctgcaaaa

SEQ ID NO: 250805 - DNA, 1134 bp, Homo sapiens
tggatcctgacaccaaactcatcggaaacatagcactgttacctatcagaagtcaattcaaaggacctgcccccagagagacaaaagatacagatattgtggatgaagccaactattacttcaaggccaatgtcttcttcaaaaactatgaaattaagaatgaagctgataggaccttgatatatttaactctctacatttctgaatgtctgaaaaaactccaaaagtgcaattccaaaagtcaaggtgagaaagaaatgtatacactgggaatcattagttttcccattcctggagagcctggttttccacttcacgcaatttataccaaacctgcaaacaaacaggaagatgaagtgatgagagcctatttacaacagctaaggcaagagactggactgagactttgtgaggaagttttcgaccctaagaatgataaacccagcacgtggtggacttgctttgtgaagagacagttcatgaacaagagtctttcaggacctggacagcgaagggagcccgggcagccgccatctccagagccctgggcagcattttccagcaagatgtacacaatcttttgcctttattcgtaacgttttatatagaagagagaagagcatgtctttacttgaaaaactcttgatcaagaatttgggtgggagaaaagaaagtgggttatcaagggtgatgtgaaattttctgcagcattaagctggcgcttaataaaaataagtaacaaaaaaaattctcccttacctccctcgtccatttggatgaactatatgtcttttaaggcaacatatattaaaatgtaccttatttcccactttgatcagacaattcattgattattgtttttagaacacaaggtctcaacaacaaatgaagttattaaacaggaattgagggcagacgctagacaatgacaaaaactgagtccttttcaaaattactctgaagagacctttagggaccacaaatgcttttgagactgatctaagtgatgaactagcccctccacccttccctatccagaagaatacacatatgaacactaacacaaccatcttcagactgcttcaggaggtccacacaccaactgaagccatcatgaactctctacacatccat

SEQ ID NO: 250806 - DNA, 1265 bp, Homo sapiens
  misc_feature (493)..(493): n is a, c, g, or t
agagaattcacactggtgagaaaccatatgcatgcaaagaatgtgggaaagccttcagccaaagctcagctctcatacaacatcaaagaattcacactggagaaaaaccctacaaatgtaatgaatgtgggaaagccttctcttggatttcacggcttaatatacatcacagaattcacactggagagaaaccatataattgtaaggaatgtggaaaagccttcagttcccactcaggcgttaatactcatcgaaaaattcatactggagaaaaaccttataaatgtaatgactgtgagaaagccttcaaccaaagctcagctctaattcagcaccagagaattcatactggagagaaaccatataattgtaaagtgtgtgggaaagccttcagacagagttcatcccttatgacacacatgagaattcatacaggggaaaaacttatatatgtaagaatgtgggaagcttttagtcaactcatccttactancatcaaagactcataattgagaaaaactgtataaatgcatgtaggaactgaagttatattccatactgagtatcaaaaaattcattgtggggagaaagtgatgaagagtagttaatcataggtaaaacttcagcattagacctcatcacacatcagagacttcatgatgcagggtaaccttgggaatgctagaaaagcttctataaaatgtttattcatatgttcttaagttattaccatgaaatggagaatttttaagattgcagggttagtatttgattgtctagtgatgtacgataacagccaccagctttcctgagcatcactgggaagcctgctgtttatgtacaagtacagccataaaatccagacacagataaatctaggaatctattttttgaaactattatgcaagccagtggtactagaaagaatgttttagaaaagaaatatgtacaggtgacccatagctacctcactgtcactaaaatgttttttaataatcttaaagcagattctgcacttcatggtaaagactttgaattgtttctctgctttctaagccattcacctgagaagaaaatcactccataaactatgcagacgtactgtctttgcgttttcttcctgactacttgttccaaactctgagtcagatctaaagtcactttaagtcacagaacgcatggtatttcacttgtttttctcattaaaagtgattacctttgctgtattaaattgataagtaaaggtcattcagacaaccaaagct

SEQ ID NO: 250807 - DNA, 1202 bp, Homo sapiens
  misc_feature (430)..(430): n is a, c, g, or t
ggggagcgcggcgaggatcccgtcgtctcgatgctggagaaaaaccctacaaatgtaatgaatgtgggaaagccttctcttggatttcacggcttaatatacatcacagaattcacactggagagaaaccatataattgtaaggaatgtggaaaagccttcagttcccactcaggcgttaatactcatcgaaaaattcatactggagaaaaaccttataaatgtaatgactgtgagaaagccttcaaccaaagctcagctctaattcagcaccagagaattcatactggagagaaaccatataattgtaaagtgtgtgggaaagccttcagacagagttcatcccttatgacacacatgagaattcatacaggggaaaaacttatatatgtaagaatgtgggaagcttttagtcaactcatccttactancatcaaagactcataattgagaaaaactgtataaatgcatgtaggaactgaagttatattccatactgagtatcaaaaaattcattgtggggagaaagtgatgaagagtagttaatcataggtaaaacttcagcattagacctcatcacacatcagagacttcatgatgcagggtaaccttgggaatgctagaaaagcttctataaaatgtttattcatatgttcttaagttattaccatgaaatggagaatttttaagattgcagggttagtatttgattgtctagtgatgtacgataacagccaccagctttcctgagcatcactgggaagcctgctgtttatgtacaagtacagccataaaatccagacacagataaatctaggaatctattttttgaaactattatgcaagccagtggtactagaaagaatgttttagaaaagaaatatgtacaggtgacccatagctacctcactgtcactaaaatgttttttaataatcttaaagcagattctgcacttcatggtaaagactttgaattgtttctctgctttctaagccattcacctgagaagaaaatcactccataaactatgcagacgtactgtctttgcgttttcttcctgactacttgttccaaactctgagtcagatctaaagtcactttaagtcacagaacgcatggtatttcacttgtttttctcattaaaagtgattacctttgctgtattaaattgataagtaaaggtcattcagacaaccaaagct

SEQ ID NO: 250808 - DNA, 264 bp, Homo sapiens
cttatcagcgacatgaagatcaagctgattaataattttaattatattgatcacagactagtaagaaatcctgtgggaacatggtagtaagaggcaaagcaatgaattaatcattttatttaatcaaaaatcatttaagtagattcctttatttaaaaaatacaataaaatcaaattaaatttgtgcatatatatatggctatctgaagttatgctgagaaaatatctatactcaaattatgttctagataggtcttatggtca

SEQ ID NO: 250809 - DNA, 432 bp, Homo sapiens
atgactttgaggggtttaagacttcagtggaggaagtaactgccgatgtggtgggaattgcaaatgaactagaatcagatgtggagcctaagatggcatggtcttccaatagaaggctgtttcatctacattgaaaatctgttgtgtagtgtagccacttcatcagtggtcttacctcagtcttgtggagaacttgctgcagcttctacaccagcacttgttgcttcaacttgcacttttatgttatggagatgatttctttcctaaaacctcatgaaccaacctctgctagcttcaacctttccttctgcagcttcctcagccttcatagaattgaagagagttagggccttgctatggattaggctttggcttaaaggaatattgtggccgatttgtatcaagaccactaaaactttctccttatcagca

SEQ ID NO: 250810 - DNA, 714 bp, Homo sapiens
gagagagagaacttgtctcgagtttttttggggtttttttttttgagggaaagtcttgctctgttgcccaggctggagtgcaatggcccaatctcggctcactgcaacctctgcctcctggtctcaagtgatcctcctgtctcagcctctgaatatgctaggataacaggcatgagtcactgcacctgacctgtttccaggtttttactgttataagcagtgctccaattaatattacatctccatattgggcacttatgaggtacatctataaatacattctcagaaatgaaattgctatgtcaaagaataattgcacttttcatttgcatagacatttccaaattaccctcctggccccaattaatattcttacatttccatctttgggcacctatgaagtatatctatagatacattctcagaagtgagattgccatgtcaaagagtaattacacttttactttccgtagatgtttccagattatcctcctaagaagttacgttggtttatactcctaccaactgtgtattttctccacataattaagtatggacactaaagtaacaatagtccctatcttacatggttattgtgaggattaaatgaagtaaatgccaaaaggtacctactaagctgtcagcaaatgacttatattattaatataattattgtttttttctgaactttattaccagaaatattataaacct

SEQ ID NO: 250811 - DNA, 661 bp, Homo sapiens
agaggggtcgtttttgttgtttttttagtgtcgtcaggagactccctccatcagaattactcaggctgattgttttgagtcctgggacccagttggtatccagaatcttggcttgtttgcctaggaacctgcattttcacatccccatctccacacccctggtgattcttatgcatataataatgtgaaaagcattgcattgaagaattgctaaagggtgtcagaaaacggattaacaaaatcaggaagctttaattttcaagattctattaacctcaaaattcaacatatccaaaaattgaatgtctttttctccagtgttttctaggagagtgccaacactagccacccaagtgctcaagccagaaacctggaaatgatccattactctttcctctgtctctggagtccccatgttaaattagatgtgtttgtttgtgagacagattctcactctattacctaggctggagggcagtggtgcaatcattgttcactgcagcctcgacctctctgggctcaaggatcctcccacctcagcctcccagctactcaggaagctgagacaggagaatcacttgaacccaggaggcagaggttgcagtgaactgagattgcgccactgcactccagcctgggccacagagcaagactccatctc

SEQ ID NO: 250812 - DNA, 515 bp, Homo sapiens
aacgttgagttccgtacccggtgattgttggcccctggagttcgcggtcctttcggcactgactgactcggcgacctcccccgcaccgcgcagacccctgcaggaccctagccgctcacctgccgcccccggctccagactccgacgacccagcgtgggtctccggggatccagtgtctagagttgggggggtctcgaggacgaagggaagttttttaatgctacactttttgtttaaggttcttgcctggaaacattaaaacacacacacacacacacacacaaatttgtaggctggtctaaatgtctccagctctatttcttaatttcttgtaaatcatgaatcataaagtgtcatggctatacggtgatcctattagaattcctcacagccgtttatttgggctttttgtgaaaaactgcatatcatgttaaagaaaaaatgtaatgaattatttaaagaatccttgcatgtataaaatggaaaatacaacctatgcgtgcgtacctgtata

SEQ ID NO: 250813 - DNA, 488 bp, Homo sapiens
gctgctcaggccagatggatgagcttgtttgtgtgtgaatgttcctctcaccttcctgatggtgaggggggcgatgtccacttccagatgctgccaagtaggacttcctgttttcttcctcttgtccccccccgcttcctttttatatttacaaagctctctggttatgtacagcagggaaatggtgcctgagagactccttcagatagcagttccttctagtttgagtcaggaggcactgcgtccccagagtccctgcatcctcattcatgaaatgctggcagtcaagggaacagccctggctatctcatgaggttggccttaggatttaagtgagataatgtgtttgacaatggaatcccagcatgagcttgggtttcggcttcattaaaaaattagaatttattgtagaaaatttagaaaatagacagaagaaaataatcctagtaccttctcttactatttgatgtatatcccatatttttttc

SEQ ID NO: 250814 - DNA, 354 bp, Homo sapiens
gataaccatgcttgcctgctcaccctcggtgccttaaccacaaagagcagcgaaaggaaattctgggctcagctgggtgactcacgcctgtaatcccagcactttgggaggccagggcgggcggatcacttgaagtcaggctggtcttgaacttacctcaagtgattctcccgcctcagcctcccaaagtgctgggattacaggcatgagccaccacgcccggccagtataattaatttttacaactggtatggtttaaggagcagtgcttccaagaaggccaagtaaggagctcagcaaatcctctccctaaaaagcaatgacaaaactgaacaaacttgtcacaaaaaaaaa

SEQ ID NO: 250815 - DNA, 469 bp, Homo sapiens
agacatggctcttgcctttaaggagctcagcatctagtgggggcaacaggaaggagaccaagaaatgacacaggcatgacaatggcaccggagagaggtacacagagcatttcagaaatacaaataaaggtttcatgttggcctggagttggggataggaatggaaaaggaggggcagaggcaggatctgtgaagactttgcagatgagaagcaaattaaatcttcaaggatgagtagaaattaagggaatggggaaggcactacagccaggagtggcatgtgtaaagttaccaaggcaaagagagaaggagcattcagagagctacgcattacccatcgccgttgaaaagaaagaactacacaggtgttgtgtgtaagaaatgagcttcagaagtctgcaaagatcagaaaaaagaggcaggtctgtcctgctaagggccacacaccacagagttattgaggtatgtt

SEQ ID NO: 250816 - DNA, 704 bp, Homo sapiens
acaaagcatactttttccaggaactcatcctaaaataattccttcaagaattaacaactttattctgttatttctatgttgcttattatcagtctcacgtttgccatcttaaattttcatatacacattactaattttttcaaatgtgttaaattatttgaagtaagacattgtcttttttccccttaatattaccaaagcctttaatatcactgagtcctcttaaagattttttttctttttaaaatctgttgaataagtgatctcttctataaaataggtaaaacttacctgttgctagatgatctgggatatataagtgttcagttatggttcttatcatatcagagcatctctgaataatgagagggttataccttgcccacagctgtcttgaccacagaatacattttcccaggacctattgtccacattctcatttggtgcagggacaatgtagccatgtcactacagttctaagaccagaaacagatgctcatggaatcttttttctgaagtatttggaactgatctgttgtacatttagtggaaaacacttcaaataacttttaaagattgtcattgaaattgtaaataaataaaatgtgttaaatgacagttgttcacatttattaaatctggttgtaggcatatggatgcttttgtttttccctctactctgttgtatattaaaattgtttttc

SEQ ID NO: 250817 - DNA, 390 bp, Homo sapiens
gccatttgtcgttccattctgagccctttctgtctctccatcttcaccctcaataatgccatttgaattgtccatgcagctcccatgatgataattttgtaaagttggttgttttaggaagaagttgatttctttgatctcttgtctggtttgtagctatgttcctacttattctttccaggctctgccgttcttcggaaactcctccatgttacagtgtttgtgaaactgcttgcactttgattatttttaatgtgcatttcaccagaaacccatagtactcctgtactgggagtgaatcctgcctgcagtgagtgctgatgaatggagggatgagctaatataactaaaagaaaaggaaaacaattaaactcaatgccaaaacgaaca

SEQ ID NO: 250818 - DNA, 363 bp, Homo sapiens
cagttcaagaggcctgggcgatgtgaacctgaacagaatgaggtcagctgaataagaagaaatacaccagtaaaggaagatttgcagatttctcacccttcactgggccttcttgattagccacagtgacttggatcaattccgtcatttcatgaaccgatattttccattctctaccctttcctctgactctggtcttcttgcatctctgcctttccaaatggcttctcaactatataatttttaccaactcagctctaatgatagacgaaaccaacattaagctattgaactcatatattttagcatgtgcctacactcttgaaggcagcaatgaataaaaattctgctgggaaaatatag

SEQ ID NO: 250819 - DNA, 541 bp, Homo sapiens
cgtatgtaagtaatccaaacaaaactttgcataaatattttaagaaactgaaatatcagaatagatgagccattgaataaaaatcaacatcaatcacaacctacctcattttaaataagctacaaatcgaagtaaataatttgatgcgagtggtcatttctgctttcaatctgagaggaagtcagtaaattccttttgctgttacaaaagtagtttaaattccatgcaggacacgagtctgggcaatcacatcagcctcagcgtaccaaagagcctagagagacagcagaacaatgtctcccactcgagctacagagggaaggtggtcttaggttttgctgcagtaactggaagcttaaatttaattttcagtcagagcctgctgtttaagctccctgtctgttctgcaatctaagctgaatgggtactttttttttcttttctaatattcttaagtcatttggagaaatctaatacttatattttcaaattacatcaccttagctaaagatatattttcctctctataaaattcagttgc

SEQ ID NO: 250820 - DNA, 450 bp, Homo sapiens
ttagtcatgaagtaccataggaagagatggtcacaccctaacattgtaaagcaaaagaaagcttcaggaatcagaccataacagcaacactttgctgaaaaatatttaattagaaggcaataccacatactcacatatgctaaggagtgcaattattttgtatgtttactggaaaaggcaaaaaatttttctgtagttaaaacaatatttttgtttctagaacttttgttcttgtactgattcattaccattaaactgttttcacaaaatgccaaagaacagaggagagctatacatgatttgaccaagacgctgcaagtagtttcagaaactgaggagactatttttctgacaatgtatataagatctataatgaaatgattggtaaaattataaaatggttctggaaataatcatgtaaaatataaaatgggaaattgtaaatgtgat

SEQ ID NO: 250821 - DNA, 389 bp, Homo sapiens
tgacagcccacttgacaggtggtcaggaagaagtcaaatcttctagaggagaatcaaccactgacctaccagaatccaccatggacctggagtcacccacagatgtgtacctggagaacacccaggctttccaaaatgaagcaaattctccattagctgtgatgatcactgctatccactactttctaagaagattctatgcttttgagcatgcctaccactacactataggagatctattgtagaagactagaaaaacataggatgtgcccagctgaggcattgatcctggctgggtagggggaattgttcagggatggggaaggggcacttcttagctgtgtctcatcgagtacgggctcaataaataattgaattttgagagtggt

SEQ ID NO: 250822 - DNA, 567 bp, Homo sapiens
gatggtggcgccattttcagcttgctgtgggaagatggtgatggccttgacacagtgtaaatatgtgtcatcttgtgtgtaattccttatagatccagctagcttcttctccagtgtctccttttggagttgtacctgatttcattaccagttgttaatctgaatccactggggaatgggacatttttgcttttgtttcttggccaggaaacaatcctgaaagtcttgtgagaagacatggcaagaagcggagtcaggcacacaccacgatggtggagaaaggaagagataactaattttctatttttagtagagatgaggtttcactatgttgaccaggctggtctccaactcctgacctcaagtgatcacctgccttggcctcccagaagtgctgaggttaacaggtatgagccaccacgcctggtcaaaaatgaatattttaacacccaaagtacacagcccatcattttcttttgcacctcagatctgctgtctaggatcattattcctttgtatgaaatatatattctaaaatttcctttgttaagggtctgttggctgcaa

SEQ ID NO: 250823 - DNA, 632 bp, Homo sapiens
aatgtctggaactacccgacatacttgcagcaatttttagccccctaaattaagtcaagtgtatttatcatggcggtgtgccctacaaacatccatgctcactatttcacctttattgtaatgatggtattgtacagaaaatattaaatggtcaggggaggaggaggtgcaagatagagaaattctaatctagaataaggttttgtttgggagaaggcacagttagagcaataaaagctggtaagtctctctgcttcagtatagtgtcattgaagaggcaaatctagacgcacattcatttattttcgaaggtcctacactctgaccatcttgatcctctcacctaagcttgtctagtctagtccagctcaagagagtgtaatattctttttacttctggattaaagaaaaacataccactggcttatttccccatgtgcaaatcggaaatgagtatctatcaactttagaacataggagtacttaatacaataataaagcatacaatgaagacagaaaatgggataaaagtagaacagagagacaaaaattattaccagaatagatgagaacatttggttcatcaaaaataaaaagcccaatgctgaaagagaaaaccaagcaaatgatct

SEQ ID NO: 250824 - DNA, 224 bp, Homo sapiens
tttgttttctttcttccagggacatttgaaaaaaagaaaactatttttcaaagatctttagagctcaatttttaaagctctagattattttcattattttatgctgcctctgcataactaattttgatttcagggctaggagggtggaggtagggtgaggaaatgaaataagtttttgtcatctaaataataaacattatgaattaaacttaattttttaaatc

SEQ ID NO: 250825 - DNA, 363 bp, Homo sapiens
cttaggtattaagcccagcaagcattagctatttatcccgatgctctccctcccccaaccccagccacccccagacaggccccagtgtgtgtgtttccctccctgtgtccacgtggttctcggtgtgcagctcccacttagaacatgccatgtttggttttctgtttctgtattagcttgccgagaatgatggcctccagctccattcatgtccctgcaaaggacatgatctcattcctttttatggctgcatagtattccatggtgtgtatgcatcacattttctgtaaccagtctatcattgatgggcacaaatacatcatttttagattacaaataaagtgttgctttgaggtctctgtc

SEQ ID NO: 250826 - DNA, 551 bp, Homo sapiens
cttgggattagccccagcctctatgaggctggcctccagtccctgctgggcccggcaccctccccacaaagcaccccactctgtgctgggcccttgacatcccagcctcctccaggaacagcccctccacgcacctcttcccagacggcctccgattcagttctcaagacccggggccttgtcccctcctttgagaaggtgccctcagtggggggcagctccctggcttttccgggctcctccgcccacaggattcaggcacggctcagccagctctggtttcatccaccctgaggggcctgtctgtgcataggtgccctcactaaatgcacaagaagcctttactggtgttgctttgttaaaatgtgactgtcatcatccaattccagtttgcccatctacaaaacaggtataagaagagacagaaggcctagcatacccaaaggtctaggccggtgtgcttggtaaatgagtattattattacttctggatggtcgcaaaatacatgaactcttctcttcacccttcttcagtttcatttaaaaaaaaa

SEQ ID NO: 250827 - DNA, 499 bp, Homo sapiens
aaatgcctccctcactttgagtttatgcttttatggttttattttttatgtttaaatctttcctcaatctggagtttgttttgataatgagatgtgaggtataaatcttaacacctccacctccaattggccacccaactgcctaacaccattcattgactaatggcttcttcctctattgatttgaaataccactgttgtcatgtactaaattcttacattcttttcttttctctttatctgtatgttcattgccagcagctaaacctagtttaagttattgtagcttcataaaatgtaaaaatgtctggaagggctagtttgctctgattactctattttttttctgtcagtttttttctaggtattcttgccagactatttccaaacgaacattagaatcaacttatctaggtgaaaattcaacaaaaatcatgctggcagatctttttctccttctctctcctcccccctttcccctttctgtctgtctgtctct

SEQ ID NO: 250828 - DNA, 1948 bp, Homo sapiens
tttaactcaatttcttggaattgctttcagtaactgcttcaggcctctttgaatagcagtgaaggcaaaatcagggcaagtcgtggtgaacagtttggcttttctggaacactgagctgacgccagccaccccactgggcttggttccccaacatctcacagcgaaggcacttgtctgatgcatattaagcttttatgttaccaccgggggctgcctcagaagttactcctctgtgtcctgatggtccttgacttggccttggactgtccttgacctccaataccttagacagttgcaggtgggaacagtgtagcttgaggttctaaaatgctttgctgatggaaaaggttttgttctgaaaagtgaattacaataggaaatggatttgcattactgacactatctgctgtgggctttgcctctattgatttaaagcaaaagggcacaattagtggccttcaaagagaggggaaaaaaaaataacctaactctgtcctagcacgttcaattaacttgtttactttgaagggaaaaaaaacttttatttttacatcaacagcgtattagcatggtgttgccttgtctcatctgtaatggcaagacatggttttgaaaaaaaattctcttcgtttcatagtagtaatgttattttctaacattaagcacaacaacaacaacaaaaaaaagcagggagagcacgaggggttcggtgtataaaaacggtgttctagctgccagacttttattctggatctcgaagagaacagttcattgtatttcctttcctaaaccaatgaaaatgaaaaattagttactaggtagaattctcttccactttctatcccttttccctgacgagatgaaacctgctgggttttgccataaaaagaggtccctgttggggaaatgagagttcagctcactcttcacatcacagtgtaatacagcaggactggctctggaagattatgtagtgcagcactatgcctaagaacagaagaggaggctgagctctggagaaagagggtcacaaagcgttacaggcatttggtgaattttgctcactgcacaggcagttgtgagagcctccgaaccctgtagttcagtcttttccccactttaccagtgtgtgaggcctctctcccacttcctccacttaccacctctccaagatgccagcctcactgtgggctttccctagaaagaaacactggtttctttctatcgtgccctggttagtgttgtttctcacattaggcctctgtgttagaaataaagctgctaaactccatgtcgttatacaacaaaaggaatacagtgacctatccttcattcttctgatagttccctcaactccagctgcagcccctgccaaatactatcatccttaaaagatagacagtgatcccagcactgtgggaggccaaggcagctagatcacttgagtccgggagttcaagaccagcctgggcaacatggtgaaaccccatctctactgaaaaaaatataaaaaaaagccaggtgtggtggtgtgtgcctgtagtcccagctactcaggaggctgaggtggtaggattgcttcaggccaggaagtggaggttgcagtgagctgtgatcgcaccactgcgctccagcctgggtgacagagtgagaccctgtctaaagaaaaaaaaaagacagtgatgatgattatagctaacatttatggagcacttactatgtggtgggcactgatgctacaggcactttacttgtgtaccctgtaataatgagatagggctcgttttaaaggtgaggaaactgaggcacagagagattaagaaagtgtccaagttctcatagctaacaaatgtcagggtagagattcaaccccagactctagattttgcaaatcaaatctctacactttgtcttcaaggtcataatcaactctctcctttttcctta

SEQ ID NO: 250829 - DNA, 435 bp, Homo sapiens
tttaactcaatttcttggaattgctttcagtaactgcttcaggcctctttgaatagcagtgaaggcaaaatcagggcaagtcgtggtgaacagtttggcttttctggaacactgagctgacgccagccaccccactgggcttggttccccaacatctcacagcgaaggcacttgtctgatgcatattaagcttttatgttaccaccgggggctgcctcagaagttactcctctgtgtcctgatggtccttgacttggccttggactgtccttgacctccaataccttagacagttgcaggtgggaacagtgtagcttgaggttctaaaatgctttgctgatggaaaaggttttgttctgctgggagttccagtgctttttgtgcattgcgtatcacctgggtgtcttcttaaatggacagggttctaggcagcat

SEQ ID NO: 250830 - DNA, 829 bp, Homo sapiens
tttaactcaatttcttggaattgctttcagtaactgcttcaggcctctttgaatagcagtgaaggcaaaatcagggcaagtcgtggtgaacagtttggcttttctggaacactgagctgacgccagccaccccactgggcttggttccccaacatctcacagcgaaggcacttgtctgatgcatattaagcttttatgttaccaccgggggctgcctcagaagttactcctctgtgtcctgatggtccttgacttggccttggactgtccttgacctccaataccttagacagttgcaggtgggaacagtgtagcttgaggttctaaaatgctttgctgatggaaaaggttttgttctgaaaagtgaattacaataggaaatggatttgcattactgacactatctgctgtgggctttgcctctattgatttaaagcaaaagggcacaattagtggccttcaaagagaggggaaaaaaaaataacctaactctgtcctagcacgttcaattaacttgtttactttgaagggaaaaaaaacttttatttttacatcaacagcgtattagcatggtgttgccttgtctcatctgtaatggcaagacatggttttgaaaaaaaattctcttcgtttcatagtagtaatgttattttctaacattaagcacaacaacaacaacaaaaaaaagcagggagagcacgaggggttcggtgtataaaaacggtgttctagctgccagacttttattctggatctcgaagagaacagttcattgtatttcctttctaagggttagctgttgttatcattgtcattactaggcagactt

SEQ ID NO: 250831 - DNA, 440 bp, Homo sapiens
cctttgttactgaccgatgcttaatttggtttctgggttttgttagttttttcccctgcccttacctcatttaccttaacgacagctcccccctctagagctcagctagggcaggctgccactgtggattggggggccaagaggcccagtgcaagaagaaagtgggttgaaagcagagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttgttgttgttgtttcttgaatggccaaatcctcgttttaaa

SEQ ID NO: 250832 - DNA, 456 bp, Homo sapiens
cgctcttatctagaagggaggataagaaatctaattttttagtggggacacatttctgctcaccaaaaagtcagggccctaaagaatatattttggataggccaacagcagtgtttgccgcaaccctcaattcagctctggatgtatctttgcatagccagggatgcattttttaattaaaactaagaggccatgccattgctgaagggtggggaactggagcagaagaaatgtctctgtccttcatctgctgtcttcactaacagtctctgaaagtggaaggggcagtaaagaaatttactttcccactgttgtgaaatttaccaccctccttataaggcagaagtggttacagttgctttttattttcctgttactatacccaaggattgttgtgagaatcagaagacagatatgagaaatcatgttgtgaactataaaatgctattaaatgac

SEQ ID NO: 250833 - DNA, 757 bp, Homo sapiens
aactatagacaagaaatgagagagaactgggatagtctaaggccacatggagatctgtcttgcactatgttgacttagtttagaggccccggctggagaggagtcaggcccttttcttgtggggtcaattaagtccgatcctcaattacctccttgtttgtctctcagacccttggccgctattcagtcgccatatgtgcctcggagccagaaaccacaaaaaaaggttttcgcctactgctgccctttatccctctggctcaactctgacgctggtgctcccacgagtggccccctgtggcatggcacgctgtgttctccccagggaactctttaggagacaggatgtctgaggtcagaagttccccctggtgaccaaaccagttaagactgatgagattcaagatccagctcacttcgcctttgaagaacctccaacttcattataatttattttccatactaaatgacactcccaccagtgccatgacagtttataatcaccatgacaatgaccagaagaaattatgaaaggacaaaaaggaagaccacaactccggttctgaggaattctccacccattcccagaaaagacaagaatactcctccccttgtttttaatgcccaaacccttcattaaagatgtcccatatctgtgacttcctgtctctcattaattgagaagttaatctgtgagtcaagctcccacttcttaagtccatggccattgaataaagcctgcactgcttgatgctca

SEQ ID NO: 250834 - DNA, 583 bp, Homo sapiens
agcctgtttgccctgcctaaccctttcattcctgcagaaaccacaaaaaaaggttttcgcctactgctgccctttatccctctggctcaactctgacgctggtgctcccacgagtggccccctgtggcatggcacgctgtgttctccccagggaactctttaggagacaggatgtctgaggtcagaagttccccctggtgaccaaaccagttaagactgatgagattcaagatccagctcacttcgcctttgaagaacctccaacttcattataatttattttccatactaaatgacactcccaccagtgccatgacagtttataatcaccatgacaatgaccagaagaaattatgaaaggacaaaaaggaagaccacaactccggttctgaggaattctccacccattcccagaaaagacaagaatactcctccccttgtttttaatgcccaaacccttcattaaagatgtcccatatctgtgacttcctgtctctcattaattgagaagttaatctgtgagtcaagctcccacttcttaagtccatggccattgaataaagcctgcactgcttgatgctca

SEQ ID NO: 250835 - DNA, 636 bp, Homo sapiens
acaagaaatgagagagaactgggatagtctaaggccacatggagatctgtcttgcactatgttgacttagtttagaggccccggctggagaggagtcaggcccttttcttgtggggtcaattaagtccgatcctcaattacctccttgtttgtctctcagacccttggccgctattcagtcgccatatgtgcctcggagccaggtaccagacaaccaggaacaagcccactgaaattatttcaagtcatcaagcctaagcctgtttgccctgcctaaccctttcattcctgcagaaaccacaaaaaaaggttttcgcctactgctgccctttatccctctggctcaactctgacgctggtgctcccacgagtggccccctgtggcatggcacgctgtgttctccccagggaactgtgagtataacaaaactgtaaaactctttcaagcttctcttttgatcttcctctggcttcaccatacctcatccacattaatatggttaaatcagccatctgatgtcttgtcaaatgacaatgttttcctcccatatttttttggcaggcctttgttttccttgttgaattgtagaaattttgttttataaaggatataaatcctttgtaagatgcatgcat

SEQ ID NO: 250836 - DNA, 444 bp, Homo sapiens
agccctggactatttctgccactaccagggttttcaacaaagaacagtacgtgtgacaaaaatccatctgtttgtttctctttttgaattacttaacctttgaatattcaaccttttgccctcttttgctttatgttttcacaccatcttatcctcaaagaaggggaaatacttatcttcttctgtaagcctttgtatctaagaacacaaatgaagtatttagggacaattgctttgatttttacaagaaaactcagtggctattttgggtgacggtatgctttgctagcaaatagaaatagagaaaatctggcatctcaaggtgaaataagagtaaacagtttccagaattttctccctctctccttccttaataattgcaaattgccactgcttataaccataatagaaactagacatgtctcccggccttcctcaatgaaa

SEQ ID NO: 250837 - DNA, 137 bp, Homo sapiens
cctgctgggctaggtctccactggggccagcctcagtttctcctcaacaggtttggggacagcccctcctgccctgcttgccccacactgtctaggctcacttcctgccacagtgtaataaagcctcctaccctgca

SEQ ID NO: 250838 - DNA, 443 bp, Homo sapiens
agcccctctcatggttcccatataagtctttgggtgaggtgcaggtggggcatcctttgaaactcacccagatgacccctgaaaaaagtcatcactgttcaaggtgaaggttacatttccggtacctcctcctttctcatacaaaaggcaaaatatggctgggtgtggtgggtcattcctgtaattccagtactttgagaagctgaggagggagaaccgcttgtgctggagttcaagaccagcctggaaggtctgaacatagggagatccagactgtacaagaaaattaaaaattagccaggcatgatggcacttacctatagtcctagcgacttgggaggctgaggtgagaggattccttaagcccaggaggttgaggctgcagtgagtcatgattgtgccactgcattccagcctgggtgacagagtgagaacctgtctca

SEQ ID NO: 250839 - DNA, 380 bp, Homo sapiens
ggacacatgactaacgctttccaacctgccattttcatatgtatcatgcactctccacctcacaataattctgcctcccaaaagagcatattatagtcaatgaggtttaaggtttcttcggttcagtcatgtggaagttttgctttcctaaaattatagctggatcactttgattggatttgggatattacccaaatgctaatcaaatattaaaaggcaatcttttttgttatgtgattgctacagattactgctcttacagtttgattcttcaaattttcattctcagaagggaatcttaaacccagtttgaagggtaccttgtccacaaccacttttaaattttggctaacttcccaaccttccaccatgttctggga

SEQ ID NO: 250840 - DNA, 306 bp, Homo sapiens
gctgcaaaattttgtgacagtgacttctgctttctggcaaaagtggaaaaacaagaatggatttatcatgctgtttgaaacaaatttaaaaatccagcaaaatatatgaaacaatggttttctggacagtggctatcaggcagtgcaggagagtgataccacagagagagaaaacaaacaagatgaacattatgtttgccccagattacttccttaagagcattttcaggtcatgacacaggggtggggatcactggtagattccagcagattccctaggttgagaacagggaactaagggtccaa

SEQ ID NO: 250841 - DNA, 474 bp, Homo sapiens
cccaataatcttctgtctgtctacattcatctcagaaaatcctactcccccaagagtgattggtaggggatgtcgggggcttctggaatactgtactattctctgtgggtgctggttacatatctagtgttttcagattgtgaaaattcaatgagcctgtactgtatgcaatatattctcttttatgtgtgtgttatgctttaacaaaaagtttgtttttaagtgtatgtcccttccaagtgccctcctctctatagaaccttccctgatcaagtaactggaagtgatctctccatcctccaaatagttacagcaattatacctctcatatgatactaacacatatgagctgagcaaaccttatttcattactggacttcaatttacttaaaattggggaataactgacatatatttgaattccctagaatgcttagcatgttataggtgtttaataaatatttctgaatgaat

SEQ ID NO: 250842 - DNA, 299 bp, Homo sapiens
ccatagccaggccagaacaatcgagccgctacacgggtggcttacccccaccccgcccacactcactgctcgtcgcctgcccgtggccacccgtagtgccgctgccgtcggcctcgcgcagctcgcaccccgccgctgccacctgacgccccgtgcgaaccggggttcgaggggagaccctgatccatgccatctgagtacagattagtcgggactgggactggcgaagattgccgaaaggcggcggggaggaggaggagggtgtcatcgctacagtgagcaagcagatctcgcaggag

SEQ ID NO: 250843 - DNA, 338 bp, Homo sapiens
aacacctattgtttcagcaatggataaattatttagaaaatcaacaaagaaacatcagacttaaactatattttaggcctagtgaacatcatggtcacatacaaaacatttcatccaacagctgcagaatacacattgctctccactgcatgtggaacttcctccaaaatagattatatgttcagccacaaaataagtttataaaattttatgaagattgaaatcatatcaagtatcttttctaaatataatagtataaaactagaaataaataacagggggattttggaaaagtcacaaatacatggaaattataaaatttattgagacaaataaaa

SEQ ID NO: 250844 - DNA, 491 bp, Homo sapiens
gcggccggcgaggtggagcagtacaagctggtggagagcgcggacacccccaaggccagcaagggcagctacatggaggttcgaaccggggaccctccggaacgcagggactgtgagctgggccggccgggccccgacagccagagttcggtggccgagatctccaccatcgccaaggaggtggacaaggtcaaccagatcatcaacaactgcatcgacgcgctcaagtccgagtccacctccttccagggcgtcaagtcggggcccgtgtccgtcgcggagccgccgctggtgctgctgtccgagccgctggccgccaagcacggcttcctggcgcccgggtacaaggacgccttcggccacagcctgcagcggcaccacagcgtggaggccgccgggccccctcgtgccagcacctcgtccagcggctccgtgcgcagcccccgcgccttccgagccgaggccgtcggggtgcacaaggccgcggccgc

SEQ ID NO: 250845 - DNA, 234 bp, Homo sapiens
tcattaaaaattttctactgtgtgtaatcagggaaataatgtgcatatctgtaatttgttactttgttttgctgttttataatattcttgcatttataagagacatcatttgtaccaaatcctagctgattaatttgcatatcattgtatcagtgtgatactttgcagtaaattctgctactaaggtacaactttcagctgaataaacatagttcatctccatgttaagcttca

SEQ ID NO: 250846 - DNA, 431 bp, Homo sapiens
tgttggtttcggccatgcggtttgtggtaactggttccagcagccctaggaatctaatacactgcccatggaacaaatcctttcttgaccaccaatggctgcatgacttatcctgagaagatcatggggattttggatgccaggtcaacccttacactcagcaaggaagtggaagggcctcagtttcaaacactttgtaaacacagaggttaggtcatttcctctccaataagccagaagctgagctgtccctggcagcaaactgtgtgtcaaatgcctggcgggtttcaggttttactaactccagagtgacgaaacatcaccacctctaatgccagaaagaagtcagctgttgtacctgtgtcacaactaaatttactgaagtcagggcagctgaagtaatctataaaacttagcatgtcaatttcaat

SEQ ID NO: 250847 - DNA, 461 bp, Homo sapiens
agtctaatagtctaatctagccctcttaagtgcagagatgttttccctctgaacacccgtgtgtttcagctctgttcctcttccaatgcccttccacagggaacaaatcctttcttgaccaccaatggctgcatgacttatcctgagaagatcatggggattttggatgccaggtcaacccttacactcagcaaggaagtggaagggcctcagtttcaaacactttgtaaacacagaggttaggtcatttcctctccaataagccagaagctgagctgtccctggcagcaaactgtgtgtcaaatgcctggcgggtttcaggttttactaactccagagtgacgaaacatcaccacctctaatgccagaaagaagtcagctgttgtacctgtgtcacaactaaatttactgaagtcagggcagctgaagtaatctataaaacttagcatgtcaatttcaat

SEQ ID NO: 250848 - DNA, 456 bp, Homo sapiens
ctaaatggaagcttatcactgttcatagtcatgggatcatttggccaatgggggaacctgggaggcagtccttcctatgttggttgaaggagagctttgcttctcgtggcatacagggacccacccttatggcatgacttcaaagttatgtgacatggtggtgcagctggaagatgaggaaagtgaacaacgttggagaggccccacctactcttgactgtctctgctggaagtgattcaacactcctctttaaatttcattgataaggaaaacccccatgagagaaagtaacttgatcaacatcacacagctaggtgggagtggtggcttctgcctgtaatccaagcactttgggaggacgaggcaggcagatcgcttgagcccaggagtttgaaaccagcctgggcaacatgaggaaaccttgcctctataaaataaacaaaaattaaccagga

SEQ ID NO: 250849 - DNA, 418 bp, Homo sapiens
aaaccccaacagaataaagagcagataagagatagcatgttctttatttaataggccaagaagcagagcaggaattggtgcatatattcataattgtttctttgctatttgattttaggacatctggccacagcctgtctttccctactgttaccctcttcctggatacacctgtgtgtgctaagaacattgttctacttgattctacaaacatgccacctggtttgatttcttaagctttgcctatgtgattctccatcccactgtttctacttgcccatctccaagttatacttgaagggttggttgaaatatccctcttctgtgaagtttttcagatacctttagacagaaataattgcatgtaatctgtgaccccaccatgatttaaatatatatatttttaaaagcgctcatc

SEQ ID NO: 250850 - DNA, 474 bp, Homo sapiens
ggctggtttcgaatgagcccacgtagtctttttttttgagacagatttcgctgttgtcacccaggctggagtgcaatggcgtgatctcggctcactgtaacctctgccttccaggttcaagcaattctcctgcctcagcctcccgggtagctgggattacaggcgcctgccaccacgcccagctaatttttgtatttttagtagagatggtgtttcaccatgttggccaggctggtctccaactcttgacctcaggtgatccacccacctcggcctcccaaagtgctgggattacaggtgtgagccaccgcgcctggccgagttcatgtagtctttagtgacgctttgcacagtgaaaggtattctctgcctgtactccccgtaggtgaacatgccttctgcaatgcagaatgactttggaaagattgtatgtgtttttttttatgataaaaataaaatagaatttttaaagag

SEQ ID NO: 250851 - DNA, 464 bp, Homo sapiens
gcggccgcttctcccgctttacggctgctgaaaacccggcctggcccggcagccgtaccgcagacgagcccgcgcccgcgccgctcagttttctgaaagaaaagatcagtaagatcagttatgggctatgatgaaaccattttaagtctctgttctttgccaagctccaaggtccatgaaatctgatggtgtaggaaatgctcatccagtatctgcagtgctgtttaaagagaaaaggcccagtgtaatttcggcttattttacatcaaaaatcacctccatcaaagcagagatcaatgatggttaacatgaatattctgaagtttgtatctacatctcttacacaaatgcatttcgtttaagctttcctgtaataaagatctcccagctggacgttcaaaatagcttttgatgtcttagggcgtcttttattcaaccctaggtaagccctctattggtgacct

SEQ ID NO: 250852 - DNA, 524 bp, Homo sapiens
tgtgagtaatagtgggtgactcattgcaagcaggggagtcttgcagcttttgaggtgaacaggcaaaggggagaacagtgatggtggccacccaagggccaagtgtttatgtcctaaatgtcaaaatgtctttgatctcctgttaaactttgcagctgcatcattcacatgaatagttgcatttttttttttctaaaaatgcaacatattttctaaagcatttgtttttaatctgggatgattctgaggtgggaggtaagttggtggcaggacatactacatgatttttgttattgttattatttttaaaaatcacgcattgctggctttcccctatactcctggagatgccatcatgtatgtatagctaattctaaaaagggcttgtgtgactcttcatatgagaaggggtggttatttgtggcttgaaaaaattgcttgggtgattctgatctttctctttcactctgctgaaaaccattgtttcaaagccaataataaatatctaaagaagttttacttca

SEQ ID NO: 250853 - DNA, 856 bp, Homo sapiens
tcccacatgacagcaagaatcactgaaaatgctggacccactgtcaatgctgtattgttgcaaagaaaatgtttatcttgcctaactttaaagtcacacatgcctgggaacttccaactagaacacagctggcaaagcagacaccctctccctgcagcctcgttgaaaatgacctcctttacatttcctcattgagaatctgcccagtgaggactgtggcagaagagagtcagggagaattttctagctgattagggttagaaaatgaagacgagggctctcttgtaatcagcaggaagctatgatagaaaagaatgccttttaaatttgaagtgcaaaactagaaaatagaaaattattaggggggtttgatatgaagtttcggaattcttttcaagactgtgtgttttgaagttaagattttaaataatgtaggaaggtacagtctatactgatgggttcaggatatgctaacccaaaatatggcaccttggtgtttgagaaaatggcggaagcaggaaggtcattctcaccatccacctccctttccccctcctgaagcaggtcttctttgaaaggcccctccctgtaaccagaagaaaggaacattcttacctttgaagtcacagggtcacagagaagaatctgaacaggacttactaaattcttccagtttgtcaccatttgctcataccatctttgtccagttatatttctccaaagctatccactcttcatcaaacttagcataaaaattgtaaaaccttacacatttcttcaggtcttccttttccttaggaagcctcccatgtcacatgaaacttaaataaaataaatctgtatgcttatctcttgt

SEQ ID NO: 250854 - DNA, 918 bp, Homo sapiens
tttacaataaaactgaaatgccagaaaaagagacaacctactttaaggtcaccactgcctcccagcaaggacgtttaaaaataacccccgatctgccctgtgctcacaactctcattgcgccagctcaatggcaggcccagtgccaccaggacagctatgtggaaggttccgggtggggcacgggtgtgtgttatggaggaggtgagggaggctgttctcataacaatgctggcatctggtctgtgggtccaccctgccgatgtctgtgaaagggcatgtggttggcccctgttagaccagttctgatgccagtttccagctaaagtgaaactgctccagacctgagtgggaagtgcactgtgagaagtcaggttcacctggagggtatggatgccagggtgtggcattgggtggacatcaagcacatccctcagggagtcctggggctattacctctagaagctgctccagcaactctgccagacaggatcataaacttttgcagctaaatcttggggatgaactttttcagtaattgtcaagctgtgccccacagattgctggtgattctggggcagtgatatggtttggctctgtgtccccacctgaatctcatgttgaattgtaattcccaatgttgtgggtggcagcgggggaacctggtgggaggtcatgaatcgtgggggcagttttccaccttgctgttctcgtgatggtgagtgagttatcacaagatctgatggtttaaaagtgtgtagcatttccccttctgctctctttctctcctgccaccacgtgaatacgtgcttgcttcccctttggattccaccatgattgtaagttttctgagacctcccagccatgcttcctgtacagcctgtggaactgtgagtcaattaaacctcttttcttcgtaa

SEQ ID NO: 250855 - DNA, 352 bp, Homo sapiens
atctgtttatctgttctttcacccttgtcttgatgagtgttgcttcatagtaagtgttgggttgggcagtgttagtcctccaaccttgttctttccttccatattgtgttggctattctaagtcttttgtctttccacataaactttggaatcagtttgtcaatactcacagaataacttcctgaaattttcattgagattgcgttgaccctatagatcaagttgggaataactaacattgttacaatattgagtcttcctgtctgggggcggtggctcacacctgtaatctcattgctttgggaggcagaggcaataggatttcttgaggccaggagttaaaagaatagcc

SEQ ID NO: 250856 - DNA, 362 bp, Homo sapiens
taaatcaatactcaaagattcaccccaaaaaaaacataatgaacacacacatatccctattctcaactacaacacttacaaacatcattctgcccctatttcatctgttcctctcttttccttagaaacatcttttgcatctacgccataaaataagtttatattcacaatttaagttgaagatttccaaatgcccccggtcatcactgtccactggtactcctcggatggtcatttttcgtgtgcaggagacagtttgttctcagtccctcaagaactcatttaaaagtcatattgtaatgaaaatactttgactgtaaaaattatatcttgggaaattatacatgtattcactatcttgc

SEQ ID NO: 250857 - DNA, 437 bp, Homo sapiens
tactagcagtgcttgacactgaaaatgttatgcgttaaaatatttaatttcattctgagttaacatttttcccctgaagcattattttatgtaactggaatacccagtcacttcaggatacagtcattgtcgaaatccttgtaggttaaatattggattttcctcagatcctgaggttcagcttctgtgtttttttttgtttgtttttttgtttttttttttttgtttttgaaacagagtcttgctgtttcacccaggctggagtgcagtggcacaattttggcccactgcaacctctgcctcccgggtttaagtgattctcctgcctcagctactcggaaggctgtggccagagaatggcgtgaacgtgggtggcagagcttgcagtgagccgagaccgcgccactgcattccagcctgggcgacaaacaaaaaaa

SEQ ID NO: 250858 - DNA, 678 bp, Homo sapiens
tccatagttaaccttctttctaccatgcctcctgtgagaaacagtttaaatggtccattttcaaggcataaaaaatctgagtactggcagccaaccttgcggacgtgacgaacctcacgactcaggcacctagaaagtcacacttagcgaacaggatgtagaggaggggtcagcccatgaaagggggccaggcgcggtggctcacaccctctagaacagaccattttccatctgatttgttgtttgtaatcccgatacctggcatcacacctgcacctggaaatggtatgtggatgactggcgtttgctaattgttgaacttgggaaattacatatggcaaataattgtatggaaaatataaaggcttacaagtaaactaaggaatataacttaagacaatttaaaataaatctattagactgcaaaaataaaatgtatgtttagaaaatcaatgtggaaattctgttttaggacgtggtagactagactatactggacaaaccttcctgctgagaacagtcatatcagcttgacacaatattaacattatctgttgaaggtgctgaagagccaagtcactgagaattttcagggccaacatcagggcaaaggggaacagtcaaagagaatgagcttagtgccacattaatgctcaagagccaaatccaaaagtggtg

SEQ ID NO: 250859 - DNA, 418 bp, Homo sapiens
gtaggtaaggagctattacggctgggtgattttgagcatggctctctgagcctcagcttgagtatctgtaaaatgggttgacaacaatttcattgcagggctgtggtgaacataaaatgtactaatggctgtgagaggctttataaacagtcaggggtgggattgagcctaagttatatatatatccattatgtctgtttgcatgtgggtcgatatatacatgggtatacacagagtttgggttgaggggctaatgtaggaccatttcctgcttgctataagctaaacagcgagtaatgctatctccttgttctctttccagctggttctgaggacatggggaccacagtcaatggagatgtgtttcaggtaagcaaggctctgtctcagcagtggtaaggaccaatagccctggtct

SEQ ID NO: 250860 - DNA, 431 bp, Homo sapiens
cagacgagccatggtagttttatgcttattattagtgataaaaccacattcaaaagtatactatttgtgtttttctggttacaccctaataggctgaaaatatgtaataaaataccctaatgactacaccttgagaactaaaccctattctaattgctttgatgcatgggctagcaggataattgattgacactaagaccactcagtaaacagccagctaacagaattagattaatgaaaacatatggtaattacaactgtgcagaacaacttgaaatctacaacgtagcctcaggataaataatcaaaagtctgatcaaagagcaattaaagttaataaaagtctcattgtgcatttaggattaagaagggctgaaagatgaaactgtaaagttttagaagggtatttgatgaaagatttacttcattcc

SEQ ID NO: 250861 - DNA, 319 bp, Homo sapiens
caggccccagagctggggtgaggcatacagtgccttccctgcagaggcagatctctagatgccctggcttccaacaagtggatgagggatttggagacccagagcaatgcttatcctggaaagggacccttgtgacagtctagccttaaaaacaaccacaaccataaaacttgcagcagcagcagcaggctttgtcgagagcctattaaggtccaggtaatggggccttccgtgtgtcactcgtgacccatggcagcttggcccagagtcagagaaatctcaggccaacatccaaaaatgagtgaaaagcaatttaaat

SEQ ID NO: 250862 - DNA, 352 bp, Homo sapiens
cggtcgggttcaagagtgcccgggcctctctgaggaccatgtgtgtaaccccaggatccccagggctccccacggtgagggagatcagaaggaccccaagcagttctcaaagaagaaagaggctataaaaagtggcagcaagggacccttgaggaccgagaggccacatgggagcactgtggctggaggaagcttctccatgattgaaaaccctgcttctcaatgagcagtaactgcgttgaggataaaggagtgagaggcagatgtgtccaaggcacctctgcctcccgagtgacatcctccccggggctgtacactcttgagggcatggatcgcaggggcacaagcactt

SEQ ID NO: 250863 - DNA, 510 bp, Homo sapiens
gctaccagaattcccaggacccccaccctggccactgccatctaccccttcttcatgtttcctcagtgagacccaaggcaaaaaatgaagaatccaattgcaactaaatccaccacctttaccagaattgcctaaaacataaaacgcacattccctgaggatccatggaccaatggcacagtgggtacgtccgagacctgagtcctccctgccctacccctccaaccccgtacccttcaaggccagcctcagcctgccctgacctccacgatagcaatgaatcctctttaggcattgaggatgctgccccagcacggccggaacgaggggcacctggggacacagacagcacatctgtacctgcaatgcccaaaaatgcctggcatgaggaggtcctctatttcatcagtacgacaggtatgccaccagaaaaatctttttagaaagactccagaaagatgaaaacattccaaattttgtttaaaattttattaaaaactagtgttgtgt

SEQ ID NO: 250864 - DNA, 602 bp, Homo sapiens
agggaagagaaagcaggcccagctggagatttcctggtggctcaattttaaccccagcagccaatggaaaaatcacgacttctgagactttgggagtttccacagaggtgagagtcgggtgggaaggaaacaaaacaaaacaaaaacatcaaaccaatgaaataaaataaatcatgtctcctgctagaatagtattggatacctgactaaattacacaaaatagaccataataggatagcgctgtgaatacatccttcccgatcactgagtcacagtgacccttggctgctgctgttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaatctctctgaatttggctgtgtaataaacaactggaactgactcaca

SEQ ID NO: 250865 - DNA, 690 bp, Homo sapiens
gtctcacaatcctctccactctaagaagcagggtgagcccacaaggagcaatggagcagggcagcggccgcttggaggacttccctgtcaatgtgttctccgtcactccttacacacccagcaccgctgacatccaggtgtccgatgatgacaaggcgggggccaccttgctcttctcaggcatctttctgggactggtggggatcacattcactgtcatgggctggatcaaataccaaggtgtctcccactttgaatggacccagctccttgggcccgtcctgctgtcagttggggtgacattcatcctgattgctgtgtgcaagttcaaaatgctctcctgccagttgtgcaaagaaagtgaggaaagggtcccggactcggaacagacaccaggaggaccatcatttgttttcactggcatcaaccaacccatcaccttccatggggccactgtggtgcagtacatccctcctccttatggttctccagagcctatggggataaataccagctacctgcagtctgtggagcaagacagagcagagttgccatgtcaacacatggggaatgatatgatagaaacaatctttatgactaaaagaaactcatcttcttcattaaaaaaactttggtgtccttaatctctctgaatttggctgtgtaataaacaactggaactgactcaca

SEQ ID NO: 250866 - DNA, 1806 bp, Homo sapiens
gtctcacaatcctctccactctaagaagcagggtgagcccacaaggagcaatggagcagggcagcggccgcttggaggacttccctgtcaatgtgttctccgtcactccttacacacccagcaccgctgacatccaggtgtccgatgatgacaaggcgggggccaccttgctcttctcaggcatctttctgggactggtggggatcacattcactgtcatgggctggatcaaataccaaggtgtctcccactttgaatggacccagctccttgggcccgtcctgctgtcagttggggtgacattcatcctgattgctgtgtgcaagttcaaaatgctctcctgccagttgtgcaaagaaagtgaggaaagggtcccggactcggaacagacaccaggaggaccatcatttgttttcactggcatcaaccaacccatcaccttccatggggccactgtggtgcagtacatccctcctccttatggttctccagagcctatggggataaataccagctacctgcagtctgtggtgagcccctgcggcctcataacctctggaggggcagcagccgccatgtcaagtcctcctcaatactacaccatctaccctcaagataactctgcatttgtggttgatgagggctgcctttctttcacggacggtggaaatcacaggcccaatcctgatgttgaccagctagaagagacacagctggaagaggaggcctgtgcctgcttctctcctcccccttatgaagaaatatactctctccctcgctagaggctattctgatataataacacaatgctcagctcagggagcaagtgtttccgtcattgttacctgacaaccgtggtgttctatgttgtaaccttcagaagttacagcagcgcccaggcagcctgacagagatcattcaaggggggaaaggggaagtgggaggtgcaatttctcagattggtaaaaattaggctgggctggggaaattctcctccggaacagtttcaaattccctcgggtaagaaatctcctgtataaggttcaggagcaggaatttcactttttcatccaccaccctcccccttctctgtaggaaggcattggtggctcaattttaaccccagcagccaatggaaaaatcacgacttctgagactttgggagtttccacagaggtgagagtcgggtgggaaggaagcagggaagagaaagcaggcccagctggagatttcctggtggctgtccttggccccaaagcagactcactaatcccaaacaactcagctgccatctggcctctctgaggactctgggtaccttaaagactataaaacaaaacaaaacaaaaacatcaaaccaatgaaataaaataaatcatgtctcctgctagaatagtattggatacctgactaaattacacaaaatagaccataataggatagcgctgtgaatacatccttcccgatcactgagtcacagtgacccttggctgctgctgttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaatctctctgaatttggctgtgtaataaacaactggaactgactcaca

SEQ ID NO: 250867 - DNA, 1671 bp, Homo sapiens
gtctcacaatcctctccactctaagaagcagggtgagcccacaaggagcaatggagcagggcagcggccgcttggaggacttccctgtcaatgtgttctccgtcactccttacacacccagcaccgctgacatccaggtgtccgatgatgacaaggcgggggccaccttgctcttctcaggcatctttctgggactggtggggatcacattcactgtcatgggctggatcaaataccaaggtgtctcccactttgaatggacccagctccttgggcccgtcctgctgtcagttggggtgacattcatcctgattgctgtgtgcaagttcaaaatgctctcctgccagttgtgcaaagaaagtgaggaaagggtcccggactcggaacagacaccaggaggaccatcatttgttttcactggcatcaaccaacccatcaccttccatggggccactgtggtgcagtacatccctcctccttatggttctccagagcctatggggataaataccagctacctgcagtctgtggtgagcccctgcggcctcataacctctggaggggcagcagccgccatgtcaagtcctcctcaatactacaccatctaccctcaagataactctgcatttgtggttgatgagggctgcctttctttcacggacggtggaaatcacaggcccaatcctgatgttgaccagctagaagagacacagctggaagaggaggcctgtgcctgcttctctcctcccccttatgaagaaatatactctctccctcgctagaggctattctgatataataacacaatgctcagctcagggagcaagtgtttccgtcattgttacctgacaaccgtggtgttctatgttgtaaccttcagaagttacagcagcgcccaggcagcctgacagagatcattcaaggggggaaaggggaagtgggaggtgcaatttctcagattggtaaaaattaggctgggctggggaaattctcctccggaacagtttcaaattccctcgggtaagaaatctcctgtataaggttcaggagcaggaatttcactttttcatccaccaccctcccccttctctgtaggaaggcattggtggctcaattttaaccccagcagccaatggaaaaatcacgacttctgagactttgggagtttccacagaggtgagagtcgggtgggaaggaaacaaaacaaaacaaaaacatcaaaccaatgaaataaaataaatcatgtctcctgctagaatagtattggatacctgactaaattacacaaaatagaccataataggatagcgctgtgaatacatccttcccgatcactgagtcacagtgacccttggctgctgctgttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaatctctctgaatttggctgtgtaataaacaactggaactgactcaca

SEQ ID NO: 250868 - DNA, 1166 bp, Homo sapiens
gtctcacaatcctctccactctaagaagcagggtgagcccacaaggagcaatggagcagggcagcggccgcttggaggacttccctgtcaatgtgttctccgtcactccttacacacccagcaccgctgacatccaggtgtccgatgatgacaaggcgggggccaccttgctcttctcaggcatctttctgggactggtggggatcacattcactgtcatgggctggatcaaataccaaggtgtctcccactttgaatggacccagctccttgggcccgtcctgctgtcagttggggtgacattcatcctgattgctgtgtgcaagttcaaaatgctctcctgccagttgtgcaaagaaagtgaggaaagggtcccggactcggaacagacaccaggaggaccatcatttgttttcactggcatcaaccaacccatcaccttccatggggccactgtggtgcagtacatccctcctccttatggttctccagagcctatggggataaataccagctacctgcagtctgtggtgagcccctgcggcctcataacctctggaggggcagcagccgccatgtcaagtcctcctcaatactacaccatctaccctcaagataactctgcatttgtggttgatgagggctgcctttctttcacggacggtggaaatcacaggcccaatcctgatgttgaccagctagaagagacacagctggaagaggaggcctgtgcctgcttctctcctcccccttatgaagaaatatactctctccctcgctagaggctattctgatataataacacaatgctcagctcagggagcaagtgtttccgtcattgttacctgacaaccgtggtttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaatctctctgaatttggctgtgtaataaacaactggaactgactcaca

SEQ ID NO: 250869 - DNA, 356 bp, Homo sapiens
tgcctgtttcccacagccccacccattcagggtttgatgatttcattttcttttcactagtttggtaagcatgcactgatacccagagcttgtgtgtttgcattcctcttgtttctggtagaactatgtactttttcatgttttgatttaccatctgtgcttcctgtgtaaactgtctgttcacctcctttgttgcttacggagtggaatctgggcactgattttagctttttgtaaaaaagcaaaaattaataaattttagatgtatcgctggttggttatttcttccaggctgttattttcctcttgtgactgtcctatattttattcaataaaagtttcctattttttaattg

SEQ ID NO: 250870 - DNA, 378 bp, Homo sapiens
tggatgcttgggtggctgcactttgctgctgtgagcacttgtgcacaagctgtcgtgtggatgtgtgttttcagtaacctgcgtgtacgccgaggactggaattgctgggcgatgtaactgtgttaagcttctgaggacctgccagactgttttccacagcagctaaataattgtacgttcctcttagcaatgcataggggttcctgtgtctccatgtcatcaccaacacttgtccaaactaaaaaattctaggccaggcgctcatgcctgtagtcccagcaatttgggaggccaaggtgggcagattgcatgagttcaggagttcaggaccagccagggcaacaaagtgaaaccttgtctctaggaaaaaaaacaaa

SEQ ID NO: 250871 - DNA, 379 bp, Homo sapiens
aaacttgtgtgctgcaaatgatttatcttcaagtaagtagaaagataatccatagaatgggagaaaatatttgaaaataatatatctaagaagggtcttttatccagaatatatgtgtatagaactcttgcaacttaacaataaaaagagcaatgactcaattgaaaaatgtataaaggattcaaatagatgtttctcaaaaaaagatatacaagtagtcaataagagcattaaagatgttcagcatcattagtcatcagggaaatgatgagctaaggaggaggatcgcttgagcccaggagtttgaggttacagcgtgctatgataaagccactacacttcagcctggatgacagagcaagatcctgtctctaattta

SEQ ID NO: 250872 - DNA, 428 bp, Homo sapiens
tccaatcaatcaataataaataaatagttcatgtgttatatttctctgttgagagcaaatacagattaaaatattaattatgaaaacttaaaagttttactgtaaaaatagtgagttaataaataataaatagagattaaaaataataattctgagccctttgaaattaagacactgtattttcatcttcttagagttcaaggcttcacattttacttataaaccagatcactgatcaataaatgattttgtagtaaaagctgagtgatttgcactgtaattttgaatttgaatataatatgaatatgaaatcacctattttaacaccttgaatccacaatttttttaaagtagaatcattgtagaggaagtttttctatttaaaatacaaaaatattctatatagtataagtatgttaaaaaaaaga

SEQ ID NO: 250873 - DNA, 380 bp, Homo sapiens
ctggtggcgtatgagtcatctacagtgaatacgtctctggaactctgaggtctgtcacaaaagaaatctagcccattttctatgtttgatacaatcctttagatgggtatcatgaacatagactgggtttgtttttggtctttgtgctcatacattttcattctatttttattattgggttaatgtgagaatcaataaacaaatataaaaataaagatatattggttgaagtgttgctcaattatattcaaggaggaataaatggtacgtgtctgtcacctctttggctaatgatgatatagagaggataattatagacagtgtttttattctgggtcagtggcaaattcagaattgttcatctttttaagacaaagtga

SEQ ID NO: 250874 - DNA, 372 bp, Homo sapiens
ttattgggcattttcattttggccattgtgagagcagttatactgtttggttgaggtatagtgttaactgttaaagacagtagagtgcttcatgcttgtaatcccagcactttgggaggcggaggtgggaggattgcttgctcaagaccaacctgggccacatagggagacgtggtctctactaaaaaaacaaaaacaaaaacaaaaaacagctaggtgtggtagtgcacacctgtagtcccagttactgaggaggcggaggcgaaaggattgctttagctagagaaatggaggctgcagtgagctaggatcagtgagctatgattgtacccacacacttcagcctggctaacagagcgagatcctgtctca

SEQ ID NO: 250875 - DNA, 1076 bp, Homo sapiens
acacaaatccttacactcctgggtttacattgctgcccccagcatatgcaggtaggatgggtttacattttaaaatcagttgtttgagtcgggtctttttcattctttctttctttttttcttttttttgtccattacctaggctggagtgcagtggcataatcatagctcacagaagcctcaagctcctgggctcaagcagtcctgagctcaagccgacttagcctcccatgtagctgagaccattggtgtgcaccaccatacctggctaattttgtagagacagggtctcactttgttgcacagcctggttggttgggtcttctgtcacaaggacatgagttttgtgtgaatgtcttttccttcttttttgttcagggagaggagaaaggacacatgtcaattttcttgtcacaaagtagcctttaaatggcctcccttccaatagcccactcgctggtggatgaatcatgccctaggattaacattttggccaatggttttggcattcttttggatttggcccagtcttattttcaatgcagagtcatgactatagataccagaagattagagaataaaattcattcatacctttcttggctgttggttgttaccaataaatatttcagcaaaggttcagaccccagaaaaaaacatcaagataggatataacaaatgtgtctttgctcatgtatctagcaggagaaaaagttactttttaaaaaatttaatgcagccgggtgtggtggctcatgcctgtaatcccagcactttgggtgtccaaggcaggtggatcacctgaggtcaggagtttgagaccagccgggccaacatggagaaaccctgtctctactaaaaatacaacaagattagccgggcatggtggtgcatccctgtaatcccagctactttcaggaggctgaggcaaacccaggaggtggtggttgcagtgagccgagattgcaccattgcactccagcctgggcaacaagagtgaaactctgtctcaaaaaaaaaaaaatttaatgcattttaatacctttggtctatgtacccagtttctttttttatat

SEQ ID NO: 250876 - DNA, 1480 bp, Homo sapiens
atcagtcggtacgcacctgaagttgccagatcctagttaagagataaaacgtagagtccttttgttgtccatttgtcagtgcaaatatttaatataagtatttctcccagggaccctatagacttgaaaacagtgactatagattgcagacaattttgatattccagggatctctgaccagaataataagaaattactgtaatttctcaatttctagcaccacacaaattgcatctcacacacacagacacatacacacacaggggcgggtttacctacttctcagaaaattgcacagattcaacgagaaagaataaatagtaattaatgtgttccttaatggctggtgaataataataaaatgttaactaaaacaaaaacaatttttatttttaaacccactatcactaagtgataaagtctaaactgacagaacagcaaattagtacagtcctttgggagggaaatatggtgatacatattgcgaagcaatcctgttatttgttgctttttttttaaatgacaggaaaaaaaacaaaattaaaaaaggctatgtttcataaatcacaatacattcttacaatgaatactatgtaaacactttaaaaatgagacacttgtgtgagaactaactttgaaggaggagcaaggtatttacaaattattctactgaatgatagctagtatttggcaacacctatgtactagggctgtgctgactgcttgtacacttgctgtttaattttacaataaccttacaaggcaggtggcatactaacctcatttaacaaataaaatggaagtggaggcttaagtttattatctagtatcactgagggaggccatagcacaattaggatctaaaagcaccaaaccttgatttcagaacctacacttccactcactgtgccagtgtgtcataaagtatacatacttttgaaaaactcatttaatatggatcaatgttatatttctttaatatacagcaatgtacataatatcaacgttatgtatttatctaatatagatcaatgtatgagttcacagctcttatcactaaggatttctgggtttctttagtaaattttaagaaaactgttatgaattaacagtacagatgatacaagcatatggcaaaagtaacaaggaggcactctaatgactgaaagtttggagaacaaaactcttaccttcccggccaggcatggtggctcatgcctgtaatcccagcactttgggaggctgaggtgggcagatcatgaggtcaggagattgagaccatcctggctaacacggtgaaacctcatctctactaaaaacatgtaaaatcagccagggttggtggcgtgtgcctgtaatcccagctacttgggaggctgaggcaggagaatagcttgaacccaggaggcagaggtttcagtgagccaagattgcacccctgcacttcagcttgggcgacagagtaacaatctgtttcaga

SEQ ID NO: 250877 - DNA, 430 bp, Homo sapiens
gatctcagtgtgtttgagaactgggaagatgaaaagggttcatctcatggcctgctttagtttgaaacaatttaagcttaactagattccaaaaaaacaacatttccacctgaaccagctgggttcattccagtcttttaccctggagtttggtgcccaagtcctagttaagagataaaacgtagagtccttttgttgtccatttgtcagtgcaaatatttaatataagtatttctcccagggaccctatagacttgaaaacagtgactatagattgcagacaattttgatattccagggatctctgaccagaataataagaaattactgtaatttctcaatttctagcaccacacaaattgcatctcacacacacagacacatacacacacaggggcgggtttacctacttctcagaaaattgcacaga

SEQ ID NO: 250878 - DNA, 676 bp, Homo sapiens
tgctttatacccttggagcttcatgatcacaggatggctgttatagctccagccgtcatgaccaagttcagactccaggaacaagatggaggaagctatgtcaaagggggcttttcttgatgtgtctctcgcctttaaccagtgaagaaaatcttcttagaaggacacagcagacttctccttatgtctcattatccagaagtggaccacaggacagtccctactgtaaactctttcaagtatcaggcaaaaaggaacaaaaggccccagcctggcttaaaccaaccttgagtcatcacctgacactggacactttgtttatccaagcaaaatcaggattttctgttagcaagcaaaggaactgctcatggataagaaattaacagtgtgtgccataattcatatttgccgccaagcatcttctcaggctgacactgtgccaaacaagggattatagagatgaagatgcagcttccatccctgaaagctcacagtccattctctcagggcaatcccggtaacctcctcatcacaatcatccatccagatcatggaagtccctttactccccaaataagaaggagtagcaggaaaaagtgacctcatcaagctgactcgagtttttccaaaagcaaataaataaataaataactttttaacctgcacagccaaatat

SEQ ID NO: 250879 - DNA, 747 bp, Homo sapiens
gatcagaagaattaatattgttaaaacgaccatcctgccgaaagcagtgtacagattcaatgcaattcctatcaaaataccaacatcatttttcacagaattagaaaaaacagtcctaaaattcatatggaaccaaaaaaataaaaaataaaaaagcaaagcctaagcaaaacaaaacaacaacaaccaaaaacaaagctgcaggcatcacatttcctgacttcgaactatactgtaagactacagtaactaaaacaacagggtacttgtataaaaatagatacatagatcaatgaaacagaatagagaacccagaaataaagccatatatctacggagtgccagctgatctttgaaaaagttaacaaaaacatgctctgcgtattctgagatgttctcaggagtatatgttagtccttctccacatacctgttttccaggttggtcttgaactcctgggtgcaagcgatttacccagcttgacttcccaaagtggtaggattacaggcacgagccatcatgcctagctaggctaccttttaaatatatatcatggccaatatttgtttattctgattatttattagttcctttttgatgtctggaagaacttattttctagccagacagactcttatatcaaatatcaaatttccagccttccaaatgggttttcctaccttgtctcaagccaaagcaaaacaaacccccaccccacaaaagaaaaacaaaacaaaacaaaaactt

SEQ ID NO: 250880 - DNA, 497 bp, Homo sapiens
ggaagcctgccaggtgacagctctgtggccttgcacgagtaactgaactcagtttcctccatggtaccacggacaaaagaaaatagcccaactgtaccctcgcctgtggcatcactgaaacttctgccttcaatgatgaacaataaaactcaccaggaaaaacagctcctcctcaaggacaacgtggaagtggaaatgaggggggttgtaccttctcaagagccagtctctgagaagactctcagggatggagtggcagtgccagaggaagagagagcaggctgggtccctgggaccacaccaaggaggtaaaggagagcctgctaaggaaccaagggctcacctgtggtagggaagtatacacctgtccataccaagcaaaagctgatggtaatgaaatgacaaggtcaggggaaaagcagggtcaaacatcatatgccaaagaggaaatcccaaccgttaagtcggcacacaataaaacattctgcttactgaat

SEQ ID NO: 250881 - DNA, 611 bp, Homo sapiens
caagcgattctcctgcctcaggctcccaagtaggtgggactacaggcatgtgccaccacgttcagctaattcttgtaattttagtagagacggggtttcaccatgttggccaggctggtcaccaactgctgacctcaagcgatccacccgccttggcctcccaaagtgctgggattacaggtgtgagccaccacgctcggctggcctaatgtatagttttaaaaaccatagttgttttggttaaagtaatgcagaaaggagtccttttcctgacagctcagctggtcttccaagtgtgattgtcaaaatggtagggactgactaaaacaaacaaacaaacaaaaagaaaaaaaaaaaaccaaaactattctatgccatagtgaaacctaatgctgaatttttctccaaaaaagaagaaagtgagaacaagcaaaccccagggctgctgggcctgtctgcaaagggtgaaagcagcagaggagtctaaatcgaactgaattgcaagatttcagttctaagcatggcacatgtatacatatgtaactaacctgcacattgtgcacatgtaccctaaaacttaaagtataataataataaattaaaaaaaaaaa

SEQ ID NO: 250882 - DNA, 417 bp, Homo sapiens
gctggagtggcaactgtgatagaaacatgtctgtgccagattctcgcccccacacactggaccagtgccaggggtagaagctgtaatgtgaactgggggcttcccctccgcccagccagaagcagagcaggaccttctataatattttaacaatgctgcaagccacaggaccactatcagagatggagccagtcagggttcaccgcctacccttaaacaaagcatttcaggtccttcctcctaagacagcacagactttgctttactttctcttatttttaaattaggcaaaactgggccaggtgcggtggctcacgcctgtaatcccagcactttgggaggctgaggcgtgtggatcacctgaggtcaggagtttgagaccagcctggccaacatggtgaaaccctgtctccacta

SEQ ID NO: 250883 - DNA, 456 bp, Homo sapiens
gcaagtgatacagtctcaccaagcccctgtgtcctcagttggaaaacaggggtaagaataccaactacctaaagtaacgctgtggatttcatgagaatatgagagattcctggaatagagcatggcaccccatggatgcagtaaatgccaggttactttggaatttttggacctttgggaaatctatcccaactttttctccttctgccacctacactctgccatccctttctgtggagttgctacagtaacgccacctgggtatacagaattccaggccctccaccccattcattgtctctatcaaaatgtacccatcttcctggccaggcacagtggctcatgcccataatcccagttctttgggaggctgaggcaggaggatcacttgaggccaggagtttgagaccagcctgggcaacatagtgagtccccacctctacaagaaatacaaaa

SEQ ID NO: 250884 - DNA, 470 bp, Homo sapiens
agtttgcttaagttgctaaaactctgcatcattattcatgtcatctccccataccccttgcccaagttaaaaataaagcaatgtcaggataataaaagctgtgacagggaaaaatgaaaaataaagcaaacatctcttcttattgcatgcatggtattaaatcagggttgccacttcaaatagtgaccagtactgtgcaagagctatggagagtgtgcttattttctttgtcctctggagcctcctttttcgtttgtttcaggcattttattgaacaccacacctaaaattcaggcatccagcatgctttcttaaatgtgatgatttatgttgggtgatgcatgcccccaactaatccagttaagggtgacttaattaagaggataaaatttgcctgtgcttttctgcttctagcattcacattacagcattcacatatttgcatttcctgcaaaaacacaggcagaaaa

SEQ ID NO: 250885 - DNA, 168 bp, Homo sapiens
accgtgtgaatagaactttaattgaatactgcaaaggttcaggcgacatgccttcctcttggtgtgagggggtagatgttaggagagagcagagaatatttcatttaatgcaccatctcctacatatgagtaattggtaaaacaaggataccccttctgctgcctttc

SEQ ID NO: 250886 - DNA, 622 bp, Homo sapiens
gtatccgctacaagaacaaatgtggtattctggatgggatcctgcaacagaaaaaggacactggataaaaactgaggacatctgaataaagcatggatgttagtcaataatgataatatgggccaggcatggtggctcacgcctgtaatcctagcactttgggaggccaaggtgtgcggattacttgaggtcaggagttcaagaccagcctggccaacatggtgaaacctcgtctctactaaaaatacaaaaattagccaggcctggtggcaggtgccttgtaatcccagctactcacctaaaacctctactcagtcccagctgtcttaccctcactccaccaatgctcctggttggtaattgaaaaaaccaaagctatcagccatgaatgatttctacttcctgttctgtctcactctctacaaatgcccacaaacctccaacttcagaggaagaagagtcctttatctaagaacaatcctcctattctccaaatttatgctctggccttgtcgcgcgacaaggccagacaaatggagattgggaaggggcctgattagaatagaaactgatgatgtgggtcagcactgtcagatgagaaggggcctggagaaccttagag

SEQ ID NO: 250887 - DNA, 536 bp, Homo sapiens
cccaccacagagcaaggtgaattgcaatgtaagttttaataatctacaaacatttactgaggcccaccatgtgcacagcattgtactttgcaagtagagggtaagaacaagtgaggcatggagtctgctcttgagaaatgagtaagcatccttttccttgttgtggtcatttccatctctcatgcccttagctcccaccctacactactcacctaaaacctctactcagtcccagctgtcttaccctcactccaccaatgctcctggttggtaattgaaaaaaccaaagctatcagccatgaatgatttctacttcctgttctgtctcactctctacaaatgcccacaaacctccaacttcagaggaagaagagtcctttatctaagaacaatcctcctattctccaaatttatgctctggccttgtcgcgcgacaaggccagacaaatggagattgggaaggggcctgattagaatagaaactgatgatgtgggtcagcactgtcagatgagaaggggcctggagaaccttagag

SEQ ID NO: 250888 - DNA, 1002 bp, Homo sapiens
ttcgcctttttcagactccaagggggatggaggagatggtctgaataagacaaatatgaaagaggaagtgtctcagcaccaaccaaacgtaaaacagcgacagcgacccacttcacttgtgacctatacagaaatactgaagacgtcctctgtgtccttttagactttctgggggagggaacagccgctgcccagaagcaagcagcttccttttggccaggtcagtgcagggaaccaacaaagacagggacctgtggccagaagaagcacagccgcagcaggtgtctgattggactgagccaggaaaggccttcttgcccttagggacccctcaaggcttttttcccaaaagctggaaactgcttggctcactgctgtgctaaatgcaggtgccagccgagggggttaccctaggaccgtgagccattaacagcttgtctcaaatacacttctccaaggcagtcagcaactccccactgaacacctgtgggttcctgctggtgctaacttaggcacggggctagcaggtccctcccctgtagcagatgatgagagcaagtgtggtgcaggaggaactgaaaagagagcgtcgtcagagatgacacttgcgtggattaaaaccatatattcttgtgcaatgtaaaaatgccaacttgcatcagcgtaacgaaggacacacttagaatagaaaagctgaggaggacagaagaataggaagaacaacaaaaccatgcctggtccttttgcccagaaatgacccatgtgaatcttggctgaacttttagactttttcgtggtgcacatttttcaacataatttgacaacgtgggacctctagaattgtacattctaatttttcagtccatttatttcttattccagaaagaatccatgtataaggatggctcatcacagtgttgtttttaattctgaaaagctgaaagatggatgctcaccactagtgtttatacataagttcaataaagttatgctctcacaata

SEQ ID NO: 250889 - DNA, 590 bp, Homo sapiens
agtggaagttctctgcctgccaaggacaaaatccaagtcctatttttctcagcctgagaatcatgtccactgagtccactccagatgtggaccaaaacagtcagtgactggtcaggagagacagtgctgccacagatgcagggccacatctatttaatcttttcataaggacttaattttccttcttcttcaggtcacaatggccatggatagcaattttaatacaatgtcagtagcctatgagaagagtagcaggataaaataattctagagtgttggactagcaactggagatgtgggttctggccacagtgctgtccctgcctcacagggtgatcacggtggagtccctttccctccctgacccacacattccttgtcagtaaaaagaggggcggggatgaaatcatctctgtgggtttccctgctctaaaattctgatcctgctacatattggacaagtctgagaattccaaaaataccttcaaaaattctactagaaatactgttcctgcaaagaatggtccccattcattaaaaagcagtactagttttcaaaatgaggtaataaagctatacattcaatgtgc

SEQ ID NO: 250890 - DNA, 819 bp, Homo sapiens
gaaattaggatacttacttagcatttaatgggatatgtttgtgtagttttgaggcactctgggaggaattaaactaaactattgacaaccatcctggtataggaatggcttccagaaaaattcctgttgcccatggtactgagtactgactcatctggcattatgacacaaagctgcagggccagaggccatacaatatgaatatgtcttgtaggggcaccaccataggtgtgtgggtaatggaggagaacaaggattgaataggaagctagtctggggcaaattcttccagtcattagatctataatattgtaagcagatgatctggttatcatcaatgtcaagtcaaaaggaaagttttctcttattagatatacacttcataatgtgacatgtataattatcaatgcaacaaatatatttttcttgtattgatgggaatccatgaactagaatgtattaagattaataaatattaataaagttgacctatggcagtactacaaacagtaagcacatttgtgtgtgaatgttgtatacatcccaaataaataaaaaacaaatattgatctaacttatcaatgggaagactaaaatacattttaatttttaaatagaaaataagaaaataatatattcccatgaagaagcaaagagaattcatgtaacacgggaaagagagcatttatacaggtatgacaagaagtcatttaattaaaaatgtatgttagtaatttgtcaactttttcaaatttataattaattgtaattccttttctcattttaaataaatatattttgtgcattactttgtatttg

SEQ ID NO: 250891 - DNA, 450 bp, Homo sapiens
acacccttatctctgttccacgacagagactcctgggaaggacccaatctggcaggggtgggcgttttcttggacacagccgttttcccgggagcccgaagtcccaggagcctctggacgagaggtttatctcgagagagcctcataaatgcatgttcacagtcaggggcacgacaggaaatgcatgccacagtgctgcgggaaagatttcctaaagcggtttctggtcctccttgaatgccagtttcacgcccctaaaagctatgacgctgaggcacctttcagggcctagcagtggggtgtggggttttgtgttttcatatggaacaagctgggaaggggccagaacctgttgctcacaggggccagggggcatcagcatcggggaggaagcccctcaggaggagaggtgcctggggggcggttgagaggctgcttcccagtggctgc

SEQ ID NO: 250892 - DNA, 278 bp, Homo sapiens
cccccaccccaaaacacacacacacacctaccacactgcctacaagaggctctcagctctgctttcacctgaactcttccacagcctgagcctcaggtctggaacccctggaaaggtctagctctgtctgggctgcccctgggaaaacctttgtgggcccaaaaggcactgtgaactaccccaacaagtagttttagtcaaagttatcagtaataggcagtgagacaaatgagcatactaaccacaaggttaataaatgtatctcttacatagttaaa

SEQ ID NO: 250893 - DNA, 428 bp, Homo sapiens
agcttctggtcgcctcagggattccttggcctgggtcctgtgtccacatttcccctttttataaggacaactgtcatgttgcataaggacttcccctaatgacctcatcctaacttgattacctctgcaaagaccttttccaaatgaaggccacattcacacataaggaggatcaagactaccacatcttttgggaggacacggttcaacctgtaacatctgcttctatttattcagagtactctatgccatgtgatttgagaagtaaagcaggccttctgcagaaaaattagtgattttatatgtattgcctttagaacgtctaaatcctgttaccgtgcaatatttggagaccctacttgctgtcatacttcatctccctctctctagacattttagagaagtagatctcttttaaggcaaaagga

SEQ ID NO: 250894 - DNA, 328 bp, Homo sapiens
ggacaaggtaaacaccgcttcaggaaacaaattcagaatatgggacagcccatttaagtcaggaatgggaggcagggaagtaatgagatattatttttctacatttaaaaagacgaaagagacaaacaacaacaacagcccacagtgcaatgtgaaccttgattgaatcttggtttccaaaaaacaaaaatggtgacaaatgctatttaagggagaatttttttttttttttttctttttatgcgttgtcgagcaggtagaggcttacttgaaatgtgtaaacgttggctttggattaaggcgacagcgatttctaggataattacgt

SEQ ID NO: 250895 - DNA, 666 bp, Homo sapiens
tctctactaaaaatagaaaaattagctgggcatggtggcgcgtgcctatagtcccagctacatgggaggctaaggtgggaggatcacttgagccctggagatcgaggctgcagtaagccaagatcgcatgctactgcactccagcctgggagacagagcgagacgctgtctcaattaaaaaaaaaaaaaagtggagaactggcagtgacctctactgggggccatggcagggaggggagccttctggaagggctgccttggagattggaatggggactcccagggagacctgcgttccatccctgcctgcctcacccctgccacagactctgcacaccactggatggtgggtccaagcctggcacagtccctgtgcttgtcagagtcattattatgattaatatcaattacgatgccaaaaattgctgggcaaactttgaagacctcaacttgttacaatgacgatgatgatgattcttggcggttacacaatccttcctcctgggggggaggcagctaggaggcccagcaggggggcttctatgctgctgggctcccctagggagttggggtagtctgtgccaactccaggcagctgctgtggcctcacccctgggccccccaattttgggtcatccatcctcaaatacactatttttgcttgta

SEQ ID NO: 250896 - DNA, 445 bp, Homo sapiens
cccaacgtttaaggcaccggatcttgagaagcaaatctagtgcccagcttcaaatccccgccttggaaaagtacaaagagaaaactgatttttcaaatcccaaagccctttccttttaagcaacttggaaaaactcagctataaacgctttctcctcttatgctaaaattgaaaacttatagattttagatggaatgaagagaagatatattccttttccctttaaatagccacatttcaaattgtgccaggcagcaatttctgcgaaaaaggagtggcggttgggattgtttgggagatggagttttatttgttcccatttattttgttttatttttgttttatttttttctttgagtttctttgttattttgagattcatctaagagactcagaattccactctgaataaagcactttttgttgtttcaaaatttcaaactga

SEQ ID NO: 250897 - DNA, 604 bp, Homo sapiens
agccccgggctgcaggaattcggcacgagcggcacgagagaaaatctgagtaagtatggacgtcagttaataatgtatcaatattagttcattaattgtgacaaactatcatagagtaacgtaagatgttaacagtagaggtgttgtgtacccctgtggtagaaagattgaagggtcttatgtacccctattgggtgtggggtatataggaactctttaaaaaagagtttgatctaccatggtagagaatttattctttccatagaaatgatggaattcttagatgaagaagcattcgaagagaagtcaaccaaaacatataggaagaagaaagtatcatagatgtgtatcaggaagttaattgataaatattctctctgggggaaaaaaaaaagctacttctgcttgcatcttacacaattgcacgtgtacatttttgctggaaaacaatcagaagtcctattttgttacttagaatgttataaagtcatgtactcgagagttgagatataatgaaattaataatttttactgttgttatcaagtacattcttaaatgaaactggctttttttaaaatttattttcaatttttgagtgtgtgg

SEQ ID NO: 250898 - DNA, 312 bp, Homo sapiens
ccaagagaaagataaatttccttggaaaacttagagtaatcatacccattatcattatggctttaaaatttaaataaaaattctaactttcagtggtgcctgagtgtataataagaacagtgtctgttggtttccagtactgttttataaagaaacagggcagtgagtcatattgactgatagatttcttggctaagtatctccttactagcaagagcatggactgtctgcccctcctgctgcttctgagcatatgcttcttgggaaatagaattggtaattgcttgcaatacaaactaaaacaaaaaacaa

SEQ ID NO: 250899 - DNA, 424 bp, Homo sapiens
tgccatttttccttcattttcatattttgttcccttcccaaattataaagcgccttttcatgccacacctgggtaaattgaaatctaaagtgggagcctgatgagcccttgaggattaatggttcaatttccctgcaaatctgcatgtgcttttgaactaaggaaaaagaacacagggcaatgtaaccctccgtagggcttcgctagcacatttcagttttctacagttaccgccagctcttaggacagtcatcacatttgacacctgactctagaacaaccaaagtgcaggttttttgtaggttatggctcatgcaagttagtgtgaggttgggagtttttcttttttcttttttttttggcataagaatagcgctgtattttcctacaggtaatttttctattgcttcaacattttctcttc

SEQ ID NO: 250900 - DNA, 411 bp, Homo sapiens
aactcggagtctgatgtttgagggcaggaagcctctagcacggggaaaagatgaaggctggaagactcggcaagtcaaatccttccacgttcttctgcctgctttattctagcggcaatggcaactgatcagttggtgcctacacagattgagactgggtctgtctctcccagtccactgactcaaatgttaatctttggcagcactctcacagacacacccaggaacaatattttgcattcttcaatccaatcgagttgatactcaatatgaaccatcacaggggatattgcagccaattccatagatgcttctctgatctactgtttttctctgagtcccttcagcctttgcttaaatgaatgtaggaggcaaagtgcaatttactatataaaaaagtgtgaaataaga

SEQ ID NO: 250901 - DNA, 353 bp, Homo sapiens
tatcctctcccacctcctgctctttcctccagttgtgtgcctcgtaacctcttcctccctccaaggctaaatcaaaccctacctccttatacaggaggaagtaatttctgggttgatgtatgcatccggcagattcatgctgagccaacaggttaggggctggagaaacagtgatgagcttaaccaggccctgccagcctgcccaccccgagtctggtgagggtagcaaaaaacataaagtggaattgataaataatataatctatccatatccatatttttattttttattttttgggacgaagtcttgctctgtcacccaggctggagtgcagtggtgtgatctcagctca

SEQ ID NO: 250902 - DNA, 398 bp, Homo sapiens
ctggagtgcactggtgcaatcatggctcactgcagcctccacctgttggctcaggccaggcactaattttaatgatagaaaccaaatggaatgatgctgggtcatttactacttagggtcagtttttctggcaggtcagatatttggagttggtgtttcccttttcttccctgccttctggccatttaactgctaattcagacctccacctggggaagtgaaaaagaaaagtggttccctgctcattgtcatagttctggtttaaaagttttatagaatgaaatacttgcccaacatgagaggtttagaatgttctggtaaaccacagtgttaataagtggaagctaatggaaatagctaacaggttttctacacgtagaatccccttgtgtagatga

SEQ ID NO: 250903 - DNA, 257 bp, Homo sapiens
ctcccggatcccccgggctgcatgtgggtgtgcagttgagaagacagcctcttgaatgatgtgaacagtgatggctttctctgagagtaagacaagaaagctttgtaaatggcgttgaatttcctgctcttggcaggccctgctcagcacagaagaaaagactgatcaagttgtccaagatggagccctttatccacgttagtccacttatctctttaagattaaaggaaagcaatcattaaaaatacagatccagt

SEQ ID NO: 250904 - DNA, 190 bp, Homo sapiens
tcaagccctgctagaagggcactactctcatccactaggactccaacctcacagcttcatcacctcttaaaagccccacctcttcatactatcagttgattattaaattccaacatctgaatgttggaggacacatccagaccgtagcatccctcaaaaaaagaataaagatgttccatagcacccatca

SEQ ID NO: 250905 - DNA, 619 bp, Homo sapiens
tttcaataaggttaatctgttccttactcaaattcaacatttgctaagcaccaactgtattcagggaacaatgccagaaatgggaggtcgggatagcggggtggttctcataacccctgttccctgccaaggcatcaagcaaacagccccacttgtgtttggggtagctgtatgtagccaggtagggagagtgaataccccttgcccacctttccatttccagttgttctattgaggttcttgaagactaagaagtcaagtacagtactgtaaatctgagggcccaacaatgggagaagagaagtgatacacctatctcatcaaggcttttgtggaagcaccgcctcttttggagaaggctgacagtcagatatgggcagaaatggtcttagtcaggatcagtgtatgcccagtcaacctggatgtgaatgttgggcattgatttcttctgagaaaacatcacggggctctgtgctacacacttagtaggcaattgtggatttttttatactgccctagtggctcttgagccccacaacccccactccaccagctttcttgagaccaggagaatgtgatagaaaaggtaagatggcaattagaaggctccaattccaag

SEQ ID NO: 250906 - DNA, 517 bp, Homo sapiens
tctctctctaaacctgtgggaaagacatcagcaaggaacaaagattataaatccatttttatgtcttccaaattatgttttgattgtgtagttatttttcctctatagatgcaaacgtttttaagttatccacatagacattttttaactgtacggtttaatggtttttagtatattcaatatacagataggagcactatcaccacagttatagaactttttcattgccccaaaagaaaccccatacattgtagctattcctatgctaataataatagtaatactgatattggatgatcccaaccctaatctgttttctgtttctgtagatttccctgttctggacatctcatatgaatgaaattatataatgtatggtcgttcatgactggcttttattcacttagcataatgtttttaaggttcatccatattgtagcatgtacctttttttattccttctgtgtatgcatttttatttgagcaaatatacaagtgaataattcgtaaaaaaaaa

SEQ ID NO: 250907 - DNA, 245 bp, Homo sapiens
caatgtttattatcagtcttccccactgaagtttgtttacttatgagaacagggctctctttccggtagatcataaagcaattcccggaagggcctcgggtgggaggatgtgctcaggtacagaagatatctcacaatgttgacctattaagaaaatgggtggtcctagactctgggctggtgagcatttttcttctgccttctagcaatttcttataaatggcaaagtcttgttttaaaaatct

SEQ ID NO: 250908 - DNA, 1145 bp, Homo sapiens
ctgcccgcctccacctctcctggtgacaggtatctggatggtctggtctctcggacagaggcagtccctagttctgaagtggcgtgttgttcttacctggctcccgtcccaccccacacctctctctctcatcttctactgttaacaagaaaattgggcagcagctcactttctgggacccagatgactggcttaagcaggaagggctgtgtgcatgaggcagccggggtggttctggaaggctactgaaaggtgaacaggagcagcccttccatgcccacgtctgttgaagccactggctcgatagagcagctggagctcccttagaagggcaatgctgggagacacctccagtcttcacttacccacttggcaaaggcatcataaagccccacctttgtcctgctcatgggcatgacttagcagatctgtcctcagccccttgggctctagtgccttctcctgtatcctgcctgggactcccatgcggccatgctgcactctgtgttctcagacataagcagaacctctgggaggaagggagaggcggtgggcagctgtgagccccgtcaagtgtcctggcccagttttgctccgggaggcctgagattaaagttcagtcgtgcaggttctgcaccacacagggttccacgactaaagggcactgtccatgctgtggacattgaagatttgaacattttcatcaccaggcttaggcagcatacacccctcccccagacctccctggtaggcaggactccagaagaagcacaacatcaccatgaccacagaatcttcacgtctcatgcagatctcctgccctccacatggcatctgagtgaccgttttaaaatgcatgatgaggccgggctggtggctcacgcctgtaatcccagcactttgggaggccaaggcaggcggatcacttgaggccaggagttcgagaccagcctggccaacatggtgaaaccccgtctctactaaaaatacaaaaattagccgggtgtgatagcaccctcctgtaatcccagctattcaggaggctgagaccagagaatcgcttgaacccgagaggtggaggttgcagtgagccaagattgtgccactgcactccagcctgggtgacagagtcagactctgtctca

SEQ ID NO: 250909 - DNA, 431 bp, Homo sapiens
ctttgactccccactttttagggtaagaaattagtaaccgctgccattttacctccccctttgttttttctttaataatgtcttctctctttttcagtttagaatgcctatccatttgatatagaagtacctggctgaggccgggcacagtggctcacgcctgtaatcccagcactttgggagtccgaggcaggcagatcacaaggtcaggagatcgagaccatcctggctaacatggtgaaaccccgtctctactaaaaatacaaaaaattagctgggcatggtggcaggcgcctgtagtcccagctactcgggaggctgaggtgagagaatggcatgaacctgggaggtggagcttgcagtgagccaagatcgcgccactgcactccggcagaggcgacagtgcgagactccgtctcaaaaaaaaaaaa

SEQ ID NO: 250910 - DNA, 747 bp, Homo sapiens
tgatcttgaaagagtttctaattttagtgtaattaaaataaaaatttttaatagcttcacctattgccacataatattaattaggcctccaaagacaagaaaagctcctctatgaaccacttttacgggaatctctgtgccctcttagagtttcaagtctgcgacttgaaagatttaaactacaaaattctgtgtgtatgtgtgtgtctctctctctgtctctctttctctctctatgtgtgtgtgtctgtctctcacacagacacacacacagacacaaacacacacacacacacacgtaattttctcccaaaaaatttacacccaaattaatggcgtgttcctttttgacaaagactttggctaaaccctcttgtaaaacattctaaaatggctagtgatatctacctactgacaaggagtcagtgtaatcaataacccaatcaaacactcaaaatgcttaactataatcttaggatttttaaatatcctgatcattttcacttggtacttcatattgaatgaatatcaccaagatccaacttgataggctgggcgcagtggctcacgcctgtaaatcacacctcccaaagtgctgcaattacaggaatgagccaccacgcctggcctgagatcatacacatttttgaaattcagctactaggtgagataccacagggatataggaagaggctatgttattagctttactggggataaatgttactggacagttattatgagggt

SEQ ID NO: 250911 - DNA, 574 bp, Homo sapiens
tgcctcaggttattcaaataacatcttcaccattgatcaaatgctcaagaaaaagcagacttgtacagtggccgatgcaactgctattaaacaacatgtgaagagagctactgatacctataatttaggaattgcccttgaacaccgaaaagagatgctaaacctctggcagaagatccgaggggatttgattgggatggactctagaaatgagtccttttatgacaccttttctacttatacatggtcctggaatgtttgccaagaattactttctcctaaggacttaaggttatatgatgcctatgtgaatagaaattcctcccataactccagatcctcttcctcatcagataccagtgaatgttacacagactcaggaagaaaaagaaaacggaaaggtttaaagggatttcaacaatgaaatttctacattttctaaacagctcatcacaaactactttttcatagttatcaaaattattgtttcttgcttttgtctaagtacattcttagaagctggaaattttgacatcttttggattctgaccagtaaaaaagtttaagtcataaa

SEQ ID NO: 250912 - DNA, 581 bp, Homo sapiens
ggagggatggaagtcagcggtgggtctgcgaaagcgcaaacaggagtggtggacagcaagcgaaagctcacctcgagccgtaaggaacacggaacaaaagagagtgcagttgcaagatttaatagagtgaagacagagctcccatacaaaaagagaggacccaaagaggtcatcagttagatgaatatgtatttgaaagctgttcattcattgtggagatgtgggaagacagcagtaaatatgccccatggcactgattaactcaaagtggctccaggccaaagattttatgcttcagtggagacatttttgccaggaaccatgtttaccagagatgtttcccaagatggacaacagactgaccatgttgattcagaactaagtactaataaaaaggagtttaataagaagtctaatagaaatcaaattgtatttatcaactttaattctattttaatgcacgagtcctaacagccaaacgactaatatgctgacatttcttaattcattttttctgactgtgctcccaaaaggtgtgtgaaaatgcagtttataaattaaaaccttatacatgtttatat

SEQ ID NO: 250913 - DNA, 501 bp, Homo sapiens
aatatttaatactatttggagactgatatattttcctcttatctagagtaaaataaattataagaagtgatgaaaacaaccatttaattagacttaagtaagtttgaaaagcaactctgtgaatttaagtgtttttaataatttcataggtgtctcattctataaactcaatggctattgagttaatcttcaagttattttcctacgggcccttttaagagaaggttggaaagaatgaaccatgtttaccagagatgtttcccaagatggacaacagactgaccatgttgattcagaactaagtactaataaaaaggagtttaataagaagtctaatagaaatcaaattgtatttatcaactttaattctattttaatgcacgagtcctaacagccaaacgactaatatgctgacatttcttaattcattttttctgactgtgctcccaaaaggtgtgtgaaaatgcagtttataaattaaaaccttatacatgtttatat

SEQ ID NO: 250914 - DNA, 2636 bp, Homo sapiens
  misc_feature (1558)..(1558): n is a, c, g, or t
aggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccggtcagtatggaagcctggcctggtgggaagggccaggctttcaagtcaaggctgagcttgactcccgtctccaccatttgcggatcatgtgaccttgagtgagttgtataacctcttggagcctcagtgtcttcagagttatgagaattaaatgtattagcctatgtgagagctctcagtgcagggttctgtaaatgcaagttttcctcctattccacactgccagggcagagaggcacagaagcccaaaccttggtgccaagtccactcattcacatcaactcactggctggatcatccctatacctgtgccccagcttatcccttagcactttctagcgggttctccttctccaaagggatctagggcttctgctgacctctcaaggagcactgtgtttttgtgcacaaatgaagatattgtgattttgagtaggaagagtatgaacaattcagagtaggtatgcctttattggcagcctgttttcttctacaagtcccaagttagggatctggatatttcctcatttttattatagtggaattgcctagagaaacttatagaatgttctctgtggacttgtgcctatctatggaatgatgcacatatttgcaatttacagatcactgcagatattttaaccagaaatcaggaaagctggattttactcccagctccaccttgggccagctgtgtaaaaccttgcacaggtcccttccccacttgagacttcagtttcttcacctgtagaattaccggcttggagtttgtgacctgtaagaattctgtgaggtagtaaggcaaatattctaacccccactttacaaatgaagaaatagggcaaaggaaggctcaagtacttgcccaaaaccatgtggatagaactggaaacagaacccagcctccgcagtatctgctgcagtatctgctacagtatctgctctggtgtgactatacagtgttattacatcatgcgtgcacttgcagaaacacactaagactgtgaaagaggtagtgaaagaaacaggaagcaacagagagaaacaaggatgtaaagaacctaagcagctgtgactgccattcccaggagctatcgnccagggtgagtgcaatgtgggaatgagactccgccctctccatctgctcagttcccatgcccctctcattgggcacacctgtcgctccactaatgaaatccaggctttaaggctctgtcattttgacttgtgactttcccatagagtgataagagtatggacttcagagtcacagacgggttcaaaccttggctctgacacatgcaagctatgtaactttgtctgtcatttcacccttctgagcctcaatgttattatgcacaaaataggaatcatataagtacctaacctcctaaagttaaatgaaacaatgcttggaaatccttagctccaggcacagagtataaaaggtgatcaataaattatagttttaatagtcatcattgtcatgattatttttattatatctagatattgacaggcttggtgtaaagttaccttggtggtaggccaggtctcttgttcctgttcctgagccttcacctgtaccagaaccaggcaaaggaggctcagcacagccccaggccatccttatttccaagttcttctcagcaaggtctttcattgagagtgcttgcctaagggcacaatgctccttctgcctctcagatgagacacaaggcccttgctatggtgtaaatgcttaggcccccctagaattcatatgctgacatcctaacccccaaggtgatggtattaggaggtggggccttgggaggcaattaggtcagacaacagagccctcatgaatgggattagtgcctttataaaagagacccacagaatcaccacactgaagccttctcagtggaaagagctaagaagcacaggaaacacagaggccgaggtgggcggatcgcctgaggtgaggagttcaagaccagcctgaccaacatggagaaaccctgtctctactaaaaatacaaaattagatgggcgtggtggcgcatgcctgtaatcccagctactcaggaggctgaggcagaagaatcggttgaacctgggaggcggaggttgcagtgagccaagatcacgccattgcactccagcctgggcaacaagtgtgaaactccatctc

SEQ ID NO: 250915 - DNA, 751 bp, Homo sapiens
aggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgggcacttggcagctgtttgtacattgtgacacccctccacgcacacatctgccccccagccacagaagcttggaccagaggtggacacctgagctgactgcagcaggggcaatcagatgttctctcttgggaagttgaaataggacccaagagattctacttttgcctggacccatctcctgaaaagataaaaatccaagtgcaatggattgctgctcttctactttccatgtggaccaaaaagtagaacaatcctatgtgcagaaagagaatgattgagaagtggaaaaa

SEQ ID NO: 250916 - DNA, 334 bp, Homo sapiens
gtgttatcttcaatgtagaagtattaataggtggggcccttaagaggtgattggatcatgagggctctgtgttcgtgaatggattaatccattcatagattaatgagtgaatggattatgtgttatcatgggattaggcctgctggctttataagaagaggaagagaaacccaagctagcatgcttaaccccctggtcacgtaatgccctgcaccaccttaggactctgcagaaagtttccaccagcaaaaagtgttcatcagatgtggccatttgaccttggatttctcagtgtccataattatgagaaataaattgcttttcttataaagta

SEQ ID NO: 250917 - DNA, 370 bp, Homo sapiens
tcaaatcttcttagctacttttgcaatttctgggcaggtgattgcagaacttctttctgggggaatttatgatagcgtcaggagacagccaaggatccctggtgaaaccctgccttcaagcctaaaacagcctgaaggctgaaaaactggactgctcgtcctagatgaagcccaccctttcctgactaattctctctgaacaatgcccacctgtgcactgggaggatggggtggagcctcaggaagttcatgccattcacagcgggaggaggctgacctcttcagttcctgggtggtgacctggaattcaatctgtgagatggaaaacctactagcaagactctctctagctttgctgagagttattttt

SEQ ID NO: 250918 - DNA, 362 bp, Homo sapiens
cacccatgctggagtgtagtggcacaatcatggttcactgcagcctcaacctcctgggctaaagcagtcctcccacctcagcctcttaggtagctgggaccacaggtacaagccactacacatggctaatttttttttttattttttctagagatggggtctcacaatgttgcccagactggtctgaaattcctggactcaagtgatctgcccaccttggcctcctaaaatgctggaattataggcatgagtctccatcctggctgcactacagtaaagtttagtcttcaacctcagtcgaacccttagtgataactggtagttatttcacatgctccacatcagcaacctttttccttaat

SEQ ID NO: 250919 - DNA, 402 bp, Homo sapiens
agcagggcttaagaactgtcagtagctgacaacatttcagcctgattagctcctggggtgaggagatggggatatgttcatatgctgctctgtgcttccttgtgaactggcaacatctcaagatgtttctgatgctggagaatccctcaaagtgagacagaactgaaagccctggtcccaagatgagccagagatggggtctcacaatgttgcccagactggtctgaaattcctggactcaagtgatctgcccaccttggcctcctaaaatgctggaattataggcatgagtctccatcctggctgcactacagtaaagtttagtcttcaacctcagtcgaacccttagtgataactggtagttatttcacatgctccacatcagcaacctttttccttaat

SEQ ID NO: 250920 - DNA, 851 bp, Homo sapiens
  misc_feature (40)..(41): n is a, c, g, or t
tttttctactgtcgagcgtattcacccttccctatgggtnngtttttatttacctctacatggctgacttggaaaattacgtcattagtggcattgctaccttctctttgaggcactggtacaacacacctgtgctgctttgcctttgtagctgttgaattcatggtaattttatgtataggtagaagtaaagactggtattaaaatactgaactgctttgagaacagcttggtaaataccagctgctctgagcttccctacctcctagtgtgtccatgtatagggcccttcggatttcctgcagttagcaatgaaagagttaatcactggtaccttggggttgaagggcttccaggaccatccagctttatggattgtgccaatgcctgtgctggtgcctgtgtggatgttattattccctgggttcaaaatctattcataatatcatctagtgtagttgtggtgaaatagttacatacagaaatacatattattttattaaaattacttcttaggtctcctttatgttacatttagggcatctattgtagggtatgtctcgatatgtgtctaataggttataacattcatttcatttaaaaatagagaacagctgcttcaaactgaatcagtaaaaataggggatgttgagtttgagagttgggaactactgactggtaaatcagtcggggtcccactgtttttgtcctttatcttgcttcaaattgaaatcattatctattgctattataaattaaatatatagctggcatcatctgagtagtagaaatgaaagcgtcagtaatttgtgttgtttttaatagagtttctccttttggaatagggtgtt

SEQ ID NO: 250921 - DNA, 574 bp, Homo sapiens
tgtcgcccacacccacgcctgcaccaagacaaatcgcacggggctaggctctcccgagaaggcctttgcagaccgctgctggcctcccagcaagtgctgcatctctgcgagccactaagcatgcagggagtccctgaagagacagctttgaaatgggatcattttcttcctggaagcaaaagggtgtttcctcaagacactatttctccattaaagtatgagaaattccatctctgaagctcccagtggggccagacatcgggttggggtggggacgggacgttgataagagtcaaatctagaacactgtgctcttaccccctcatttcacctggtgtctctgggcctggcttctgggagctatttgtgatgtgtggtatgagtgcatgtgctggaaagtattcttgtatgagttcaaatttatgtgctcaccttgccccttggggtattactggccttcaagtttgatgcttttggaagctgagttctctcccgtcctttcaatcaaactcaacccttgctgcagtaatctgtctttaacaactcccactgcaagtcaataaaatgtcaattt

SEQ ID NO: 250922 - DNA, 430 bp, Homo sapiens
tcttcatggacttggagtctgctctgcactttctctctctctgtctctctctgtctctttctctctctcttccaccctccctccctctccttccttcccagacatacctgagcctatggttcccatgattcatatttgcaaagaaaattctactgtagtctcaggcctaagacgaattctccatctcaaaatactgaaaatcctttattcagggagttgtgcagatttttaataaatcaatgcttaatgtctctcatttggctggtgatcttttgctggatgcagcatcagtttgaatgctggagggatcaggggtaaccagcatttagaattcctaagactcttcttgggaggctgaggcaagaggactccttgagcccgggattgcaagaccagcctgagtaacatggcaagaccccatctcagaaaa

SEQ ID NO: 250923 - DNA, 505 bp, Homo sapiens
ctcctggtgcgggggttcgcagtaataagcgaggggaaacttggaaggcactgtggaaagtataacatcacttttaaggggggaaacgggagagggtttgtaaactatattctagctgttcaattctatgatattcattttaattacctgttcacaagatattcctaaaccttttctcaacaatttatgcttaagcacgtcggggagaggggtcagggagtgcatcacagagcaggataaatctttttctctccttgggatagtgtggagaattgtcagctttccatcaagggataattggttagttataaagctatggttatacttcccgatttccgcaggtgtcgtggctgactgcagcacctccgtctttcctctctgctaggtatttggaaagcagatcctcatattttgaaagaatgttgtgtaaatgaagagcaaacagcccgaaactgagttctgaaggctcacctgtgaaataaatgcatgaattttagtgcaaaca

SEQ ID NO: 250924 - DNA, 684 bp, Homo sapiens
ataccatttctgtataaagttcaaaaagacataccatatattggttaaatgtggtaggccaggcatggtgctcacacctataatcccagcatattgggagactgaagcgggccaattgcttgagcccaggagttcaagaccagcctgggcatcacagcaaaacccatctctacaaatattacaaatcaaaaagtaaattaaaaaaattcatcaagctatacactttatgtttagtttattgcatactttaaacatgtatcatttattgtacaaataaagctattaaacacaaaagccaggaagaggttgaagccatactcttttcccagcctgcccagtcagataagtccgtcttccttccagtccccagattctccctaccccacacacagtccccttctcccttaggaggtacattttatttcttccagtctagtaataggacgtccccccaccaaaaacataaaacaaaaagttttatgaattacttgccgtacactgttgagtgaattcagtttttggttttttttttttttgagacagggtctcgctgtgtcacccaggctggaatgcagtggcacagtcatggctcactgcagacttggcctctctgggctcaaacagtcctcccacctcaggctcctgagtagctgggattacaggtgtgcgccacaacacctgttt

SEQ ID NO: 250925 - DNA, 420 bp, Homo sapiens
tcaggcaaaaattaataatgaatctttatttgaagccttctattgtggatggatggatttagcaaaaatagttgttggaatgaagagggagaaagcagttaaaatattatttggagaaataaacaagaaaggtaaaataggaaaggatagatgaaaagctcttcatcagaggccttaaacaagtttcacttccattctaatctgtgctgctgttgttttgcttttttctttttaagggacttttccttgtcgaaaatatgttgcactattctttggattcctaacccattgctgaagtcagatgacaacacatttgcagttcctggcaccccaatcccctgctgtcaggattgtaaatgatgccacttttcaacaagcagcgatccagtaaggggattagaggcatgaattttaactgac

SEQ ID NO: 250926 - DNA, 420 bp, Homo sapiens
atatatattgatgaatttccagccttgtttcatattctgttgttcccggcagcagatttattttttatagttgtaaaccgccaagtcattttttggtgctgtcttttgttttataaagtcttccctataaagacaaactacagagcattatcaagattttctgttaaattgtaaagttctttagacttaaatttaaattaagatatattctttaagtacaaatgatatttttaaatttatctaagggcctggtggagtatgaagacaaaaagaaagaaaactcttaaagagggtcaccttcactgatattggcaaatccttgtgttttctgtctgaaagatgattcatgaatgttttgcatcactttcctttagagaaagagtgcattcttaaagcataaacaatacctattacaaagca

SEQ ID NO: 250927 - DNA, 313 bp, Homo sapiens
tttttttttgtagagacatgagtctcgctatgctgcccaggctggtctcaaactcctggactcaagcaatcctcctgcctcagcctcccaaagtgctgggattacaattgtgagcaccacacactgccatattcctgttttacagatgagccactgaggggttaaagggctcccccacattccacaaggtcatgtacagcagagctgagatgtgaatataagtagcctggcttcaggtccctctcctcaactacaaacaatggggatctctcctggcccttggtgggcatgttaggcatgcatggggttcctg

SEQ ID NO: 250928 - DNA, 492 bp, Homo sapiens
aagtctactcaccttccgacacatgatctgatctgtctggcagtcgtttcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagttggttaacaaagataagatactacactggttgaattactttcaaaagctttggaaagtaaaagagaagcaacttctgtgggtctaggtctaacagttatgttcttccccctcttaagttttaatccaggtgctggtttgccaactgacaaaaagaaaggtgggccatctccaggggatgtagaagcaatcaagaatgctatagcaaatgcttcaactctgg

SEQ ID NO: 250929 - DNA, 435 bp, Homo sapiens
gtttatgaaacaatgccgaattgtgatattttaataaagctcacatcataattcccccaaataaaaagttaatcaacttaaaattcttctatgacctcgacccatgtcctacatgatgaggagagagactcatgttctcagtcacttacatatcgttcagtcttctgcattttctaaatttctggtctacagtgttaaccatttactggtagagccatgtaaataattgaattggattcaggccgtatgcttatatgatactttctactggaataggacatattcacttaaagaaggtctgatagtaaatacttatgatctgtcttctgcttgctgtacctatactgccctcaccaagaggggagcagccatgctgtctcagatggtaatggtgtgctgcttatttactctccttataagttcgcatgctttcac

SEQ ID NO: 250930 - DNA, 773 bp, Homo sapiens
agtatagagctatgttacattgaatggcaaaagtgactttgtagaggtgtcgtttatccggatgctgcatgattaagaccaccatactcttatcaagcatacaggtgttaatgtctattttaaagaggagagaactcaagaagttctgtagaaactgctttcttcatcatatctcaaaggatttgctgaggatttcagaggtgccacgagttgagagaagacttcggacatttcacttaatgctgaaaattcactctactgccactactcaggacttctgatgggcatgaaaatccaagcctgctttatgatattaacctctgaatttcataaaccgcttaaaactttagaatgtccagaaaacactggtagaatacggacacatgagacaaggccagaaaggaagtcaataaaatgtgattactaagcaaattaccaccagagaagcagaaggaaatccctcttcaatattttgagagacagtaaagaacattccctggagttaggacaaatgaagagcaagaagtttcatcttgctctgtcatccaggctggagtgcaggggcaccatctcggctcactgaaacctccacttcccgggttcaagcgattctcctgcctcagcctcctgagtaactggggttacagagtgaatagacaacctacagaatgggagaaaatacttgcaagctatgtatccaacaaaggactaatatcgagaatttacaaggaactcaaacaaaactcaacaagagtaaaacaaccccaataaaa

SEQ ID NO: 250931 - DNA, 696 bp, Homo sapiens
atcaaagtacttctccaaccagaggacttccattgatcaatagccactcagatgttctgtgtttgccatgagtatcggacttcagtcttctggaaagatggctgtggtgcctaaacacatctgtgcctggcctcacccgcgggacttcggacatttcacttaatgctgaaaattcactctactgccactactcaggacttctgatgggcatgaaaatccaagcctgctttatgatattaacctctgaatttcataaaccgcttaaaactttagaatgtccagaaaacactggtagaatacggacacatgagacaaggccagaaaggaagtcaataaaatgtgattactaagcaaattaccaccagagaagcagaaggaaatccctcttcaatattttgagagacagtaaagaacattccctggagttaggacaaatgaagagcaagaagtttcatcttgctctgtcatccaggctggagtgcaggggcaccatctcggctcactgaaacctccacttcccgggttcaagcgattctcctgcctcagcctcctgagtaactggggttacagagtgaatagacaacctacagaatgggagaaaatacttgcaagctatgtatccaacaaaggactaatatcgagaatttacaaggaactcaaacaaaactcaacaagagtaaaacaaccccaataaaa

SEQ ID NO: 250932 - DNA, 511 bp, Homo sapiens
agtatagagctatgttacattgaatggcaaaagtgactttgtagaggtgtcgtttatccggatgctgcatgattaagaccaccatactcttatcaagcatacaggtgttaatgtctattttaaagaggagagaactcaagaagttctgtagaaactgctttcttcatcatatctcaaaggatttgctgaggatttcagaggtgccacgagttgagagaagtgagccaaaaaaactcatctgaagtgtttggacagatgaaatcaatggctgctgattaaatgagaggcacacagcaagtacactgtaaaataattaaatagtaattgaaaatacctgcagaaagtttgattagcatctgaggaactaacaaaagtagccagataataacaaatgcatttccaaagcctgtttaattctatcaatgtaccttagtaaatatgtagttagtctcattaaacgaattaatgtaaatgcattaaacttttcacagtaaaagtagtgttttggaaa

SEQ ID NO: 250933 - DNA, 228 bp, Homo sapiens
ctaaaaataggaggcacaggaaagcaggataacctataattggaggaaaacctgtctgggagatcaagaaggcattcccatacattgtcgtgacaaccttttttggaaggcaatactgaagtgtattaaatgacacagctccttcgacctagctgttccactttaggaataaaagtaatatagcaataaaagtaatactacttaaagcagcatgtggctttggctccc

SEQ ID NO: 250934 - DNA, 262 bp, Homo sapiens
aaacaaaacaacaacaaacccaccaccatattaaaggaatagccaaatttccagcttctgtgccaacagtgacaggtttactagaatagatgagcataacctggtgtgttgtgtgtgactgttgatctggcaaaagcatcctttccgccaccatcaggaaggaggaacagaggcaggcgcattcgcttggcatggacaacagtatactttcacagtcttgttccaggactgtgttaattttcttctccttgtagtattgttc

SEQ ID NO: 250935 - DNA, 549 bp, Homo sapiens
taccctagagcgtccgatttaacgggtcccttagggaattggcccccaggccaaaatttggacgggccccaacagaccaagcagccttgccagcccccacccaagtgccaggagccctgtgcccccaagtgcccaccccctcagcagtgccagacgtccaagcagaagtaagccctgggcatgtgatcagaggcgaacccccaggaaaaacagagcatgaagttccttctgggccagcatcttacactccacaggccaagcaaagccctgctcaccagtgcttctggatgcagccacacttcacacttgcaggagaggcagcaccaggctggcagctggcggcttcctcgagctctactcttcttaattagcagctgcagtttccatctcagacaaggatctggttctaaactatctaatcatctttcctgacatgcatctacattgccctgctggaaacatgagcggcatgcacaggcatcttctcctaccacgcttcccctcagctcctgttttcaaacaattaaaacagaattcctctggcatgaa

SEQ ID NO: 250936 - DNA, 349 bp, Homo sapiens
tgcagaggcgtgtctgtgtctgtctgtgtaagaacacgtttgaatgctgtacaaggcacatatgtgaacattgtaccacatgtacagctttcaaacatgctcttatattctcccagccctttagggggaatgtctcctacatacatttatgctttgtgccttcctacttatgaaattaacccatcattgtcacacttgctgatatgcacgctgtatgcccatagcatgccagggtctgtatacagtgcaaccttgtagtttcaatgcagtgataacatatccctcacatttgtaatcatgggttattctttgattacaaggattaattccaagattccaagattttcaa

SEQ ID NO: 250937 - DNA, 495 bp, Homo sapiens
aagaaatcttcgaaatgaaaactattcctgtttaatgactaatagactctgtatcttaccttgtatcctaaatacaaaactgttttcacaaggttagatttctgggaaagtgggtcatttaaaatattgccataaatttagaaataagcatgagaaacattttttacagtcctgaaaatgaaatatataagaattactatttgaaacaatggaagtaaaataaattgctgtatatatgtttgatgtgacttggctttgtccccaccaaaatctcatcttgaattagctcccataattcccacatgttgtgggagggacctggtgggaggtaattgaatgatggaggtgggtctttcccatgctgttctcctgatagtgaataagactcatgagatctgatagttctataaagggaagttcccctacacaagctttcttgcctgcggccatgtaaggtgtgcctttgcttctcctttgctttctgccatgactgtg

SEQ ID NO: 250938 - DNA, 498 bp, Homo sapiens
cactagccttggtgacagagccagactctctctctctctctgtctctctctctgtctctctctctctctatatatatatacatatacatacacacacacacacacacaattttatatgtatatataatgtatgatgttgtaaaagttgacttggaggaatgtgttcaatgaaagcatgagagcacatatctcatatatgatttcttatctttattaacacgttgaaaatggtatgttttcatcattatatgaacatggattaaaaatacagatgattgatacatgtcagactgttaacaaatttacaaagggtaaatatagatgttggaagaaattaagagaaagaatgttgcagagagaagagaaaaataggccaggcgcggtggctcacgcctgtaatcccagcactttgggaggctgaggcaggcagatcacgaggtcaggagatcgagaccatcctggctaacgcggtgaaaccctgtctctactaaaaaaaaa

SEQ ID NO: 250939 - DNA, 481 bp, Homo sapiens
caactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcatgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacc

SEQ ID NO: 250940 - DNA, 443 bp, Homo sapiens
catttcagctttagagtcagctacatgaaaattcgaacgaccagcccaggtaaaacagagaagagaggttagcctgggaaaggtgtatcagtttatattctagaaacagaagtctcctgaccttcctgtgcttttggccctggacgtccctccttaccacgactctgggagcgggctcagtcctgcccctgcaggtggccccgggatcgctaggctccacagccactggcttctcccaacctgtctcacctctttcccctgggctggggtgtgggcttgatcagtccctggaggagacagctctgcggccttcgagggtcccagcgacacccactccacaagcgcaggagcgtgctggtcccagtgatgattcgctccctttgttaattactcagtgtttcttgttttaggatttttaactataccctgtaaaagaatcctta

SEQ ID NO: 250941 - DNA, 410 bp, Homo sapiens
actatatgggagtgaatgtatctagtgacatcacccttaaaagattagatgtgtagctgtgaggtaatataagtttagctaaatggtttttatgttctattagtactgccatgccacacttcacaatttgctgtgagaagtacaaccatttctttgcctctttaaatgactacacgtcagaatgtgaagaatgagtacatctcctattttaatgattttattatcttctcttagtcttctgtgaggtttgaagaatcatacacatctttgaactgtcttagctgttgatgatgctgttatcatgggcaacatagttcaactctgagtcttggtttccttatctctgtaatggggacttaaaattgctgtcttgaagtgatgttgtggaaataaaacattgaacaaagaaa

SEQ ID NO: 250942 - DNA, 753 bp, Homo sapiens
cgagctcttccggcttggatgtctacgccggttgtttctctgaattctggcctccctcctgtcactgatacttctttctccatcacttttgtgtgtacctggttaaggacaccctggtagccttgttgagctttataaatggagagacccttcaagtcatccagataattctcttagacagtagcaattgttgagcatcatgtgaggtgtgctaggctggggatggaactctaactaggtgacaccaccttctccagcactgaaaggaaaccagagcctgtgtctggagacttgtatttgacgtagaatactgttcatgataatttgtcaagggaaaagcaaattgcttttgttaaaaaaaaatactcaaaaaataatacttagtcttttaaaaatgtggcacatattcactgtggaatactacgcagccataaaaaagaatgagatcatttcctttggagcaacatggatggacctgtaagggcattagccttagccactaacacaggaacagaaaatcaaataatgcatgttctcacttacaagtgggaactaaatgatgagaacacatggacacagagaggggaatgccacacactggcacctacttgagggtggatggtggaaggagagaagatcagaaaaaatacatatgcatagtacgtggctgatgaaataatctgtacaccaagcctacatgacatgagcttacctatatgacaaacctgcatatgtacccctgaacctaaaata

SEQ ID NO: 250943 - DNA, 567 bp, Homo sapiens
atatatatgactttgttattgtctttatatgatgattaagtgtggttcaaggagatgcatatgggtgccatcttggcaaggagtggacttgtgatggttaatttcatctgtcaacttggctggaccataggatgcccagataattagtcaaacattattctgggtgtttctgtgagggtattttggatgagagtaacatttaaattggtggactttgtgtaaagcagattgccctccgtaatgtgggtgggcctcatttaatcatttgaaggcctgcagagagcaaaaagactgccctccctaatgcaagacagaatttctccatcagcctgcctttggacttcactgagacttttgactcttcctggttctaccacagactgccttcacatgcaaattgggatgctggctctccaaactgctggccttcagactggaacttcagagcatcagctctcctgggtctccagcccaccagccttccctaaagattttgtacttgccagccttcataatcacaggagccaattcctataataaatctctttctctgtgtgtaaaattcta

SEQ ID NO: 250944 - DNA, 589 bp, Homo sapiens
caaggagaggaattgtgagcctgtggatgtgtcagtagaaaccgtgaaactggaatgcagaggggagaaaaggttgaaaaacatctgaacagaacttccaagacctgtgtgacaatcacaaaagatgtaacaacatgtaatgagaatacaaggaagagaaaggagaagaaatattggaaattgtcatggctgagaatttttcaaaattaatgacagatccaggaagcaccaggaacaccaagcagaataaatatcaaaatgtctatacctagacacatacaaagcacaggaaaccaaaaaagaagagaaaatcttgaaaggagccagagggctcctatgctggcaccagtagctgcagaagagcaagggtaataaatagggcttctcttcagaaactgagcgatcaagaagagagtggcataatatatttattgtgttgaaaggaaaaaacaaaaacaaaaaactaccaacctagaattctgtatccagagaaattatccttcaaaagtgaaggagaaagaccttctcagacaaaagttgagggaatgtgtgattagtagacctgccttgcctttccttcatcataaaa

SEQ ID NO: 250945 - DNA, 383 bp, Homo sapiens
ggccgctgcagaagtatttgttaaaacttgtatggtaactttaccttctggtagattctaaactctttctttctgattgcaggagcaagatgtatcaaccagggtcctatgctttgatttggaatgtttgaatatgactcatgtttatttccttcaaggatgaagtgtgtatacctcagtagatcctgtcccccgcctcgcctcctgaaaatgtatgcttaaaaacaaattatgaagttattgctagatatgtggttggagtggccagtgtaaacttagttgttgcttacggcactttctgttctctgtggaacagaagggcggggcaggtggggaactggaagaagcagcttccctttgcttttcctgccaaatttagtaaa

SEQ ID NO: 250946 - DNA, 377 bp, Homo sapiens
tctgactccttttccatagggctgctgtagtatcctaggggtctactccagtccctggttacctcgaattttccagtccctggatgtctcaccagtgaaggtagtgaaacagcaaaaatggcagcctgcaccctcctctgggagctccatcccaagaagatgttggcacttcttaggaaggagccatccatgtctgaagagaagaaatgataattaacttcatcatgtggaaagctttagaaggaagtatcttgtccttctgtccaaacccgcctcctccttaccacccccaataaaaataaaagccaaacaaataaaacacgatcggccgggatttttctcctcaccgacccctccgcgcggcgcgcccgcgcccc

SEQ ID NO: 250947 - DNA, 384 bp, Homo sapiens
tctgactccttttccatagggctgctgtagtatcctaggggtctactccagtccctggttacctcgaattttccagtccctggatgtctcaccagtgaaggtagtgaaacagcaaaaatggcagcctgcaccctcctctgggagctccatcccaagaagatgttggcacttcttaggaaggagccatccatgtctgaagagaagaaatgataattaacttcatcatgtggaaagctttagaaggaagtatcttgtccttctgtccaaacccgcctcctccttaccacccccaataaaaataaaagccaaacaaataaaacagatgcggccggactcccttcccttctattctcttcaattgctctgcccgcggctctcctactc

SEQ ID NO: 250948 - DNA, 378 bp, Homo sapiens
tctgactccttttccatagggctgctgtagtatcctaggggtctactccagtccctggttacctcgaattttccagtccctggatgtctcaccagtgaaggtagtgaaacagcaaaaatggcagcctgcaccctcctctgggagctccatcccaagaagatgttggcacttcttaggaaggagccatccatgtctgaagagaagaaatgataattaacttcatcatgtggaaagctttagaaggaagtatcttgtccttctgtccaaacccgcctcctccttaccacccccaataaaaataaaagccaaacaaataaaacaataaatcagatgggcaagtcttcctctttcttccgactaattacgttgcccaccggg

SEQ ID NO: 250949 - DNA, 574 bp, Homo sapiens
tctgactccttttccatagggctgctgtagtatcctaggggtctactccagtccctggttacctcgaattttccagtccctggatgtctcaccagtgaaggtagtgaaacagcaaaaatggcagcctgcaccctcctctgggagctccatcccaagaagatgttggcacttcttaggaaggagccatccatgtctgaagagaagaaatgataattaacttcatcatgtggaaagctttagaaggaagtatcttgtccttctgtccaaacccgcctcctccttaccacccccaataaaaataaaagccaaacaaataaaacacattagcagtagctctgagtttcttcctttcactttttctctctcttcatgccttttctcctccattccttccttctttcaaatcatttttactagtttaagagaataattcaatctatatttagaaatcagacttaaaacttcaaaaattatactgaaatagcttccccttaaagggtgaaacagtcatgataaaaataacaaccgatgcggccgtcgtccttgctatgtcgcctccaaaaatagactataa

SEQ ID NO: 250950 - DNA, 377 bp, Homo sapiens
  misc_feature (345)..(345): n is a, c, g, or t
tctgactccttttccatagggctgctgtagtatcctaggggtctactccagtccctggttacctcgaattttccagtccctggatgtctcaccagtgaaggtagtgaaacagcaaaaatggcagcctgcaccctcctctgggagctccatcccaagaagatgttggcacttcttaggaaggagccatccatgtctgaagagaagaaatgataattaacttcatcatgtggaaagctttagaaggaagtatcttgtccttctgtccaaacccgcctcctccttaccacccccaataaaaataaaagccaaacaaataaaacatggatgcggccgtttctcctcccnacggaactcacccgccgtgcgcacccccgggc

SEQ ID NO: 250951 - DNA, 371 bp, Homo sapiens
tctgactccttttccatagggctgctgtagtatcctaggggtctactccagtccctggttacctcgaattttccagtccctggatgtctcaccagtgaaggtagtgaaacagcaaaaatggcagcctgcaccctcctctgggagctccatcccaagaagatgttggcacttcttaggaaggagccatccatgtctgaagagaagaaatgataattaacttcatcatgtggaaagctttagaaggaagtatcttgtccttctgtccaaacccgcctcctccttaccacccccaataaaaataaaagccaaacaaataaaacatgcgtcggccgaaaccccctcttttttttttttggcggcggaatagcaac

SEQ ID NO: 250952 - DNA, 395 bp, Homo sapiens
aggggattagctgagggctcgcggggtgcgggggagcctgggaatggtggggttcagtttgggactggcaatccagtgcataaaggacaccctagaagtctcgtgttgcacctcgggggaccctgctggggcccaaaagccaggctgaactctcgaacttctgggctcaagcgattctcttgcctcagcctcctgagtagctgaagctacaggtgtaagttactgtgtttggcttaaccttcaatacttaggaaaggccatgtgaccacacaccaagaagctagctgtctgccagccaggaagagagccctgaccagtaatcaaattggctgaagacttgatcttggactccttgtctccagaaatgtgagaaaataaaaatttctgttaagtca

SEQ ID NO: 250953 - DNA, 781 bp, Homo sapiens
aggggattagctgagggctcgcggggtgcgggggagcctgggaatggtggggttcagtttgggactggcaatccagtgcataaaggacaccctagaagtctcgtgttgcacctcgggggaccctgctggggcccaaaagccaggctgaactctcgaacttctgggctcaagcgattctcttgcctcagcctcctgagtagctgaagctacaggtgtaagttactgtgtttggcttaaccttcaatacttaggaaaggccatgtgaccacacaccaagaagctagctgtctgccagccaggaagagagccctgaccagtaatcaaattggctgaagacttgatcttggactccttgtctccagaaatatgttggcacttcttaggaaggagccatccatgtctgaagagaagaaatgataattaacttcatcatgtggaaagctttagaaggaagtatcttgtccttctgtccaaacccgcctcctccttaccacccccaataaaaataaaagccaaacaaataaaacacattagcagtagctctgagtttcttcctttcactttttctctctcttcatgccttttctcctccattccttccttctttcaaatcatttttactagtttaagagaataattcaatctatatttagaaatcagacttaaaacttcaaaaattatactgaaatagcttccccttaaagggtgaaacagtcatgataaaaataacaaccgatgcggccgtcgtccttgctatgtcgcctccaaaaatagactataa

SEQ ID NO: 250954 - DNA, 542 bp, Homo sapiens
tctttttaagtgaagttcattttcttcatggaataagatagtgtagttcagcaaatattgagtacctgccacatgacaaactgtatgttctttaagaaccgtatgaaattgctgatatttaactgttgtttacttatacaaactgcaacttagtgtgattcaatcttatactttatgttatttaattcttacaataatcccatttttagatagatgttttcatggcttagaaaacatttctgaccaagaatagtttctatacttgtggagacactcatagccaaaaacttggatggtctaggttccctcagccccccgaaataaaccttagtctgtttaagatgtgtaaagaatatgctctaagatgacccctgatgactcctgtgcctcttgatgtttatgacgttttgtaatgccttccccttgagtaaatttcttctaatcatcattgtgggtatgtcacttcttgctagcagactctctcccttgctggctttgatgaagcaaattaccatgttgggaaagtccacacagcaaggaac

SEQ ID NO: 250955 - DNA, 317 bp, Homo sapiens
ttatggaagaaagggggcccagaaaggcaaaagtgcccagggcccatggaagtcataacgtggccctgccctagtcttccctcctgcccactcgaaccctctagactccagagttttccttcccccatatcaaaacgtacctgctatctcatgtccctccactaaccctggagctcctggagggcaagaccattctttatgtatcctctgtgcccacagtcatatcaggtattgcgttaccatttcttctttttgcagggaggggggttggaggtgggatgtatggggtggagcagaaaactcagaaaaaaaaaaaa

SEQ ID NO: 250956 - DNA, 342 bp, Homo sapiens
gaaatttcatggtcccacaatgtcattgccatacagcttcactagagttctttgaaccacagctgaaaagagctttgtattattttttaatcccctccccagatatcatttagaactattataataaaggtggtgggtaataacaacctaaggagcctttctagttaccttaagttgcagctaactctgtggtttcttttttgaggcctaacaaacatactgtattttacattatcaaaatgtagtttacattactcactatgttaatgagtatataaaagattcttttgcattgatgcattttgtatctgccttcattaaaagcaaaacagccctaaaaaa

SEQ ID NO: 250957 - DNA, 288 bp, Homo sapiens
agatgacgagttagtgggtgcagcgcaccagcatggcacatgtatacatatgtaactaacctgcacaatgtgcacatgtaccctaaaacttaaagtataataaaaaaataaataaataaaaaaagaaaaaaaagaaaaaagaaaaatatatatatatatatattcatatactgtagatagaatgtaagtaataagtgatcatgtgaataattagcattatatctcattggtttactttgcgtaatagtaaaatgaatgtaatatttctaatatagactctactattta

SEQ ID NO: 250958 - DNA, 772 bp, Homo sapiens
tcccttgtagggaaaaacaagcctccatgaagcaggacccccaccccatcccgcctggagccatcactgcctggcctcgtgctaacatctctttcttcagaaattccaccagactaaacagaggaagctgccctgtctctaagtctagcctgctgtggctgctgagagtacttgcagcctacatgcatctccaaactggcccccactgctgggatttggagactgttttggcaaaaagtaagaggccagaaagtcaagttatctctaacctctcctccagagagtagaatacccccagtgtagtccccagtgactgcatcctattccatcaaagccgggtatcacagctcacttaacctttccctattgttaagcaatttgctttattccaagttttgctctcataagtaatgctgggataaatatttttggtttattgacttttattgcagttctaatgatgtctttggggagtacaattttgatgtcaaaaggtaaacacattttttaaattcctggtgcattttcccacgtggccttccataagatttgtatctttttacattcccatggcaggggatgctgtctcacagactcttctcagcaagcaaacattatattttctacaaacgtttgttaattttgatgattggaaagtatatcctgttatttttaagtcagtagaattccagcagttttcttcccatcaaataccatttaactttccattttggaaggaaggaagggagggagggagggaggaagggaagga

SEQ ID NO: 250959 - DNA, 710 bp, Homo sapiens
ctcttgccctatcaaagagaatagttttggaggggagaagtgggaccaaaaaagatgcagttttcatttgtattgggaaatgtgaaaataaaattgacaactcttttagttaaaaacaaaaaaaagaaaaggaaacaagatgtggggctgccatatgtaataccgtggattccacggatcttctactctggaggcaaatattatctttgctgaagccagaccaacctgacacaaagaccttttgtttttttaatgtgactgtgttttattttagaatgtgtaattcactttagaagggcaaagtacctgtctggggaagactatttaatttcctgcatttatttagaatgttggctgatgttattatgaagggaaacagctctaacaactgagtgccccccacatagccacagctcatgagttcacggggcaaaggaaatgaacagcagcctcctaatagccagccttctttgtgatgtggaaataattatcagcatgtaaaagactatatatatattcaacaattctgatcccctgaaaaattcaaatctacaactgatttgcttcctgggctcctgaaaacaactttgtcaaaattgttcagaaatataatcagccaatcgttgccccttggggacgcaggataaagcaagtcagccatgaccaatgaggagtcggccgtgcacaattacatgcagacctgcaggaca

SEQ ID NO: 250960 - DNA, 451 bp, Homo sapiens
agggcctgggcttggaaccctgttctggcacccactctctgtgggcccttgggccagcccctcaccctctctctgcctcctttctcttctgtgtacacccaaggctgacttcaggattttgccatcccatatactattttactcctaatttatctataagtggattcaattaacatttacacgtatggggttaaaagagtaacttcatatggccaccagagatgcaaaaccatcattactaggcatacataaagggaaattacagatcattaaattctagtagaaacagttgtcctagacagttctgaagccggggcttgctctctttattagaagcaggagggaagcaagtattagagagatgctaaaaacattagcatccagtgatatttttttcccacctaatcttaaggattgaaacagacattaaagaagatgtattttcttacca

SEQ ID NO: 250961 - DNA, 362 bp, Homo sapiens
tattactcaatgccatttttttggcctaccttatgacagataaaatttttaagaaaccctgtctctactaaaaaaaaaaattagccggtgtgatgttatgtgcctgaagtcctagctactccggaggctgaggcaggagaactgcttgaacccgcaaggtggaggttgcagtgagctgagattgcgtcgctgtgctccagcctggcgacagggcaagactctatctaaaaaaaaaaaaagatttattagctgttgacagaactatagtgaattcttcaccaacttattgagcatcagaatactggtcagcttctaaggtagctttaaaaaacaaggaaccctgatttacagaaaaaaaaaaa

SEQ ID NO: 250962 - DNA, 459 bp, Homo sapiens
aaggtttgcagcatgctggtccaagatatttgccctcagacccattctctggcccttccctactctgtgctatattgggtgaactacatattccagattctcttgtcaactggctgccaaacagctttgggaggtacaggtggaagactgcagggaggggaaaagggaaaagtctaagtggtcctccctctgttactctccctcctacctctgactgggaatttcccacagttctagctcctgccaggcagcccctgccccatcattctagctccctctgggcagcccaggttcttgggctctaacatctcttcctgccgttgctccatccctaggggtggcagtgacctccagctgttactaatcttagtagcctcactgctccatttggtttctcaggaactccttcaggggtgtaaccagagactcagtattaaattccctacactgaaagactta

SEQ ID NO: 250963 - DNA, 249 bp, Homo sapiens
gcttcttctgttcatttctgggactcgtgtgggtcaacctccatgcatctgtaaggtggtctaatgcatccctaattctcgggggacctgtcagtgacttgcagtagcatctaatgcttattttacaaaattggcccagcctcgaccttgggtctacacgctatttacgtctctatctatatttcgtgttttttttcttttgttatgtccttgttcagatcaggatgtgccaaatatttttaaatgaac

SEQ ID NO: 250964 - DNA, 404 bp, Homo sapiens
ttagtttaatatttttagaattttattttatccattggccttctaaagcaaaaatatatttaccttttggagggagaagtgtttatatgtagattacaaattacttcctgaggccgggcatggtggctcacgcctgtaatcccagcactttgggaggccaaggtgggcagatcacctgaggtcaggatttcgagaccagcctggccaatatggtgaaaccgtgtctctactaaaaatacaaaaattagctgggtgtcgtggcgcacacctgtaatcccagctgcttgggaggctgaggcaggagaatcacttgaacctgtgaggcggaggctgcagtgagccaagatcgtgcctctgcactccagcctaggtgacaagagcgaaactctgtctcaaaaaaaaaa

SEQ ID NO: 250965 - DNA, 399 bp, Homo sapiens
gtcacgccccctgtggctggcgggtttccatggagaccacaggcggtccaggcccttgggcggggcgacgggagcctgtggtccaccaaggctcgagaatcctcagccccgggctgcccgcgcccggtccaggtgggcaaaggcctgacgagcatacttgggcggcagagccaggccgaggaaagagatttacaaaaaaggaaaaaacgatgggattcgatgaaagcttgtttccgatgggcgggttggtgggatgatggtggtgataatgatagcatcaatcatggatcgctccacatgtgacagacacggttctgagcttaaacagttcgatgtggcagggccctgttgtgccaattatgcagatcatagcaataaaaataattgttgaaggtccgc

SEQ ID NO: 250966 - DNA, 462 bp, Homo sapiens
tttgtagagaccgggtgttgcaatgtacccaagctggtcgtgaactcctgagctcgagcaatctgcctgcctgggcctcccaaagtgctaggaatacaggtgtgagccaccacacccaacccacgattgtaactggctcaggggctggcatagcaatggtgtctggcaacttgatcattcactatgccatcagcccatctctcaaggaacagctcttctatgccattctggactttgccctatctgaggccatgggactcttctgtttgacagtcaccttcctcatcctctttgccatgtgaagctccatgggggtcacctactcacccttgctgctacaactccataacattcctggtgctggcatgtgctgagttttaccattaaacacgtttctcttttttttttttttttttttttttttttttttttttttttttttattatttttttttataaaat

SEQ ID NO: 250967 - DNA, 503 bp, Homo sapiens
tagggcttgggtttcattttactctacttagaattagtaattttgtttgttactatttcacggatgctgccacaagacatgaaacttctgggtaagagacaaaggtctttattactcattgcacagcaagtaacttgatcagcatatctgtgttgataccctttgcccaccaagacacagaggggcaacacagagggcccagatagatgcctaaacatgcagtaagttgcattacagaaaaggaacactgagcatggtgaatctgctgttttgtagcaagtcagaaagcctgttctttgtcccacagggagatgttacctcattcttcaaagatgctcactgcaaagacatccctgagaaatgctatggtaaacagtcatcagggtcttgcatctcaggcatactcagcagatatgtaggtgtgttagatctccatggaagcatgtctcccaacacagcttaacacataattttttaaaatgttgtgtaagcacaactcagat

SEQ ID NO: 250968 - DNA, 120 bp, Homo sapiens
tttaagatgaaggtaaatatttaaattttctctcccaagaaaattcagatgaaaacaggataagtattcaatgacctaatccaaaaagtgtataaaatttaaagcaaagacaaaacaaaa

SEQ ID NO: 250969 - DNA, 399 bp, Homo sapiens
ttcccagtaatgcctgccagaggagaaggcctgagctccccatgctgcaaagttctctgctctctgggactccccgggtgcaccatcatggtcatctccaaataccacatttctcacatcctcagaaaggctcatatagtgactcgtcttttccttactcagaggatcatccactgcaagaagaacaaaaatcagatcaaggagttacgtgggggtcagatgttatctgcccaggtactggctttatttgtacctcctgtaagtgacagacagaatacatggagcaaaaagactttggagactgtcatctatgaagatcaagggttattatgacttctacagcacaggagaatccttaaaatcacacagaaaaacaaataaacaaacatatcattaatt

SEQ ID NO: 250970 - DNA, 498 bp, Homo sapiens
tcccaccccacacctaacactaataacattgcagtctgtctccagcaagcagccctgacctcagggtgtggccggataaacacactgcagtccgtccacacaatggaacgtaactcagctgtagaaaggcatgtggcaccagcaggccagagtgaggaggaaccttgggaggaacatcccactgagggaagcgtggcagacgcccccacataccatgtgattccatttttatgaaatgtccagaatgggccggtccatggggactgaacacagagtggtgggggctcaggagaagggaacgggcaggtgctgtctgaggggcctggggtttcctgctgaggcaggagaatggcgttaacccaggaggcggagcttgcagtgagccgagatggcgtcactgcactccagcctaggtaacagagtgagactccatctcaaaaaaaaggaaatatgtggagtgggaaatcatgcttttaataaaacgagacccaaagaaac

SEQ ID NO: 250971 - DNA, 689 bp, Homo sapiens
ggaccttgtgtgcagctagaaccacagaccctcttcccttcagagccccagggagaggggaaaaataccactaggatttcagtgtcttcacaggaacagggtttcaggtttgggaaacattcatgccatccctcaaataagaagcttggtctgtttaacaaatcttcacttatcgtagtgctaggcatcaaggattcaaccagaatatgctgcataccttgcccttaaggagcttatggttttgtggagggagacagaagtaagtatgatagcacccaaacttactcctgtgataacagttgaagcactgggagagacacctaaagaaggtttcctggtggaggaaaggacctttacattgaggccaaaaaataaaagctaggctggagtaagggaaagtctaggcagagggaacagcaggtacagaagcctcaagcaagaaagagcatggtgttgtgagaattgcaagtggctgtgatctgtagtgagaccatagaaccattaattaaatgaaactggagaaaaggaaaatgagtaggagccaaggcctgaggaccgtgtaatgctcttagaggttttggacttgatcctgagggcagtggaagatcattgtgagattttaaatagagggtgacatgatcagatatgctttacagcagatcaccatggctacagtgcagacatgggat

SEQ ID NO: 250972 - DNA, 612 bp, Homo sapiens
ggagagggtgggtgtcctgagagactcaactgggacatgggaggaggcgcagagggtccctgtcccttgcttgcttgctttcccgaaaagtccccacaagtgtgaaacagaaggaggtgcttgccaggcctcccatggccccctcctttctcggggtctcctcccacgccatggctgtgagtgtctaacataagggacgctgtttttgcaggttttgtggttgtgattcctttgaaccatatccagcccatcttacatcacagtgccatgcttgacttggtctccaatacatcggcacccattggcatttggagaacttgctccgtagttatttgacagtttttagttgtctgtgataatgtattctctatgtttccaatcgtcagtatgggaatctctcccccaacctttcaatttctgggtttgattttttgtatcatatttggtttttttgctttttaaagttgtgattcctttggttattagcccctcccagtggctgcttgtttatgcattatgtttgtgacttcttttgactgtcagtgttgagccagtcttgccaagaaacaatatcaagtatttcctatttctctacttcttgaaaaaaaaaaa

SEQ ID NO: 250973 - DNA, 5071 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaattgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcgttagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatatta

SEQ ID NO: 250974 - DNA, 5604 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcgttagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatattaaatgtgatcatgtgattacttcatatgcagtgatcactagagcaaaacttacagagcaatgtaagaacccttgcttagaacattacttactctgatgggcagttattgttgatggagggacagaaaaatagatctaactggaagatgaactaccggaattaactcagccctcaagctatgtccctggttttctgaaaacagccaacaggaagtctcctaggctgaaatcataaaactgcagacaatccagcaaaaatctacaaactcacctagttcattcttgaaatacttcttgtatttgttatttatgaacccctgcctgcttccaaaaagaacttgcttgcagcgttttgtattaaaagacgcatgtgtataatactttaaacttttagagtaaaatatcaagactctcatgttggggagtggggaacgaggaacagaacaataacgcattaaagtaaataactctggataaaagt

SEQ ID NO: 250975 - DNA, 5070 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggattattacatttacagtactttaatacttgtataaactatgcagaaatttttaataaagtgtaatatattttataagctaataagactgaatgggtaaaggtttttagcatgcgttagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatatta

SEQ ID NO: 250976 - DNA, 2145 bp, Homo sapiens
tggtgttctagaggatcccgaggcttcaacggaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcgttagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatatta

SEQ ID NO: 250977 - DNA, 1858 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattctccttgccagagacattcttacctctgccctgtgataatattttatgcttgacagtgaaaacaagtgtggccccttgcaccggttagctagaagtacagccagatttcaagctagtgcagtcacctcttccgtcattttacactttggcaacccgaactttacactttgggctgg

SEQ ID NO: 250978 - DNA, 1275 bp, Homo sapiens
catgatgtgattgtccatgatgtgattgttcatgatgcgactgttcatgatgtgattgtccatgatgtgattgttcatgatgtgattgttcatgatgtgattgttcatgatgtgattgtcatgatgtgattgttcatgatgtgattgttcatgatgtgatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcgttagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatatta

SEQ ID NO: 250979 - DNA, 1258 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagtaagtatatttaggtctacccagcatttgcatagtagtgtgcatcttggaacctggagcagaagcacaagatttcacacgtgtgatgtggtgtggatgaccaggaacggcttgtgatctgtggccgccactggtccagtaccactggtcaagatgggagaatctctccaaaaacaatatgctgttacactgacaacgttatgacaaaagttacatcaagttttcatggaatcagtcatccatgattttgcac

SEQ ID NO: 250980 - DNA, 5125 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcgttagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatatta

SEQ ID NO: 250981 - DNA, 5071 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatcccgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcgttagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatatta

SEQ ID NO: 250982 - DNA, 3063 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattcgttgacgagctaacggggtcctttag

SEQ ID NO: 250983 - DNA, 1844 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgctagtgcagtaaccttttcggcatttttaacatttgtcaccttgtcttctt

SEQ ID NO: 250984 - DNA, 866 bp, Homo sapiens
aggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtggtaagttttccaagattgaacacctcgccttattttttccaagtgatgataacattattgtgtgttgaattattccttgaaatcatggccgggcgtggtggctcacgcctgtaatcccagcactttgggagaccgaggcgggaggatcacctgaggtcgggagtttgagaccagcctgaccaacatgaagaaactcccgtctctactaaaaataccaaattagccgggcgtggtggcacatgcctgtaatcccagctactcgggaggctgaggcaggagagtcgcttgaacccgggaggtagaggttgcagtgagccgagactgtgggcaaagtcatcatctctctggatctcagttcttgttctgagcagctgaattctccagaaattctccgtacgtgtgtgtgctcatcttcagcactttctgcattcaagaatactggcagtcagacaagttatctctgtgtgggcccgggctcctccgcccgtcagagcctcat

SEQ ID NO: 250985 - DNA, 597 bp, Homo sapiens
ctctcagcccctctgcctcactatccctctttctgtgccctcccccacacagccccctacacttcttcttagtctcatcttcagcttcccatacgaggccatcctcatgaaatcaggcactgggaggtccctggggactgacaagtgccagctgtcccttgctgtctctctgccccatggctgcagcagggagggtgggcaaagggcagaggtgacagtggccaaacctgaaactgaggcccagctctggttgggaaagaaacaaggaaacaaaataacttggggacagagggcgtggggtcatcagagcgggcaaaggctgcccaggagttgtaaatccgagccgctcccggctttatgaggccgatttggggttgagcctggactttgcccaggaaggagtgctggcagcacacggggcgccaggtgtgggccccggatgataagaagcctcggtgaaaagaccatggacctggggccacgaagactggggagcccaggtgagtgggcatgggacactctccagagccctgccgaaggcggacgccaggcagggccccggtctccaattggttcccgcccccaagaaacagcaac

SEQ ID NO: 250986 - DNA, 398 bp, Homo sapiens
ccaataaccaaggaattctacctgcaggaatcatgctaccagaattccgcctcttaagggacaccctaataaagcaatcgcaaaaacctttatccctacagggtatctgcaaaagaaacatcaggaatatttatggtgagaaatacaaacagcacttgaagcaattcctcccagtgacaatatggaattctgtctactgctgttatgacttggcatatacctcttgaaataagacctcccagtttcacagcagagggactttcggccactcaaactgcattttctggctagacatgtcccagaaaatgcttcacctatcacctgtgacatcccaaatgtacaaactactgattcttgaacatgttccaaaatacaaagtgatttgtctattaaaaaaa

SEQ ID NO: 250987 - DNA, 869 bp, Homo sapiens
agctgcctagattacccagtgtcttcaagatcgactccttggaaatgcttgcaaaacactagttttttttctcttgaacagctaaacctttcaggttgacacagctgaaggagtgtgagttaggagagtcgttataagcttgagctgtggatcctgggttgggccttatttacctaccacttactgcttgtgtaactttgggcaaaattgtttaacttttccctgcttcagtttcctcatctgtgaaggagggaaatagtaatactgatctcatagggttgttggatgaaccccacttatccagtacggccatactaagtactccaataggcatttcatgtattcgaatcttaataacataactgaggtgtgggggcttttgaagcaaaatggaaaacttcttatctttgagaggctgtggaattcatgctgtggatggtaggaactggtgaaacagtttgtcttggggagtaggtgcctgggtggagtgcatccgtaagtgtgaaaggacctcgggtccagcacttggaaataagatggtgcctcctgttacctgctcatccgacctgttgcgctagtgggtggaggggggcataaaacgtgcttcattttgaaggcgtgggacagaagctagggtggtaatagtttgtgatactccctcgaggtagtgaagagctacatgccaggctggcagctgggccaagccacttctggaggtagcgtgagactgctgatggccctgttgctcaggctggtgtgcagtggctccgtcatagctcactacagcctcactgtatgacccaggctgggcttgcactcctggcctcaacagatgtctccctaaagattggttaatcagtttttaaaaa

SEQ ID NO: 250988 - DNA, 487 bp, Homo sapiens
ctttcaatcatggcagaagtcacctcttcacagggcagcaggaggcagaatgggtgccgagtgaaaggagaagccccttataaaaccatcagatcttgtgcgaaatcactcactaccactagaactgcatgggggaaactgcccccatgatgcagtgatctcaacaggatcctgcccttgacatgtggggattattataattcaaggtgaaatttgggtggggacacatatcaccgaaaattatttttacttctggcatatagaaatgcagttatttttgtagattttgtagaaatctttccttattaatttttttagacttttattttaggttcaggggtacatgtgaaggtttgttttgtaggtgtcatgtcatgggggtttgttgtatagattatttcatcaccaaggtattaagcctaataaccattagttattttttctactgctctcctttttactaccctccaccctcaagtagacccaa

SEQ ID NO: 250989 - DNA, 395 bp, Homo sapiens
tattgctctaaaggaacacctgaggctggataatttgtgaagaaaaaaggtttctttggctcatggctctgcaggctgtacaggaagcatggtgccagcatctgcttctggtgagggcttcaggctgcttccactcgtgatggaagctgggatagtgttcaactttgttgttgagggccctggatgtgctccatcccctctgcacacctgcccaccagcctgggatgtcctgctccccagagggtggttctacgtgcctgagggccatggaacagctctgggttaggaacccaagagaacttctcggccatcgtatttctcttggactattctgatagcctgtgaactggtctcctttcttccattcttgctaccctgcaataaatcctgatccc

SEQ ID NO: 250990 - DNA, 354 bp, Homo sapiens
ttagtctttccccaactaaagcctagaagaatgagcgcaggggttcagaacgctaccttgggttcagttgtttctggcctcctccccagaccccatgcctgaggtctgccaaccacctttccctacagtttcagacttgtttacaaccatatgcatggccggggttgccaggaagtgggagctgcagattgtcttctgcaatgtatcatggctctgatcatcaaaagtgaacgtggaaactctgaggcttatttctttaagcgctggaaaaaaaaatctgacacatactttggtcttcttttggcttgagtctatgtgttgccacttcaggaaatgtaaggggacaatgcaggc

SEQ ID NO: 250991 - DNA, 1010 bp, Homo sapiens
cacacagtgtaccaagaatgaatcatgaagaattagaaaatctaaacagactcacagttatatgacattgatgtagtaatcagaacccctaaattggacagacactacaacaagctacaaatgttctttataactattaatgcagaaatcctcacttaaataccaacaaaccatatttagcatcatactaacgcagaaatcctcacttaagtactcacaagccatatttagcagcacagtaaaaggattatacaccaaaaccaagtgagatttatccctaaaataaaatggttcaatatatgaaaaatcaatcagtgtaatgtatgacatttgcaaaatgactgaaatatcgtagctattgcaacggatgcaggaaaagtatttggcaaattattaagacccactcatgataaaaatacacaataaactaggactacaaggaaactacagtatgaaaaaccagcactaacatcaccatcaatgctgaaataccaaaacaaacaagcaaaaaaacccttttctcccaagatcaggaaagagcggtagagaacctctgcttttatcactcccattcaacacagtattggaaatcctggccacagtgatcgggcaaggttgctgtacagatttagcattaatgtgccaaatgcaggcaacagaaaacagcacagacttacccactctaacaaattcttcatcctgcaggaaacaaactgatgttttggttaatttttgtaattcaccaatttatgtaccacacttttgtgtgtggaaatgtattcactttctgtaatcataaaggaagagagatttttcctatttctcttccctggtagcattcctgattaaaagccctagaatttcatttgaaactacccaaaagaagagacgagacctcaaaaagttaccacatacactcaggggaatgaaaataaaatatatcaaaaaaactcttctaaacattggcttgggcaaagaactcatgaccaagaacccaaaagcaaatgcac

SEQ ID NO: 250992 - DNA, 313 bp, Homo sapiens
actcacttacttcacttacagaaatccacaaaatcggctgggcacggtcgtcacgcctctaatcccagcactttggtaggctgagatgggtggatcaccaggctggtcttgaactctgacctcaaatgatccacccgccttggcctcccaaagtgctgggattacaggtgtgagccaccacacccggctagatcttaactgtttttagtaaacatgttggtgatgatgttggatattgttatttcaaaatgattgtctgtattctgcataaaataaatgaatactttgcttaatgattgagaactggcatttt

SEQ ID NO: 250993 - DNA, 464 bp, Homo sapiens
ctcctgcccccgagtcatgggctctgcgcgctttattcccacgaaacctaggacagtggccatcaaaccgagcgctttttcacggagaaacccggggcgggagaaagacgggagcgcgtcccttgaaggcgcccggcgccagcgccgcgtgggttcccggcagcgtacgccaggcccggacgggcaggacgcgagcccaagggcgcgggaagaagacggcggccgggagcgccgcgggggcctttcacacagtaaggactgcaacgccgcgagaaacgcgcggggaaagcatctccgacggacgaggcgaaggcgcaccctggggagccactggaagatccagcctggggtccagcgcctgccgcgccccaccccctccgtgcagccacgccacgcccctgtagccccgccctgcagccacaccccgccccggcgtgcaccgcgcccagcccgcgccccacccc

SEQ ID NO: 250994 - DNA, 437 bp, Homo sapiens
agctgtttaatgtgtagatagaggctgctctggttgtgtagtcttccagctctggactgtgccaatagcatggggtttggagtcaaatccaagttctatcatttacacttgatggcattttgatgacagataatttgcttaaatcctctatatgtgcatttaaatttgtatagctattgccaatctgcaaattgctctccattgacaatgtaccagtttacactcagattacacaccggagaggtgatgggcccgttgtctcacgctcatcacacatggtgtactctcaaactttgggttgcttgcaaatatgaaatgtagaagaagctatcccagtggagttttcatttgctttttcttcaatatgagtgaggttgtgcatcttttcatctatttaagggctacgagtatttctataaaccatcctttctatcttt

SEQ ID NO: 250995 - DNA, 516 bp, Homo sapiens
gtgctttccctgtatgtgtataccatgttctctttatggactactatttagccttaaaaaaagacaagggaattctgtagtaggcaacaacatggatgtaccttgaagacattatgtgctcagtgaaataagccaggtatggacaaacactgcatgattctgcttacatgaggtatctagagaagtcaaattcatggaatcaaacatcaggatggtagctgccaggggcttggtggaggaggaaatgggaatttattaatccacaggcataaagtttcaggtaaggaagatgaacgagccctagagatctgctgtccattgtaccgagagtctacaatgttctgtccacttaaaatgtgttcaggacaaacagcaattaaagaaaaaaaaatgttgggccgggcacagtggctcaggcctgtaatcccagccctttggaaggccaaagcaggtggatcacttgaggtcaggagttggagaccggcctagccaacatggcgaaacctcttctctact

SEQ ID NO: 250996 - DNA, 413 bp, Homo sapiens
aagttttaagtttagtggttgccggaaattaaggggaggaaggaatggaaagttattgcttaatgggtacagagtttttggttttgcaagatgaagagagttctggatgtggatggtaatggtgatgattgcacaacgtcaagaattaaagcataaaaaagattgggttaaagcctttggtttctagtaaaggttagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaactaa

SEQ ID NO: 250997 - DNA, 324 bp, Homo sapiens
tgaaagggcaaaagtgacatttttggggttgtgactaacttgcactttagcaactagtaaagaaaagaaaatcaactaaagtttcccctctccctcccccactccaaactcccacattcttccaaaatagaaagttgaattccagaatgaattgccagaatacatttatttagagttgaggacaacacggagctcacaggctttgggtgctgaacgtctctctggccctcagaaggcgagacgtggtacctgggtccctgcaaggtagatcttctgaagtggcctatttcccatagcggagacagaacaaccaaggtgtaggag

SEQ ID NO: 250998 - DNA, 157 bp, Homo sapiens
acattatcacatgtatacgaagtaaacaattcctcagcatacctaagacagtatacagtggtcccccatctccggaggataagtcccaagacccctaggggatgcctgaatcctcagagagtactgaactccgaatttgctatgcatgcacttcttt

SEQ ID NO: 250999 - DNA, 480 bp, Homo sapiens
cagaaatgtgccctgacgtgcaagtttgagaaacaccggttaacagatgagacaggacagttagaaggaaggacagagccagccagcaactaactgtagccccttggcatcacacaagaaacccgggattctctgtctccttgtgaagatttgcatcagctctctttgaggttagagaaggcagctgctggaagaggaaaggggtttatctggaccaactcttctgccaaatccatgtgctggagtttgttgtatgatcactctcctgagtttccagctgtcccttttcatgagtctcctggtcagtggctgggaaggaaggggagcgggagactcgtggattgtcttgaaaatcactggccaagtcaggaaatgcatgccttcctcttggcctgtttctggtattgactctttggttaccaagaaacacaaacccagctagctcaagaaagcatgtatattataataaaggctatctca

SEQ ID NO: 251000 - DNA, 441 bp, Homo sapiens
tatcatttataagagcaacataacatcaactacttaggaataaatctaagtacagagggtcaaaacatcaataccaaaaaactttattagcagaaagtaaggaagacaagtgactggaggaatatatcatgttcacagatggaaagactcaatattgtaaagttgtttattctttcctaggtgatatacagcaacatgcaattctaataaaaatttcaggattgtttttgtggaaactgaaaagctaattcttaatttatatagaaatgtaaagcacaatcagctggggctgccataacagaatatcagagactgggtagcttcaacaatagagattgattttcttaaagttccagaggctagattaaggtgctggcgggatgggtttctggtgaagcctctcttcttggcttgcagacagcttccttcttgctctgacct

SEQ ID NO: 251001 - DNA, 456 bp, Homo sapiens
tcaaaattatatgcctcctattagcctgactcatgcgtttctcacagcctatagaaaagcttactgagatgctttacagagaaacttccagaaacttacagaaaagtatacaagaacagggatatttcactgtctcttgggcctaggacaatacaaggcagtcaacactattgactcattcattcgttcacttatttgtttctttatttgcgtgataaataatcactgatttctacttcgtattaggtgtcaggctgtattacagcaaggtgccaccctcaaggagctcatagagctggtacaaaccctaagtaacatatgtattataaatatatatgtgtgtgcatacacacacacacaactgagttgccttttcagtaatgtttgtagcagctctaacaataaaaaagggcaattcaattgaattttgaccaaaagatatgcataggcagttca

SEQ ID NO: 251002 - DNA, 642 bp, Homo sapiens
agtttttcctttatctctcctatggttaatggtttctgcagaaaaggaccaattaatttctttctaaaacgttgcttcagggtgtagagtcctttataggtcatgtgtcaacttacagaaaatttttatagttcaaatataaattacgttcaatgtagactttgtaatagaatttaaggttaagtaaagtttccactttccttaggctgtttgcagtgcccagcaggccccatcatatcgagatggaagttatgttaaaggaggaggttggccagggttgggcagaataaggactatgggcagctcaggctaatgatacaatgattgagatgtagaaagagggccaggcatgggataacgcctgtaatcccagtgctttgggaggccaaggcaagaggatcgcttgaggtcagaccagcatggtcaacagagtgagacctaacctgtagaaaaaaaaaaaaacacaaaaaaacaaaaaaattagttgggactacaggcccacactagtatgcccagctaattattttaatttttgtagagatggcaggtggcggtgtgggggtgtctctctatgttgcccaggctggtctcgaactcttgacctcaagaggatcgcttgaggtcagaccagcatggtcaaca

SEQ ID NO: 251003 - DNA, 550 bp, Homo sapiens
ccagaagaaatctttatcttggtgtgcagtctctggtgagggacaaatgtcatctctcttggatctgaatctggaaggatcaaggcactgaagggatttttttgtttcaggcagtctccctctgttgccaggctggagtgcagtggcccaatctcggctcactgcaacctctgcctcccgggctcaagcgattctcctgcctcagcctctcgagtagctgggagtacaggcacgcgtcaccacgcccagctaatttttgtatttttagtagagactgggttttaccatgttggccaaggcaagaggatcgcttgaggtcagaccagcatggtcaacagagtgagacctaacctgtagaaaaaaaaaaaaacacaaaaaaacaaaaaaattagttgggactacaggcccacactagtatgcccagctaattattttaatttttgtagagatggcaggtggcggtgtgggggtgtctctctatgttgcccaggctggtctcgaactcttgacctcaagaggatcgcttgaggtcagaccagcatggtcaaca

SEQ ID NO: 251004 - DNA, 442 bp, Homo sapiens
aggcatagaacacatagaaggtaaaagtcactggaaataacttctctatgagggagttcatatctttttgtattagcagcatgatccgccacttaatattttaaaatattcttaccatggaaccctgtgctttcttcactgtggatccgtagcaatcatggcgttttctcttttttgtctccaccaaatcaactcactcttgctgagcatcattcttcattaagatatggctttggggccaggaatggtggctcatgcctttaatcccagcaatttgggaggctgaggcaggtagatcacttgaggtcaggagttcaagaccagcctggccaacatggcaaaaccccatatctactaaaaatacagaggcatgaggctcacttgaacccaggaggcagaggttgcaatgagctgagatcgcaccactgcacttcagcctcgg

SEQ ID NO: 251005 - DNA, 249 bp, Homo sapiens
ctgagaatgttttgtgttgatggagaaacagacaatatgtggcaaatttgaaaataaacaatacaattctcatatagtgataagtacaatgagcaagcagaacccaatctgaaagcaaagtaaactctatataagcgtagagcatgaatccattcattcaccaaacacttgctgagcactaccatggggctgggggctgtccttaggtgctttaaatacttgatttcttcccttttttttttttttaaa

SEQ ID NO: 251006 - DNA, 349 bp, Homo sapiens
ctgtgatgtttcctaatcagtgaactcatactggacctcgaagctgtctattaacaaaaatagcaaagtggctgttcagggtggctcatgcctgtagtcctagcactttgagaagctgagggcggtggatcacttgaggccaggagttcgatacgagcctggccaatatgtgaaaccccatctctactaaaaatacaaaaattagccaggtgtggtggtgtctgcctgtagtcccagctacttgggaggctaaggcacaagaatcatttgagctcaggaggcagaggttgaagtgagctgagatggcgccactgcactccagcctgggcgacacagcgaggctctgtct

SEQ ID NO: 251007 - DNA, 571 bp, Homo sapiens
ttctttataggtgttttgatttgttttgagggggttgtttggcatatattttgcaactaattaattcatttttgtaaaaccatcagacaacagtgctagatgtttaaaatattctacagcagaaattttcaaatgtttttggaatcattaatacaaccctgtctctccttcacttaaaccacagtagccattggtaattgagaactagattctttccctttgagtcctagttgatctcaaaaatcattctcaacactgcacttagctacaggtagctgttaatattttgagttgatgactaagctgaaacccatttgccacctgtgagttaatgggcaaggtctatccttgtctcttccaggctctagcctatagtgcaagtgttggcaaactttttctgtaaaggacctgataactattttaagccttgttaaccatacagtctcttatcacaaccattcacctctgctattgtagcctgaagccagctgtggacaagacacaacaaatgaactatgttccattaaaactttatgagtgtgactgtgttccaacaaaattttatttacca

SEQ ID NO: 251008 - DNA, 550 bp, Homo sapiens
tgtagacacctaagcagtgaaaaatttgatgccttaacctatataatttaaaatcaaaatatttacactataaggtgaatttaaggaagatctcatttttctcatggtgaagactaagatactttttcaaaattactaaattttcatttgtttcatcagggatgaggttgggggaggatctagctcctttattaatacctgaatatataggttttaatatccaagcttgactatatccactacacttggtacacaacagaacaaatgaatgaacattttcatgcctgtaatcctagcactttgagaagccaaggcaggaggattgcttaagcccaggagcttgtgaccagcttggacaacatagggagaccttatctcgacaataaatttaaaaattagctggttgtggtggcacgtgctggtagtcctagctactggggaggctaaggtgagaggatcgcttgagcccaagaggttgaggctgcagtgagccatgatcatgccactgcactccaacttgggctacagagcaagaccttgtctctcaact

SEQ ID NO: 251009 - DNA, 338 bp, Homo sapiens
actgtcagaatctcatccctttagctaagaaccttcaatgtataccaagacatacaaaacttagggaaggctagcactttaattctatcattcacatacctcttcgagggaatgacataaagatctcacatgggttcagctctttttagttttcatgacaacacagtgaggtaagcaggatttttttgtatcatttcacaaatatggagaatgaatagcttaagaacgctaatacatagcctagctagatcccaaaggcaggttttccaaaaaatctagattcctgtaggaagagaccacgattccatttaagctgagtggactctcagagattacag

SEQ ID NO: 251010 - DNA, 435 bp, Homo sapiens
atttgtttcatgcccatttttagttgtttgtggaaacatgtttataatggctactttcaaatccttgtcagataattccaacatctgtgccatctcaatgttggcatctcttgactgtgttttctcatttaaattgaggttttcctggttcttggtatgataaatgattttgattatatccaggcatgttgggtactatgctatgagactggattttatttaagccttctgtgttaacaaaccttctctgacactgtgctagcaggggaaaggggggcactccctcatttctgtgaggtgggggagtaggagggtaccttattattggtaggtgagggtgaaattcaggctacccatagttgatactgttatttttattgttagttttgtactgggtgcagtaacctggacagtgtctcagctctgtattcctta

SEQ ID NO: 251011 - DNA, 531 bp, Homo sapiens
gctgtcatggcagccctaacagatgaatccagtggcatatgaaataactgctaagaaccatgtgatagctggatgggggtttgtctgtgcaccatatgcacatacacacaaggacatccacatgtgtgaaagagggtgttgcattcccttaagagtagtatacttatttatgtattctgtgtaggatacttatttatatgagaaactctagcgcatgagaaaatgttgaacaagaatttaagaggattttctgtttaccctgagtttaactgtaaaattagagttcttccctaaatattattgttaatattatacatgttgttttttgctgtaaaatattcagagattatctaagtaattctgccactatctgtcatgatgtagtgactatgtgcatttctgttggacatttaatttctatttgataatttatttctgttcaatatgtatatttgtagaattatttctgagatatagatgttcattgctatccagaatattttatgtaataaactctatgttttctgtcat

SEQ ID NO: 251012 - DNA, 204 bp, Homo sapiens
ccccttaattttcatataaaatgtaataactatcagaataaaaagcacaataaccaagtatactttaaaaagagagctaagacagttataaacatatgaaaagcacacaatccattaacctaccagaacgtttcttaagtaaaaatatcccaaactcagaaaatctctcatggtttttgacaaacttgacaaaacggtttctta

SEQ ID NO: 251013 - DNA, 417 bp, Homo sapiens
gtgcctgtagttccagctgctcaggaggctgaggtaggaggattgcttgagcccgggagtttgtattgaagatataatgctgagcaaaataagccggtgacaaaaggacaaatactgtacagttccactcctaagagctgcctagaatcatcatatttattgagacagaacgtacaatggtgggtgccagggactggggaaatgggaagttatgtttaatgagctgagagtttcagttttgcaggctgaaaagagatctggagctggatggtggtgatggttgcacagcagtctgaatgtgctccatgctactgacctgtacccttaagatagttacagtggtacattttatgttacatataatttaccacaatttaaagaaaattaaaaaaatttacaaattcccttaaaaaaaaa

SEQ ID NO: 251014 - DNA, 946 bp, Homo sapiens
taaggctttcatcatataggaactctttattgaaatatttcaagaaaaaagggattatcatttagaagactgattagtcttatttattatgactgaaatgtgcaaacagaatcattgtttcatgaacagaaaacagcagagtttttgactgtcaatgatgttcgaatagaaaatggatcactaaggagataggagattctgttatcgacagtcttcaaaagtaagttgatggccctggaatgaatggagtacaggggattctctaatttgatgacttgttgaactacattatagtcaagatttttctccagtcatgagttggaagattctacaatctggtggtattatagaatggattggccacttgtgcatctgaatttgttatgaatgtgtaagaaaaaagcaattgagaagataccttgaaaataaatgagaacctcctttgtaacctgactttgtcagtcttcttaaagataacattgagttgatgtgtttttaaataagctgctaagagtaatatgtgtttttctgaaccaatattgtggtatttacatttaaggaattgttatagatttatttatttcaagtttccaaaggtatatacctaaacaagagatctaatcatacacatcttcaaagctcattttcttgtatctttgtgatataatttgataaaataacaattttaaacaacttgaatcttggatattagtctcatgagttagatgggctgttatacatatgattatttcataaactctgaaagtgtgaatgttattttactatactaccaatttgggatgttaaactacatcttgagcatttgttgttatagggaaagctcactaactacttttcatggagatcaggctggtttattttattctcttattacctgtgaccatttcatttaaacaaataaaatatttctctgatggaaaaacta

SEQ ID NO: 251015 - DNA, 395 bp, Homo sapiens
atttatataatttttaggagaagcaaatggtaacccttttaacgagaccctaaatcatataaagtggttggatattattatatctatatgtttgtgtctgaatatatttatttctgctactcctctgctataatcccaacactggcttacaaaagaggcaattcaggcaatggatatgtcacatcatttttttttttttttttatcacttgcggattgctttttaaatgctgtagtatgaataactgggcatttaataaccttgagaatattaattcatttactgatgtgcttattcatttatactcattcttactccaaaaaggatctaagaagactcgcaaagataaaaataatacaagaaaaactaaaatttaaaaaggagagggaattagg

SEQ ID NO: 251016 - DNA, 388 bp, Homo sapiens
ttttaaattttctataatgtgtgtgtgtgtgtattaatttaacaattagataaaatgttatgtacaggtcgatttcactaaaaagccaggtgctgattacagcagtattcattataatgaaaacttgaaagtagctcacatatcaattactgttgatactcgggtcactattggatttgttaagtgagttataaaatatatatctattgcaatagcttgcagccattgaaaatgaagattacaaagaccaagtgaaaccattatgtgaaaaaataaaaaatgctaggcatattatgcataattatttgaggatatcattgtaaaatctgtaaggaaagaggaaatgataactgcaacaggatagtaaaattaaatttgatttaaaaat

SEQ ID NO: 251017 - DNA, 542 bp, Homo sapiens
cttgatctcttgacctcatgatctgcccgcctcggcctcccaaagtgctgggattacaggcgtgagccaagtgcctggccatcagtacatgttttattgggaggtgggaggatcacttgatgccgggagttcaggaccagcctgagcaacatagactctgtctctacaaaaataaaataaaacttagcgggacatgatggcctgcatctgcagtcccagctacttgggaggctgaggtgggaggatggtttgagcccagtagttccaggctattgtgtgagctgtgatgatggcaccactgcactctagctagggcaacagagccagatcctgagtcaaaaataaatgttttaaagagtattatttccttttacaaatctccacttgtttctaggaaatttagaaatgagaaaagtattatttgcaatgtctggaatgccagagtctaacctcttaaatatgtgctcataacctcagatacttggtctatgcttgataattaatggttttgaattgcagtgtttattagttttgaaaatttg

SEQ ID NO: 251018 - DNA, 429 bp, Homo sapiens
cagggaaatacagggtagaaaagggcagttccccagcaaaggccccaccctcaagcctgaaaaaccatggccctaaatgaggacaggcattcctgttgtcacacccaaaaagttgccttttggcctgccatgccccatatcctgtacccatataaatcccgaaccccacgctccagaagcagatgagcaggtgaggaaatgaggagtcaaacagatggatagtagaacgacacagcaaagaaagaagaggaatgtctgaataccaagaggagttcagctgggggcagttagggagaggtttggagactggccagtttccaggggaagatcaccttcctattctatcccctccttctgcctcctcatccagcgcactgagagccacctccaccactcaataaaaaccttgcattcatcctttaagcccgt

SEQ ID NO: 251019 - DNA, 419 bp, Homo sapiens
ggtctctcttttcacatctccataatagaggtggtattttttgacttccatttgtgaagtgtaaatgagattcgttattgttgcttttatgtgaatccttagtacatggcctgctgcaaacacccaggacacccaggaaatggttgttgtttgattttcctcatccccagtctcaaggggaagccaggccaatgagaagagccacttgccatcaggctgtccctttaggagtcactgaaagggccccagggtgggatggtggggagataagaaccatgagagaagttggcacaaaggagttatgggaaaaagggtccaagataggcagaaaagaagcttttgccagttgatggggaagaaaggaaatcagagggcttagacagtgaggggggacaggacatctccatgtgcactctcat

SEQ ID NO: 251020 - DNA, 289 bp, Homo sapiens
gctgcagaggggagtggggccaggactggactggacctttgttacttgtagggtcctatcctgactttcccacagaaccttgtggctgaggagtatgtttgttgtttttatttttattttttgacaagatctgcactccagcccgggtgacagaacaagaccctgtctcaaaaaaaaaaagaacaaaataaaataaaagtaatcataagacaagagaatcccatcctgacttctgttttattgttcattggagaagattctttctataagtcaaggaaattttgctgtg

SEQ ID NO: 251021 - DNA, 421 bp, Homo sapiens
acactgcctgatttttcctgaaaccgaagataattctcatctgactgtggttacctcctagttggtgtgtctgtattccaattttgcaagcttaaaatctgtccattcacctgtcttatttttttaaaatctgtactgccccattctacattatgactttaagatttcagctttgaatttctggtcctagttcagatcctaaggtttggaaaagtcagaaaacagatctattaaaaaaaacacacacacattaaagggaaagtacttcattacattttaaacagcacctgggaggctgaggtaggaggattcgcttgaacctggtaggtggaggttgcagtgagccagattgcgccactgcattccagactggtgacagagtgagatccgtctcaaaaaaaataaaaaaactaaaataaat

SEQ ID NO: 251022 - DNA, 300 bp, Homo sapiens
gttcggagtaaaccggtttagccacaaatacttggagctgtgctttcactccttccagctcattagcatttttcttactgattttctccctatttggccttagaaaaaaagtgtaaatttaactctgtggagtaaatgggagggacacacttccaaatctccagtagatttcaaattttgacccacgatttgtgtgtacttcaaaagaggggagaatgacattcgtttatgcatgccttaacctcctgtttttaactcttagctgaaatcataatccctaacatgtttttccccaagttc

SEQ ID NO: 251023 - DNA, 415 bp, Homo sapiens
tcatgatcggatgccgaagtcagaaacttaaaggacacagcagagcccaggggggtacgcgttcagaccccagccctcctaacactggctgcgtgacctggtaatgcacagaagctctctgtgcttcagctttgtcacctgtgaaatggagatagaaatgggatctgtctcggtgagtgctgtgagcattagatgagtgtagatacacatccatggtgcctggcacacagtaagtggtgttaactatttgctattaattttgtaagcgcatatacaattatgccaaaaaaactaattaataatagcttcctttcctctttcattctaaaaattggctcagggttgcatatcaagtaatttatttaaatacaatttttcacaatatattgatatataatatataaataatttacac

SEQ ID NO: 251024 - DNA, 463 bp, Homo sapiens
tgctttttagttgtcacattctcagtgggccagttatagattgaagtgtcccccaaaagatatattgaagcctacagtacctttgaatgtgacctttttggaaacagggtctttgtagatataattaagctaaaatgaggtcactagtgtgggccctaatccaatatgacttagggctttttaagaaggagaaatttgaacacagggacagacacatacagaaaaaaagatgaagatgatgtaaagacttacacaaaggagacgggcatgtcatgatggaggcagagaatggagtattgcatctgcaagccaaggaataacaaggattgcctgcaaacacctcaagcaagatgagactaaataggactctcccacacatgcttgagggatatgacgctgctgacaccttgattttgaacttctaccctctagagttgtgagggaataaatttctgttgtttta

SEQ ID NO: 251025 - DNA, 284 bp, Homo sapiens
tgctgggtactcctaagcaagactctcctactgtgttttgggggtttatgtaccccactccctgcagacaatatgcttctgaatcagattgtattttacggaagaaagaggcagttagaaatcagatgaaaatggccaggtgtggtagtgggctcctataatccgagtgactcgggaggccaaggcaggaggatcgcttgagcccaggagttcaaggctgcaatgagccatggttacaccattgcaccccagcctggataagagagtgagagcccgcctcttga

SEQ ID NO: 251026 - DNA, 441 bp, Homo sapiens
gagtgaaactttgtctcaaaaaacaaataaacaaatgaacaaacaaacaaaaaatcattgttattcctcagagtaagagcaaagatcatcccctgcagaagcttaggaactatgcacagaactttacagaacaggggcgatgctttaactgaaggctgactactgaccagagaatggaattctgagagggctcaaggaataaaaggaaactaggcagggaaagggaaggcgcccatctgaagcaaacttcagcggccatcaggatatcttgtggtggtcacaagttgtaggctctgtttttggaaggtttgggtatagcgcaggattccatttgtctacttggctacacctctgcctgaggtacactgttgccagaaaagagggtcccaatccagaccccaagagcaggttactggatctgcacaggaaataattcaaggg

SEQ ID NO: 251027 - DNA, 767 bp, Homo sapiens
agcatatactaaaggttttatttagttcattattaatgagggaacaagtaagatggtacaagcagtccaaagtttagaacacagtagtggaaacttcccctatgggacatgcccatccaacaagtgcaacaagaaattaagttttagtgaaaacaccaagcaaaaaagctacagctctaacttctctgctgcagagccctgagtgccttgcctggctgtaagaggaatactttcatcaccaagcctaggagagtgcctttgtccatcgagggtccccattggggttaactggagcccttgcagatcaaggttgcctctgccttctgtgttcctgtctgtggctgtgctgttgtcccagtcatcaccgtaaccagtgatccagttctcactccctcctccagagcaagataatagcctcagatgaagaaattctggttctgagcccgagaatctgagacagactcagatctaaatctttttaaagccttcaaggagattatgatgcccacgtgagctggctcagaagaagaatttatttcaggaatgccaagaatttctcatgcttggtggtaggacattccttgataatttagccaggtgagaagttgtcaaagaactgccaaacccataaggattcttgtagctcacagccaggaggctaccttatattttgaatttaagattaagggaaaaaaaaacacaaaaaacatatacaatacattcttgttgtggtcgagcataaagtaattaactatacagagaaaaac

SEQ ID NO: 251028 - DNA, 389 bp, Homo sapiens
agcccttcttcaagatggagtcgctctgatttgattgcctctgacaattatcttacctgtaatcaataggattgtaattgtgaaagtgagagacaggactagctggatttcctaggccaactaagaatccctaagcctagctggaaggtgaccgcatccacctttaaacacggggcttgcaacttagctcacacccgaccaatcagagagctcactaaaatgctaattaggcaaaaacaagaggtaaagaaatagccaatcatctattgtctgagggcacaacgggagagacaaggatctggatttaaacccaggcatttgagccggcaacagcaaccccctttgggtcccctccccctccttttgtacgggagccctgttttcaccct

SEQ ID NO: 251029 - DNA, 1037 bp, Homo sapiens
tgttaaaaagaaaaaaaatctctgtgactgtccttttatcttccctggtgcatacaccttgttagtaggtctttcggttgaagttttgctttggagaaattccagggccctttgtggcagccctccggtcttttcttgttcatgattttcagaaccgtcagggataacccaagatgcccacagtggccatatctcttggagtgtctaatgaatatcatcccctgggtcatctcttagaggacagcctgaggaggaagagtgtagcctctcagaagagcagctggatggcttaggcctgtggaaatttcctcgcataccatttgtcttagaaagctaaccttttagaaaattaaaattattttttcacaaaggaacgcgtatacactgttgatgggagtgtaaattagttcaaccattatggaagacagtgtggcaactccttgaagacctagagacaaaataccatttgacctagcaatccattattgggtatttacccaaagcaatgtgaatcattctattataaagacacatgcatgcatatgtgcattgcagcacaattcacaatagcaaaggcatggaatcaacctaaatgcctattaatgatagactggataaagaaagtgtagtacatatacaccatggagtactgtgcacccattaaaaaaaaatgagatcatgtcctttgcaggaacgtggatagagccataagacattattcttagcaaacagaggaatagaaaactaaatactagctggatgtggtggctcacagctgtaattccagcactttgggaggccaaggcaggtggatcatctgaggtcaggagtttgataccagcctgagcaacatggtgaaacctcatctctactaaaaatacaaaaaattagccaggcgtggtggcagatgcctgtaatcccagctactcaggaggatgaggcaggagaatctcttgaacccgggaggcagaggttgcagtgagctgagatagtgccactgcactccagcctgggtgacaagagcgaaactccatctc

SEQ ID NO: 251030 - DNA, 936 bp, Homo sapiens
acaaaacgaacttttttcctggttgagcattaactgacaatcacgacagtagaaccgttagagtttagtttttaatattatgtgtgttatctttcatcagttaataatgagtaagcctattcagaaaaagaacataaactgatcaaaaactcagcatctccagcctttcatttcctgctattcaggaaattgcttagaacatcttgatgtcctccttgttcttcctggacagtgactttttgggagtttgttcctgctgcgtaatgtgatacccacttcagattttttttttatcaatacatttagtaagttgaacttctgtcaagttttattacaaaattacttgttaaaacaatttttactaaactgcatttctatctagcatatttttgatatggaagtgatagtatagtatagttccaggagaagtcttaaatcagtccacagagtccagttagcaaatactctgtgccattaagattgctaaaatacacagttcaggtaaatttactagtgttttttaaaggtttatttgttttcacaagatgctctgtccacacccttataacatgtaaaatattgtgtgctgtattatgtggtaaagttgttaaaattcagtttctaacattaacttaaaagtacagacaatctaacatgatgatttgacttacaaactttcaactaaatttatgatggctttaaagcagtgcactgaatagaaaccatactttgagtacccatacagccatttttcacttttactacaatattctataaatcacatgagatatttaacactttattataaaataggctttgtgttagatgattttgcccaaatgtaaactaatgtagtgttctgagcatgtttaagttagggtaggctaaactatgtttggtaggttagatgtattaaaagcatttttgattaaaaat

SEQ ID NO: 251031 - DNA, 388 bp, Homo sapiens
ctcagcacctctgttactgttttaatacatcatgaccaagttggatttattccaggaatgaaaatcaaataatgtaatttatcacgttaccagaataaagggaagaaccatatggtcatctcaacagctgcaggaagagcttttgatagaagctaatgcccagtcatgcttaaaaactcgaagcaaaccaggtacagaaaggaacttccttcagaaaatctctaacacaatcatacttaatatgaaaatattaaaagcttttccccgtgagatctggaatgaggctagatacctgctgaccatttcaattcaacatgatattggaaattctggccagtgcagtaaggtaaaggaaaaagtgaaagggattaaggttagagaaaagaag

SEQ ID NO: 251032 - DNA, 535 bp, Homo sapiens
tggaacttatttttaacaggaatcaaggaagaaaatattcatgcagagctatgacttagaaagttataggggctgccactatacagcacttctaaagtaaaacatcttctatctccaactgggctgtcaacatagtggactttcatgttctatggatatgaattctttaaggatatagcccttaattaagctgtaaaaacaatgcatctctcaaccttgacatttaggatctctcctgtctgccccctctacgccccactccaattaactcatcctacatctctcagatgtaagttggataagagtgggtttgaagtttggtaatacaagtggcagttttaaaacaccaaattctttagatcagctgaaaagaagagtgagaattgaaaattcctccactagtaattgttagccaatagaatagcctcccagagcagtccccacagcacttggttgccatgggtttctctcctctcactgcctgccccagtgccatgatgtctggggcttgtctcttctatggcatcccctgatt

SEQ ID NO: 251033 - DNA, 188 bp, Homo sapiens
tgcagcctcaaactcctgggctccagagatcctcccaccttggtctgcagagtagctgggactacaggcttgtgccaccactcttggctatgattttctattttttgtacagatatgctctatgttggaccagactggtcttgaacacctggcctcaagtgatccccccatctcagcccatatttttt

SEQ ID NO: 251034 - DNA, 622 bp, Homo sapiens
  misc_feature (547)..(547): n is a, c, g, or t
  misc_feature (582)..(582): n is a, c, g, or t
gcctctctcaaggatgaggttttgaagattatgccagtgcagaagcagacccgtgccggccagcgcacgaggttcaaggcattcgttgctatcggggactacaatggccacgtcggtctgggtgttaagtgctccaaggaggtggccaccgccatctgtggggccatcatcctggccaagctctccattgtccccgtgcacagaggctactgggggaacaagatcggcaagccccacaccgtcccttgcaaggtgacaggccgctgcggctctgtgctggtgcacctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccntgcagcggactcaggctccagctgtggctacaacntagggtttttatacaagaaaaataaagtgaattaagcgtg

SEQ ID NO: 251035 - DNA, 763 bp, Homo sapiens
  misc_feature (547)..(547): n is a, c, g, or t
  misc_feature (582)..(582): n is a, c, g, or t
gcctctctcaaggatgaggttttgaagattatgccagtgcagaagcagacccgtgccggccagcgcacgaggttcaaggcattcgttgctatcggggactacaatggccacgtcggtctgggtgttaagtgctccaaggaggtggccaccgccatctgtggggccatcatcctggccaagctctccattgtccccgtgcacagaggctactgggggaacaagatcggcaagccccacaccgtcccttgcaaggtgacaggccgctgcggctctgtgctggtgcacctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccntgcagcggactcaggctccagctgtggctacaacntagggtttttatacaagaaaaataaagtgaattaagcgtgaaaaaaaaatcaaaataaaaaatgaaaaataatatataactactccaggttagaatattttaatctaggaagggggggacctatgaaggcaaatgtacctggggctcacaaaagtcacaacatggccccaccatgggaggg

SEQ ID NO: 251036 - DNA, 502 bp, Homo sapiens
cccttgggaagggtcatggttgtttatttgaagctgctttcagccagtacttggccgaggagtgtggatgaatgaaacgcctctgttgtcctgctgctgaaacgggaacactattgcctgtcatcactgttgtgcccactgttttggcttatgatacaagagcccactgtcctacatctctaatgatacacagagcatctctggtctctaggaggtgggagggacactacttccagctttaaccatatgcatgacaaggagatccagtgaccatctggtggggaagcaggcattccatctccggagcttcccaaggaaacaggagacaatggagtgcaggaaatgctcagaaccaggaaacctgcaaccacttagttccagtggcttggggtagctaggattccgtttattcctttgtaaaatggggataatgcagggtgctctcatgtggagctaaggaaacaatatgtgaaagcccgttgcatataaaatttatataaag

SEQ ID NO: 251037 - DNA, 332 bp, Homo sapiens
cagttgataatctattaataccattgtgttgaggaagttgctgccagagcctattaaaccactttaatctggactggttgctctctgtcttcgtacaggtgtcctcttgctgtcctccaccgtgctagggttcctttcctctctttcttgcctatgcaagattgctatagaataaatatttgtgtctcccccaaattcatacgttgaaacctaatccccagtgtggtagtatttggtggggcctttgggaggtgattaggtcatgaaggcagagtcctcttgaatgggattagcacccttatgaaaagaccccaggaaaaaaaaataaaaat

SEQ ID NO: 251038 - DNA, 479 bp, Homo sapiens
taaatagtagtcattttaatgggtgtgaagtggcatctcatcgtgattttaatttgaatgtaatcatcacctaatgaccgatgctgagcatcttttcatgtgcttatcggctacatgtatatcttctttggagaaatgtctattccatccatttcggaatctggttgttttaaaccatgatgtttttagaaaccctgaccctctgccctgtataccacagccccacacatattcccatggagagttcactggcagcccagacagcgggatgctctgagggagaagaaggtattccattgctctgccccatccaactagttttgccaacgcacatgacacttacgcacaacaccgtactctagggctacggcactgcaaacctctgtgaacctgtaatattacccggaagaggtaattcatcaagtcagtatgactcacagaactttagcttgaattcctaaatctgtgtagctgcctgg

SEQ ID NO: 251039 - DNA, 514 bp, Homo sapiens
gaggctgcaatcaaggtgtcatcaagagatggagtctcatctgaaggctccacagagacagcaagaccaactcttcccctcaggaggaggatgaaagaggctgaggagaaggaagacttttatgatgatccacttccacctaatcaatactgttctaaggcttttatcatccacagttattattttacttttattttcctcaaaaagggtttataatcagccacaagtccaaaatttgtttcttcttcaaggaaattaatggacaggattctgataagtactcctgaatacaggttcctgataacttgggaaaccataccactggactagagtaaaagttacaggtatcaactcctggatacatcacacttgagtcaaagcctgaaaaagctgagacagcaacccttgacagctcagaggaacatcttggatacaaatgtggagaaatagaagaccttgagctgaaaatcataagacaagtaaataagcaaggggtacgcatcttactcaattc

SEQ ID NO: 251040 - DNA, 451 bp, Homo sapiens
tgatattttcgtatgcttctctatggaaatggatttatttagaattttcttcttttttggtttgggcagaggagcgtcaccctgtggccaccagaagcacaggcttaggaggagtacttccaggctaccgccaatgacccttcaaagctcaaaggctcttcagtcagcttgtgagacagcaagaccaactcttcccctcaggaggaggatgaaagaggctgaggagaaggaagacttttatgatgatccacttccacctaatcaataagtaaaagttacaggtatcaactcctggatacatcacacttgagtcaaagcctgaaaaagctgagacagcaacccttgacagctcagaggaacatcttggatacaaatgtggagaaatagaagaccttgagctgaaaatcataagacaagtaaataagcaaggggtacgcatcttactcaattc

SEQ ID NO: 251041 - DNA, 586 bp, Homo sapiens
tgatattttcgtatgcttctctatggaaatggatttatttagaattttcttcttttttggtttgggcagaggagcgtcaccctgtggccaccagaagcacaggcttaggaggagtacttccaggctaccgccaatgacccttcaaagctcaaaggctcttcagtcagcttgtgagacagcaagaccaactcttcccctcaggaggaggatgaaagaggctgaggagaaggaagacttttatgatgatccacttccacctaatcaatagaaattaatggacaggattctgataagtactcctgaatacaggttcctgataacttgggaaaccataccactggactagtgcactccagcctgcgcaactgagctagactgtctgaaaaaaagacaaagttaacgagtaaaagttacaggtatcaactcctggatacatcacacttgagtcaaagcctgaaaaagctgagacagcaacccttgacagctcagaggaacatcttggatacaaatgtggagaaatagaagaccttgagctgaaaatcataagacaagtaaataagcaaggggtacgcatcttactcaattc

SEQ ID NO: 251042 - DNA, 371 bp, Homo sapiens
caggtccctctaagcacccagtcatcaggggcaggcccccatggagagaacaggcttgtttcagggaggaattcccagaagctggagctccagacagaggtgagggacagtggtcagcgcaaggcacactggacagagctgacttcagtcctatctggagtttctccaagaagcttcttcctagaagctcatcatccctactcactttggggtgaaaatagctttgcaaaacctgctcagatgagtcagcaggccagacctccagagcggtggatgtagtccacacgaaattgcctttagtgaactgagcattgatgttataccatttgattgcattgatttggtttataagaaccagcacatccctagct

SEQ ID NO: 251043 - DNA, 329 bp, Homo sapiens
tagagacggggtttcaccacgttggccaggctgatcttgaactcctgacctcaggtgatccacccgcctcagcctccgaaagtactgagattacaggcgtgagccaccgcacccagccaaagcctacttttaaaacaccagtttagtagtctttaagatgtgccaaatgttgaaatactttaactctgggatgatgaatataggcagagtgccaaactcttcaatttaaagaagtttgcttagcgattgttttattgtttattttttgagacagggtctcactatgttgcccattctgttctcaaactccagagctcaagagattctcc

SEQ ID NO: 251044 - DNA, 540 bp, Homo sapiens
gcagaggttgcattgagctgagatcatgccactgcactccagcctgggtgacggagtgagaccctgtctcaaaaaaaattttatgaagttgaacaattctgagtgatgacaagcccagactctagtcctgggtgtggttgactaaaatggaatggcatttaaagtcctgtgagaatcatagatggacggagaagtactaagttcttcagtgaatatggaggcacagattgggaagctgagtataggagacagtactactgaagggccgtgatgcctgttacggacttttacatgagaacataaatagttgtctgaaaagtggctcctggcccagagaatgcctgttcctgttgccagccctatggcatatagagtcctgaaagaataagcagcgtgcactctctcgtggggaaagtgaacacttgagaggttgaatgtgcttctcaccaactcccttggggacatttaaagatgtaaggggtaatttttggcacaacctaaaatactgttctcttcctgttcagggcttaccttttttta

SEQ ID NO: 251045 - DNA, 113 bp, Homo sapiens
ttacatcttttgggtagaggaggtttcagtgaagtttacaaggcatttgatctaacagagcaaagatacgtagctgtgaaaattcaccagttaaataaaaactggagagatga

SEQ ID NO: 251046 - DNA, 281 bp, Homo sapiens
actccaacttgggcgacagcaaaagaccctgtctaaaaataaataaataaataaataaataaacaaatatgtacagccatccttgtcttcaagcactttgagaacattttagccattgatgtttacatgtggcacccacccatgcaagataggtttctgtatttatacattaaaataccaaaaaaaaaaaagtatgaaatgccttcaaaaatgttcaaagcttgagagaaaagcttttttcattagtcaaggtgttttgatatggtattaaaataatatct

SEQ ID NO: 251047 - DNA, 399 bp, Homo sapiens
aacaaacagacaaacatctcagtctttggagcttaaatctgagtgaatgacagtccatcactgaaagaaaaagaaaaaaaacaggtttggttttggtttggagggagggtgcagagattaatgcaattaggtgtttttaaaattttttacttttttgtttgatatcttctcaaaaaccaaaaaaaaaaaaaaaaaaaaaaaaaaaaccaccacaaaataacttttttttttactttgctcagttgccagcactacaggaaagagaagcctggaagtacattatgggaaaagaagtagataggtcttcagtgtaaaatctgaaggggtcatgtgagtatttttaaggattcaataatatacataaacacaaataaaaacacagtatatttcccatctatt

SEQ ID NO: 251048 - DNA, 353 bp, Homo sapiens
tgttttaggtgccacagtcacagcaatgtacaagacagttgctctggaccaagtgctgtatcccctcaaaatttaatgttgaaatgttgaaattctaatccccagtgggatggcatttggagatggagactttgggagataatgaggtattgagggtggagtcctcatgatggaattagtgtctaagaagagacaggccagaacttgcttcatctccatccttctaccatgtaagattacaacaagaagctggatatctacaaagcagcaagagggccctcacaagacaccagactgccagcaccctgccttcccagcctccagattgtggaaaataaatgtttgttgtttaa

SEQ ID NO: 251049 - DNA, 766 bp, Homo sapiens
gtctcttaaaaaaaaaaaaaggtaaaaaaaaaaagcttgtagtgttcatatgtatatatatatattattcaatatattacggtaactaagtcctgcctagtaaaatctttttttttgtaataaaattagcaactcactaaatttatgtgaatatatggttttaaaaactctcaatgaagattaaaagttcactgtcagaggtttcagcagtcctttcccaagcttatttacatgctaattttgcttagtaaactctggcttcaaagaacacaaaggtcagctgccaccaggtccctcctccgaggctttggccctagggaccctgggaaggcggcttcagtgcccgcttccctgagcaaaggctcgtctggactctgacgcggacccaccgggtggggtgggtctccacgccacccggctgtgcgtggggcaagtcctgcaccccgggcctgcgtttcccgctgcgtgaacggatggtcttgcgaatctagccaagggcacacagcgagcctctactcgggcattaggcaggctgtaacgactgagtgctgcacgggcagcgtccttttgcttgtgttttcttaacccgtaagtcatttaaagctttgttttggaacgaccctctagtgaaattggaacatgcccatttaatgccatattttaaaaacgctgtaaccccctcccatctccgcgttcacccttgaggaaatcctaacagtcaccatggatataaacattaataacaaaattaaagctcataacaggc

SEQ ID NO: 251050 - DNA, 271 bp, Homo sapiens
ggtttccatgagatagtgttgttttatagcagtttaatggtcacagctggcagtatgtgcagagctgaaatcacaatagacttgtgtatttggtttatatataggtgagacatccttacctacaaattgaaccagtcctgagcttttctttctcttatcgtaaagtgactagaacttttttctataccaatcgccaaacttgtcaggactggctaacgcggattcgactctccatcatgagggtaggattgttggcaggccagcctgcagt

SEQ ID NO: 251051 - DNA, 492 bp, Homo sapiens
gtgatttccaatacacatttctgcaaagtttttgttttttgtttttcccctacatttcgggaaggagttttgaagggattaaaaagctgagattctttctgaggtgaccaggcctggctttcaaccacgccctggttgcttttggctgttactctgctgcaagccttgtgattcatgttgtttaaaggctgagtcaccagctttgtgacatagcttttttcagagtccaaaaggtacagagaaaaaacagccctaactgcagaggcaggggcgggagaggaggacaggaggaggaaaaaggaagaagaggggatgagggtagggtgggtaatgggccaaaggttagctgcaaagagaaaccaatgttgtctctagcagaaaaaaattattgaaaacatcccagcattccctgacttaaatggttattgaagcaaacagaaataaacctttctccaaagtcactgaggtgacagggaagaaaatggcctccca

SEQ ID NO: 251052 - DNA, 481 bp, Homo sapiens
acatagttcttttctttgaattcctttagggtcctaaggtaaagtacacctgaattttacccaacaataatgtacctattgggcaggccgtgtaaccttcagaatagtggtccttaatctattctaagtttcaggctcctctcagagtctgacctcagaaaaggtacttcagaaaaggtacctcagaaaaggtacgttatactcagatgtacagaattttcacacaatgtcataggttttatgagttcctaatgaccagttatgggtccttcagcaatccatggctttcaagttgatagtctatgttctgtagcaagaatatgagcatcatctctctttgctttcctcctccctcatactttccctcctttcctgtcagcagtcccttccttgaaactcccactccctcaatcccttaaaaaaaaagcatatgagtgtcaatcatatgatttgaaagttttgcccccattgtttaggaaat

SEQ ID NO: 251053 - DNA, 358 bp, Homo sapiens
cagatagatacatgtggtatactttgacccaaagttaaggaaatttttaaatattaaaaagatgaatttttggccaggtgcagtggcttacgcctgtaatcccagcactttgggaggccaaggcaggtggatcaccctgaggtcaggagtttaagaccagcctggtcaacatggtgaaaccccatctctactaaaaatacaaaaattagctgggcatgatagcacgtgcctgtagtcccagctactcgggaggctgaggcaggagaatcccttgatcctgggaggcaaaggttgcagtcagccaagatcacgccactgcaactccagccagggcaacagaacaagactccatctcaga

SEQ ID NO: 251054 - DNA, 483 bp, Homo sapiens
tatttccctggcttgcccaattatcaagggaaaatttcagctgaacacggggaacccagtctttgacactcctgtgtgcagtgtggagcagcgtgcactgtctgagtctccatagtgaggaatggtcttccctggggcatcaccctagaaggatgggctcaaagtcgccctccacgtgggtgcacaggagcccagattctcaagccccagttgcagaattaggctgatggttttacaaaagagtcctcctaaaagtccatcactaagttttgtttggttagcaacccttgccacatgatgtagtacttagctataattttatttttattcaaggccaaatcttatctggtgtccatgccttcccacctacttaaaatttcaaatttcaccctcaaaaatatttcagtaaataaaagttagatctactcaaaattagactccaagggaattactatagttgattatagagtatctatttcctta

SEQ ID NO: 251055 - DNA, 722 bp, Homo sapiens
caagagtcttcagttctatttctctggagtcggatcaacttatttagcaagtgatttgcaaaagtctctttaattaggttatttttgtaatcgtgcaaagaggttttcctttgcctgaaaactcaaacattcattaattattagaaaagccaggaagcaattaacatcaatttagaaataacgtttctaatatacaagttgatgttgtcttatcaaccaaacgaactctgaacgatgggcatggcccaatagacaggtgacttgggaatcacatgccaagaactcaggtttccacactgctgctaaagggctgtgtgtctttgggcaagtcattttacttccctcaacctcagtttcttcatctgtggaatgaggaggttgcatttgaagttctctgccaaccacaatattgtttgactctagtagaaaatgggaaggaaataaaaacaaaaaacatagaagcagtgataaaaagagatttttgtttctacatttctttatatggttatgtgtctctcttggacacatgaaattcttattgccatcagaatgactgtgtcctgccagtacttcaaggcagaaaggcctcccctggatatagagaaaatggccccactagccatcatgacatcaagaagcaagaaggttcccatctaatgaatcataagcaaatcattacagacagagtgaattttacagaagtagaattgttcttgacctta

SEQ ID NO: 251056 - DNA, 485 bp, Homo sapiens
tttgctagcaataaatctacataaacctcaaagctttcttcaagaagctcagtgtctaggacacagacttgaagaattcttatgcagttcctaggtatatatggccatcttgtgttaaaggcagagaaactccaggcacagaaaagacataaaatcatgggtagaactgggaacaagaatcaaacctaatctcctgcttcacaaatttctccaggctgtttccccacaggagtttaagtaaaattattattctttaaaggagttattcattataccataatggcataatgaataactaatacagggctgctcaaaaggtctcccttttatctcttattcactgaggtattataaagacaaaactgctaagttctgaattctgtattaagagcatattacaaataatagatgaactatgtgattatacttttgaattatttagagctctaaagcattttagagaagcattacattaaaatagaaga

SEQ ID NO: 251057 - DNA, 446 bp, Homo sapiens
tactttattcttccagtcatctctgttgtcagaaaggagttgatttctggcttaactctgtatcagaatttcttgctcggatcatttggtattgttaatattcgtctatgaaataagatgtttcaaagaattcaacatgctaaggcaatacttaggaaacactgtgcttcaaggtctgcctgtctcctctgctgaacattttaaataatgggattacaggtgtgagccactgcactcatcctgttccaacttttgaattggctgttatttattttaaacattgaaaacttccaagtgtctgttctttctgttgtcagtgatgaataatgtttcctccagatatgcatgttttagtatagtgctcatttttgctgtagcgaagagcagtgctatttatgtgagtgtacatgtggatttgagaaatgttaattttgaaatgaaccaaa

SEQ ID NO: 251058 - DNA, 864 bp, Homo sapiens
ctaatttaacttttttttttttttttgcggagatatggggatgcctcgctgtgttgcccaggctggtcttgaactcctggcctcagcaatcttcccgcctcagcttcccaagtagctggaattacagttgcaagtcaccacacctaactttttattttgaaataacttcagatttacagataagtttccacgcataataaaaataacttgcaggctgagcacagtggctcacgcctgtaatcccaacactttgggaggccaaggcgggaggatcacttgaggccaggaattcgagaccagtgtgggcaacgtcgggagacctcatttctacaaaaaaaaaattagccaagtatggtgatgtgcaactatggtcccagctactcaggaggctgaggtgggaggatcacttgtgcccaggagcaatgagctgtgagcgtgccactgcactttagcctggggtaacagaacaagatcctgtctcagggaaaaaaaaaaaaaagaaactttcatagatcttcacccagatttccaaactgttaatactttgctgcatgtgttggtttccacctctattgtatgtgtttttttttctctaagccaatatgagtaagctacaggatatggcatcccttgacctcttaatatttcagtgtatttcctagaagcgaatgcattatcctatatagtcacagtgcctgtaaccacaccaggaagttagtattgccaccaggcctcacactgtgtgcagtgatgtttcacaggctcacccactgtatatagtgatatttctagtccccttcagtcaggaatggtcccttgcctttctgtctttcctgaccttgacccctccagagcatgcggccg

SEQ ID NO: 251059 - DNA, 535 bp, Homo sapiens
ctagtactataagcatgcacccccacacctagcttttattttatttttttgtaagatgggtcttgctatgttgcccaggctgctctagaactcctgggctcgagcgatcctcctgcactttagcctggggtaacagaacaagatcctgtctcagggaaaaaaaaaaaaaagaaactttcatagatcttcacccagatttccaaactgttaatactttgctgcatgtgttggtttccacctctattgtatgtgtttttttttctctaagccaatatgagtaagctacaggatatggcatcccttgacctcttaatatttcagtgtatttcctagaagcgaatgcattatcctatatagtcacagtgcctgtaaccacaccaggaagttagtattgccaccaggcctcacactgtgtgcagtgatgtttcacaggctcacccactgtatatagtgatatttctagtccccttcagtcaggaatggtcccttgcctttctgtctttcctgaccttgacccctccagagcatgcggccg

SEQ ID NO: 251060 - DNA, 685 bp, Homo sapiens
gctcggtacccaatcttttaccgcagtgtcaaatcatgatcctctcatatttttaaaggtaaacaaatgcatttctttgggagtcatggaataggtaaatgcaagtagaagagaaaaagcagatgtgacagtcaagggcagagagatgacagatactcagatttcatagattagcacagaacttctttcggcctttattaataagattgccctagcggtaaaagcttaagcttttaccgccaggtaccagataatcagtccatgaaattcaaaaacacacattcttctctaattcccacatgagagatcactgaactgggtaaaagcaacaaaacaggaattctatgggtggggttgaaacaatccctaggaaaaaatgcaaatctttcagactgatccatgattcctttatcatcatatacggctagttttatccagtgggagaaagcagatgcggtaaaagctttacagaggacacactatccagaaaagaatgaacaaagaacaggctgttgcaaaaatatttagtccctttacacatatagtcaaacttcattaatgcaaaaaaatgtagtggttattaaatgtctgaaagaatcagtatgtatgattgagatggttaatctctgagtataacacatattgttcatctcagagttgtttggttttaaagccgtggcggtaa

SEQ ID NO: 251061 - DNA, 353 bp, Homo sapiens
caggtcctggcgctggctgcatctccctactcacctggttgatgaggcccctttttctaattcacacaaaagcaccctgagctaacagcagctccagacctgcagaataggtaagcagacagatgggcaaagggccaggcacttcctcaccctaacccccagccctggcctccgggagagcaaaccaaagcccagaccctgacagaagagcctgaggaactggcaccgtggctcacagggagctggtcttccctgggacaccaggatgcagctaagagtttctcaaatctcaggagtttgagtccaaaagcctccctggagaatgaatgtccacaaaatatatcttacagaaa

SEQ ID NO: 251062 - DNA, 223 bp, Homo sapiens
tctctcttttatatgcaaaaattttagtaaaccttcagatgaagtgactgacacttttttacttgtcagtgaatttccatcatgaagagcagagagcattttctcctcgtgttgtgaggtgggtgctggttatccctgctgtgcaagtacattgtttctcagcttagacaagctgttttatcttgatttttccatctgtgtaaaggacagaatataaaccctg

SEQ ID NO: 251063 - DNA, 459 bp, Homo sapiens
ggtcaaagacggacccgggcgggagcggtctgggctggatatccggagagttctgctctccacgggatgttagaatttgaggcagtctgcctaaggaggcagagcagagaggcatgtgatcacccagatcgtctgagagcgggacattttcccggagcggggtggaaggagtgtcaaggtgactgtgagatgacagacacgtaggggagccccacagaggacccccaagacaccctctctgttgccatcagcctgagtcatcctctatctgaaaaacttccaggactgaagttcgaattggaagcacgcgttctccttggtgaagtccgtcctgtcccaggaggctgcgctaggtctctcctctggctccccctcctcgggtcctcgtggctctctgtcgtgtgaagcggggggtcaggagcgcacaaatgtttatactccacgtgagtcacttgcaca

SEQ ID NO: 251064 - DNA, 504 bp, Homo sapiens
aagattgtttttattccttttcagtcatttcagagaggcttcaggatggagttgtgataaacgcatgtgttcagtctacaatgtttaacagggagtgcctcttgattttttcatgtgaattactgaggagtaggtagtagactatcttgatgcccttcctcatgtccctttgactctgagttgacctgcagctgcagtgaacacttcctaaggatgctgatgtcttcccctatcaagcacttgcctcattctgcttctccgaggatttcctccagtacaccaagagcttgcccgacactcacaaggtatcctggaactgctggggactgaaaacccctcaacccatgaagaatgaggatcagtggattaatagcaactgtcccataccttggtgggactattataaggcattctggttggttcctcagaggtcccaaatgggattgaaccaaagttgcccacagtaaaaactcattcaccaacaaaaaaaacaacaacaaaaaa

SEQ ID NO: 251065 - DNA, 245 bp, Homo sapiens
tctgctgcccccatcacgccgttccgtgactgtcacacagaatccgcagacaggaagggagactcgagcgggagtgcggccagcgcctgcctcggccgtcagggaggactcccaggctcactcgaaggaggtgccaccatttcagctttggtagcttttcttcttcttttaaattttctaaagctcattaattgtctttgatgtttcttttgtgatgacaataaaataccctttttaagtcttgt

SEQ ID NO: 251066 - DNA, 622 bp, Homo sapiens
ggttctggttcttctcaatccaagtttctattgcatcctctctctcttccccttcacctcccaaaccactaccacctttaatatattactttcgctttttgtatttatcagtgattcaattttattttactgtgattttggtaaacatccgtagtgttcaactacttggcagatttgtccccctttttgtgataatagaactctaacacttcttggttacatcacatgttttactatctgatgattatgttggtcatcaatccttcttctgcaaggaacacaatataacaacattacaatgcatctttgttttgtttttgctgatttgggtagaacatagcaaaaataaaaatgcgttcattttctgtcattttggtaataaatctgaagccatgcttaacagaatagttttaagtttaaaatgaaataattttataaatattttacccttttaaaacaaggacgtctcagttcttatggcatcaagatgctcaaattaaattcacaaggctcttcaggaccaattatatcggtgtttaaccctcccagtgtcttttttgcatcttaatatcattgatttctttaccaataatgccaaatacagaaactacccctgcttata

SEQ ID NO: 251067 - DNA, 409 bp, Homo sapiens
agcatttaatggactagctggttcactgctgcctttccactcctgccctccatggtctgcagtatgccagtaaacaactaagtcactgaggcaaagtggtcatgcttcctctgaaactagagacctaaaaatccatgactgtcctattaatacggcaaatgtagtctcttgcttgggaaatacattcttggtagttaaagattttgtgatctacatgttactttagtgtttatattactgaaaacagtatgataagtagtaaaatataaatttggttgctagtatttatttgtgatctgtggctccccacttatgaacaactacttacaatataaaaataattacaaaagatagttcttaaagaatgaaaagtggtttcttttcattcatttattcttttcgaaagaat

SEQ ID NO: 251068 - DNA, 313 bp, Homo sapiens
agtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgct

SEQ ID NO: 251069 - DNA, 1639 bp, Homo sapiens
gtctggagggggctgaggtgctgggcaaccagcctgctcccacctgtgccgagcctcctcccgctatgggtacgatcgggtgggtgggagcacctgctggagagggttcaggggcccacccgcctaagggccctacccacctgggcacctttgtccacaggctccttgaacctgtatcatcccccagacccagagaaagaggtgtttccagccccaccagcaggtaccggcctcccctgagcccttgacgaggctgggagtgggtttgagtgtgcaggcccatcttgcccctgccccgtccctaagtgggagcctgaaggcatggcctctgctccccatgcttcacacaggtcccccagatgagccccaaagacaagctctgtgtcatccatcacccagccagggccccaaagcaatatctatgtcgtcccccaaaggggccccccaatggcaaggttcttgtggcatctcccaaacaggcccccaggcttgggctgggcccctcaggcagcagctgctctcagggcacccgcctgccgcccacaggtttccagatggccccatgcgggtgcttcttcgacccccgcatctatcggatcgagtggaccacccccgactgggccagtcagccctgtataagctggcagcaagcagcggggggccagcgggggtcccctccgccccaggcagctacctcctggagcctcagccctacctcaaggccccggggctgcctccatacccccactaccagcaggcacccggggggccccagtttctcttgccctacttcccgcctgagggccccgggccagaggctctgggttttgtgggggacgcagggcccgccgccttcgtggagctgcccctaccgcccctagaggaaggcccggccccgctgccacccccaccccccaaggagaacaagccgccccctgtactcatcacgctgcctgcagagcccacactgcccccagacgcctacagccacctccagggtcacctcggccacttccctgggcccgaacccctggccttccccgtcaaggagctgcagggcagtggggcccgacctggggtgcccctgtacccaccgggcctcagcgagctcaaggtggccgaggtcaaggagggggccctgctgggagcaggcaaggccaaggcccccaagacggccagagctttggcactgcctgacaaggttctgctggaggacgccatgaagctcttcgactgcctgccaggcgcctctgagcctgagggtaccctgtgcgaggtccctgggccggccctgcctgacagcagtggtgggaactcagccgatgacatccgctcgctgtgcctgcccgaggagctgctgtcctttgactacagcgtgcctgagatcctggacaccgtgtccaacgttgactacttcttcaacttcaaggcgctcgacgaggagcagccgccccacccggggccccctgccaccaacaccccggcccccattctgtctggcaagagaaaggcctcgacggccaagaagggaaagccgggaaggaaggccaggcagccggcaggcccagccagcgccactcccccggggcccagggaggacctgggagccaccccgcattaaagcacatttgacctttca

SEQ ID NO: 251070 - DNA, 3134 bp, Homo sapiens
gtctggagggggctgaggtgctgggcaaccagcctgctcccacctgtgccgagcctcctcccgctatgggtacgatcgggtgggtgggagcacctgctggagagggttcaggggcccacccgcctaagggccctacccacctgggcacctttgtccacaggctccttgaacctgtatcatcccccagacccagagaaagaggtgtttccagccccaccagcaggtaccggcctcccctgagcccttgacgaggctgggagtgggtttgagtgtgcaggcccatcttgcccctgccccgtccctaagtgggagcctgaaggcatggcctctgctccccatgcttcacacaggtcccccagatgagccccaaagacaagctctgtgtcatccatcacccagccagggccccaaagcaatatctatgtcgtcccccaaaggggccccccaatggcaaggttcttgtggcatctcccaaacaggcccccaggcttgggctgggcccctcaggcagcagctgctctcagggcacccgcctgccgcccacaggtttccagatggccccatgcgggtgcttcttcgacccccgcatctatcggatcgagtggaccacccccgactgggccagtcagccctgtataagctggcagcaagcagcggggggccagcgggggtcccctccgccccaggcagctacctcctggagcctcagccctacctcaaggccccggggctgcctccatacccccactaccagcaggcacccggggggccccagtttctcttgccctacttcccgcctgagggccccgggccagaggctctgggttttgtgggggacgcagggcccgccgccttcgtggagctgcccctaccgcccctagaggaaggcccggccccgctgccacccccaccccccaaggagaacaagccgccccctgtactcatcacgctgcctgcagagcccacactgcccccagacgcctacagccacctccagggtcacctcggccacttccctgggcccgaacccctggccttccccgtcaaggagctgcagggcagtggggcccgacctggggtgcccctgtacccaccgggcctcagcgagctcaaggtggccgaggtcaaggagggggccctgctgggagcaggcaaggccaaggcccccaagacggccagagctttggcactgcctgacaaggttctgctggaggacgccatgaagctcttcgactgcctgccaggcgcctctgagcctgagggtaccctgtgcgaggtccctgggccggccctgcctgacagcagtggtgggaactcagccgatgacatccgctcgctgtgcctgcccgaggagctgctgtcctttgactacagcgtgcctgagatcctggacaccgtgtccaacgttgactacttcttcaacttcaaggcgctcgacgaggagcagccgccccacccggggccccctgccaccaacaccccggcccccattctgtctggcaagagaaaggcctcgacggccaagaagggaaagccgggaaggaaggccaggcagccggcaggcccagccagcgccactcccccggggcccagggaggacctgggagccaccccgcattaaagcacatttgacctttcaaaaaaaaaaaaaaaaaaaaaaaaaaaaaaaaaaaacaaaaaaaccccgcagaggcctcataatgtgcggcgggggcgggaaacaagcggagaaaaggaaagcgggccaagtgggcaccaacagcggcggtccacgcggcccacacacattatcgtggtgcacaccaaggggggaaaacattcggcgcgggatccccccaatatagaggaagagagcgcgaatatataaaactcgcgagagaaaacgccgaggggtaacccgcggggatatcagaggaaccgcccggaaaaaaaaagacaagaccgacacacgaccacacacacgacgaccgacaaagacaaaaacccaaaaagaagacaagagacaaagaggacacaaaacaacacaaacctcaagaggacaaacaaaacaacagacggagagaaaaagagaaaacaaaacgaacaacaatacacacgaacaagcaacaagacacaccagcgacaccgcacaaagacacacccacagccacagaaaacaaaacagaaacacaaagaagggacccccgcaccacaaaacgaacacaacaccaccacagacaagcaccgaggaagaggagcgggagaggagagagagagggggaggcggcgggagacgcggaggcaaggagaagggacggaggcacagaagcagagagacaacgaagcgaacggcagagcacgacgcgcgagcggaggaggcgcaggaggcgcgcagggaggagagggacagacggcgggcggagggagcagagacggcagagagcacgcaagcaagaaggcgagagggaagagaggagagagagggaggaggaggcagagagacgcgaggagcgagagagggcggacgggcgccgggcgcagggggccggcagagcgcgacggcggagggcgagaggggaggcgcgggcaggcaggcggagcgacagcacaagagcacaaggcagcgcgagcggaagcagagaggcgacgccggacaggaagggagagaaggcgggggacaaaaccagccgggggagaacaggggggaggcaggaaagagcgcacaaggcaggcgcaagggcgagggagagaggcgcagggggggaagcaagggagagggagcgaaggagagaaaggaaggccgcccagcggcaaagaggacggcagacgaagcaacggagcgaaccaacaggcagacacgagcaggacgacgccaagcacgagaggaacagcaggcaggaagagcagcacaaacaacaagaacgaaagagaaggaggagcaaagggaggaggaagcggcaggggaacgcaaccaaagaaccgagaggagcgagacacgggacagaggaagcgaacgcagagcgagaagcgacccagacacaagagcgagccaacagaacaacgacgagcaaagcagacaacggacagacaaccaaagacagcaaggaaggcgagacacaggcaagcagcagagcgaaaagacacacaggacgacg

SEQ ID NO: 251071 - DNA, 363 bp, Homo sapiens
gagcaggttcaggagctgggccaagtttcacacgaagagacttggagtatctggagaaggtttttgaagacgtttaggagggagggtgagttttctgctgagaaactcaatctgccatacagtagcggccccatctgggatctgtcactgctgacagcaccagagggcacagccgtgatcttctgcacagcctgcactccccgaaataccctccttaatcaaaggatgtctgcgcgcctgagctcagctgaccgcgccgggagcaccagggccgttggattccaccccagcccgccccctccccacgcacacagccacggcccctcgcgtcttcgcggcacgttaattaaatgcggaaaacag

SEQ ID NO: 251072 - DNA, 209 bp, Homo sapiens
gtatgcattgtaatttttattgaaagctgtacatcgtatgtagcatagtatagacaaaggcaaatagattttatgcctggaaacgagtctccctttctttcctttttcgtttcttttcctttctcacttgaacctggaaagcagaagttgtagtgagctgagatcgcaccattgcatgacagcctgggtgacagagtgagactgtctca

SEQ ID NO: 251073 - DNA, 469 bp, Homo sapiens
cattgattgctatctattcattctcacaacaactttaaggaaaatgcagccaagaggagatatactcccaggatgaagttgttctttgaagtttccttatctgcctaaagactggacctgccaaaaagaaaacaattactgctggtcccttccctgagttttcaataactgaactcacatgacaggaggaaacactgaagtcagtaaacactcctggatagacttgtcacaaaccactgtaggttctgtgggcccagcagattttgtcccaggcctttgtatgttcttcgagcccattgacttcccctaaaaatcatttactatgcccctaaaatcatccagacttcctcatctcccttttcccctaagaagggtgtataacctgtaccccattgcatagtggggtaatcactctgtgatcttccctcatgcacatcaataaatttatatgcttttttcttttaatctg

SEQ ID NO: 251074 - DNA, 491 bp, Homo sapiens
aatttgacctagttgacatttgtagaacatcccaccccaaaatggtacaatacacatttttaagtccatgtgaagcatttaccaagacagagcaataaatttaaaaggtaaggtgactcattctcatgtgattctaatttaattcattagaaatcaattacattagaaataaataacatgaaaatatgtggaaaataccaaatatatggaaagtaataacacatttctaaataacccattagtcaaagaatgaatcaaaaaggaaatgaagcattttgaacttaatgaaaataaaaacacaactatatcaacatttgtgaaatgtccgtaaagtagttcttaaagagaaatttaaagtgctaaaggaatgcattagaaaagaagaaaagtctcaatgaatcagtttctaccttaagaagataggagtaggaaaaaatgaaatgcattataaacagcagaatgattggttcaaagcataaattaaatagaaa

SEQ ID NO: 251075 - DNA, 457 bp, Homo sapiens
ttgggaggtttctggttttttattaaaaaaaatcttaaaatgttataaatgatcatgtttattatagaaaatttgaagaatacaaaagaagtttgaagaaggaaatggaaataacccataatcctaccacccagaaaaggaaaaattatttttgatggaggagaatgactttaaaatattttaatttaacgtgaaagctgctggtccttgttgttcctagtctagaattaggactttataaactggtctttgcatgtcaaatctcttcttcaaactcatcttttatctcaggggtcagaaaacattgagagggtcaaatagtaaatattgtaggctatgttggctacctgtagtctccatcacatattctttgtctttattatttatgatccttttaaaatgtaaaaaaaaaatttagcttgcaggctgtacaaaaacaggcccacggaccatcatt

SEQ ID NO: 251076 - DNA, 279 bp, Homo sapiens
taaaattttagatgagcactttaattattggtttacttcttctcccaaatctgcaggtaaagccaacgctctggaaattgggccacatttattctgtgagttcatgtgtcccaagagcatatgaactcatctgaggagcaggcctgatattctggagtgaatgttttttgctctttcctgaaacatggccagaattgggtgtgccccgacatctgcaggctcattgtgctccttcttctgggtttcaattggatttcagtcctgagttctttttttttt

SEQ ID NO: 251077 - DNA, 276 bp, Homo sapiens
atatattttatatgttctagagatataatatatagatacataatatatctagatttttatgtattctaaacatatgtttatatattatatatgtagattttaaaaatatatttgaggcatataaaaatatattttatacattccagatttaagtcccttatgagatatataatttgcaaatgttttctcccattctttgggttaccttttcactttctacacagtgttctttgaagcatgcaagtttcaaattttaataaagttcagtttattttt

SEQ ID NO: 251078 - DNA, 367 bp, Homo sapiens
cctcgagaccgggagattattctggattgtctggtggacccactgtaatcacaaggttcatataagggaaatagggaagcaggagagtcggagaaggagatgggatgatggaggcagaggttggagtgatgcaattgctagctttgaaggtagaggaagagaccttaagccaaggaatgtgggtggcttctagaagctaaaaaaaggcaaacaaacaaacaaacaacaaccctgcaacagattcttccctagaccctccagaaggaacactgccttgctaacaccttgattttagcccagtaaaattcattttgaacttctaacctgcagaaccataagataataaatgtttgtcattttaaactac

SEQ ID NO: 251079 - DNA, 484 bp, Homo sapiens
cactgctgtgcgattttctctcaaacaatggccattatctgaaataacagttcaatgtcacagataacaggccaccgaaacaaattagtcaccacctcttgtcattttctctcccccaatccctcccttttgctactatttttgtttttaaatcaatattttgggaaaatatagttctactggatttacacgtttatttgcacttggagaaaacaaaaagtgggtggcacttgtgttatcccgtttgcagctaaagtttaaccgtcagcacactttccagcccctcttgccccacctctcccccgcaagtgtccctagactcgcttactttgcttaactttccattgttgagctggggagttggattttgtccatttgtttttatgaatggagttttgtgataaaaacgcgtttacttccatttagccagtgggatttactaaatcttacaaagttggccatgaataaatctgtagaccctttt

SEQ ID NO: 251080 - DNA, 365 bp, Homo sapiens
cagggtggtgaagtagcgttgctggctgtcctaagggccggtcttgccccagctttgtcaagggcttctctcttgaagcttcgtgtggattcatggctttcaagaacgtgttgtattttaggggactgctaaatcacttcccagaccaactagttacttctcacggtctaagagtggctttgaatttgctgtttgtatccactctcctccctcaccgtgcagagaatttatctttttttcaatactgctttaaagaatgtttacatagcactttctggagatttcaaggctgtcagtttgttacattttttaaaagttttattgaggtataattgctatacaataaaaatggcacatgtttaaaa

SEQ ID NO: 251081 - DNA, 453 bp, Homo sapiens
agtgatgagtatagcttaataccctcattggggaagaggagcaacgcccttttttggggaggggtatgtgttctgtggtgatggttttggggggcaattgtgggaaacctcagctgctccgctgaacccgtgtgcccacccagtgtgtctgtggctgtgaaatcccatgtcctcctgggtgctcacttggtgccttaaacttgagctccatggcccctccgggtggctgcttagctgagcataggtccagctcagaggtagaattcttaatgttcttgcctctgtcccagagtcccctcaatgtccacacctagaaatacagtttctcatcactggggtaacttgagaactcggtgaagaggttgccagttggggcaaagagaggcacgaaagcctggctgcattcagcttgtagcctgcggtggcctcgagcctcgctgggaagcagctgca

SEQ ID NO: 251082 - DNA, 361 bp, Homo sapiens
gaaaaatattttgcattacgtatagcacatgtcaatatttacaaaacttacacaaacataactttgtggacctataattttctaaaagtttggaaagtaggcgacacttaggattggaaaaggcatagctttgtgaataatttttttgctacctggaagctgcaatatattttgagctagaagcttctataagatatttcccttttctgaatgcaattgattatgctatactgcataatactacatttacctatatataatccagttaaagctgtattacatatttatagaagtcagactttggtctgaaatgccattatttataaacacaaatcagtgagtaattagtctactgtgtaaa

SEQ ID NO: 251083 - DNA, 153 bp, Homo sapiens
ccagaaatgtaaaatgatttaacctaatagaaacaaataacgacagagaagaatcagaggaatgatacaggagaagggacgttgaaatggggcttatttattaaaatgaaaatttttattgttctccttaaatctctgtggaagccaccctta

SEQ ID NO: 251084 - DNA, 387 bp, Homo sapiens
cacacacttagttgccagtatttgtgttcacagattttgtgagtcaaggattcagaaagggcacagcaggaacagctttgtaactccatgatgtctggggtttcagttgggaaaactcaaggttggaatcaacagttggtcagtggggtcatttgaagcggccacactatgatagccacaagtggctactgagcagttgaagtgaggccagtctgaatggagactagtgtgttgattgaaaataggactgtaagtataaaatgtgcatcagatttcgaagactttgtataaaaaaagaaactaaactatcttaatggtttttatattgattatattttagatagattaaactcaatgtattaaaattgaattttaatgtgactacta

SEQ ID NO: 251085 - DNA, 403 bp, Homo sapiens
tctttcatcacaccaaattacggataaatacaggcagtgcattgaagttgccaactttattcactgcattatctcaccgttatttgctttattaatgaatatggcactagacaaaatcaacaatgaaactaagggcttacccaactttaaattcttcctctttatcctctcttttttcctgtttaaattttttctccaataagtaaatctgcctgcagctctagaatgagtaaatctgtctgcagctagacaccaagaccattttcattatggttgaaaaagacaattgtaaaatgtagcttcatcataatctcacactgaagattttttgcatcatttttgctattatcattctaagaattacaaatcaaaagaatctacaccttaatgtgtcattatatag

SEQ ID NO: 251086 - DNA, 436 bp, Homo sapiens
gaccagttgatatacccacagctgccatgtaaggatgtgtgtggacttcactagggaagaacggtgttatgaaagaaggggcagaaaaactcacctgttggtctccatgtagacatttattgtcctgaattcctggaggttcagtgaaaagcagaagattgtcttttacacatgttgagttatgcccccatatatgtggttgtggtaaagaaagaggatgtgttgatgagaggtcctgaaatgcattttcctaatactcagcaggggcttctcaagaaggatcttccctaagaaagaagctcagagaacaaaaatggaaaaggattagatatggcactttcactggaaaaagtcatgttattcattgattgttttgtcatctccctccttaagtgttgtttttaggatgtggtaatctctgaccctgcctaacaca

SEQ ID NO: 251087 - DNA, 386 bp, Homo sapiens
cctcgtttttctcttttatattaatttaaccaatttctgtctttgcgtgtgcttaacaataataaactacatttttaggcatgtgctataatttaggctgtgttcggtttctccaccctcctgcctttgactctctattcataaatgattgttttagtaagttttgctttaaattgtgttattttagaaagaagctattttgcacatttgaggggtagcattgccttcgtccaatttcctgcttctccacaaggaccttgttcagttccataaagagattgtgcagtaggaaaaaagaccttttgtatcagggctttagaagtaattgacataaggaaaatctgcctaaaagaacataatgagcatgtctttaaataaacaaaccc

SEQ ID NO: 251088 - DNA, 544 bp, Homo sapiens
cctatgaatagctcttttcatgtttatgatatgttaatctttaaggtgttaataactctggctagcgttaaatttgacttttaggaaaaaacaccagagacttaaaggatactgatcattttcccttcctttttggaaggtagaaaattaatttaagcgccattttttaagcatgtttccatttgaccgcaaatagaactgactcctttttatcactcttttttatagtaggacaagaaactagatggtgtggaatgaagggaaagaaaggagtaataaatatggacttgtaatttaatgggtgatgatggccccttgtctggctggacagttgtcggacatcgggttaaagaaagaactctgaatttgagaagtgttcagtgaagaagggaagcaccttttaggagagagaaaaagaagggatcccttggaaaatgagataattctaatttgaaggaagaggaaaaattagccagtgacataagtatttaccatttaagtcaaataatttccttctctaccatctcgtttctggctttatgga

SEQ ID NO: 251089 - DNA, 496 bp, Homo sapiens
tcatccacctcctgccaaaatgaccaaagcttggccggcctcctggaggccgaaagcaggtggaagtgccaccaggtgcatgaggcagcagctcagagcagtgtgggattgtcctgggagcatgcgtgctgagttactgctttggacactgataccataatagcgaaactagattttggattacattttaataaaatagtgtgcactgcccagaaggcagatgtgctctgctgtattttccaaaagtaatgatgggaaaaataaagtgctgaaaattccatgggtagctgcaattaaagtcttagtgatagacaagtgattgtgtgtaatctgagacatctgggagctgatcaggaacatcagagccagaggagtggcgggtgcagcagctggcgcttgtcatcccagcactttgggaggttgtggcaggggggaatcacctgaggtcaggagtttgagaccagcctggccaacacggccaaatcccatctctact

SEQ ID NO: 251090 - DNA, 335 bp, Homo sapiens
gagagggagtctcagtctgttgcccaggctggagtgcaatggtgtgatcttggctcactgcaacctctgcctcccgggttcaagcaattcttctgcgttagcctccccagtaggtgggactacaggtgtatgccaccacacctggctgttttgtatttttagtacagatggggtttcaccatattggccaggctggtctcgaactcctgacctcattatctacctgcctcagcctcccaaagtgctaggattacaggtgtgagccaccacgtcctgcaacattaaatattttattaatttcatctttttcaagaaatccttcctggagtcttctt

SEQ ID NO: 251091 - DNA, 421 bp, Homo sapiens
attctgttgtgaaaataaataagtaaatacaaagatacatgttctgcctcacagaacttttgcaaactgcgaggatgtatcttacatttaaattttggtaattttttttctgtgcatctctttcaagtaaaatcttgtttttgttccagcatggtcctagttggaaagatatagagaaaaaaatgagaattttttttttgcaaaagaaaattgaaattctgtctatctcttaaactgctcctaccatgttttaagagggtctgttctgatcagcacaccaagtatttctaatgaattagggaagaaattaccattatgtctggtcatttatctgaagcttgctgccgaggatgcaagatagacatgtaatccacccttagccatattctccagctcccttcagtccggattgtgagtagag

SEQ ID NO: 251092 - DNA, 249 bp, Homo sapiens
ggttggggtagggacccagggatagatctctagaagggtctggattccctaggggcctgcgatgaaacttgcactctgtggaatagttccagggttgaggaggtaagcagaggccagaccgccctggaagtttgcgtaagggctgttctcctgggggtgctgagctgggagaaggcttgcctggggaggtggcggggccagagctagccagagctgtcctgcaggtccctgccatgctgagggtgatgc

SEQ ID NO: 251093 - DNA, 337 bp, Homo sapiens
tattcattctacactgacctagcatcaatgccagttctgcctagccaggtctgtgttaccagagagccaagtagagcagaggatcaaagaaggtaggtctggaactaaaaaatcgatcaggcaataacaaaaattgaatttccttccagctcaaaaactcagtgattctgtgattcttaagcatctatgaagtaccccatataagagaaacattttaacactgattttaggactttgggtactagcaagattccactgttattctgttctttagatagctaaagatatttagacagatgaacttttaaaacttgagtttacctagtttatcagtttc

SEQ ID NO: 251094 - DNA, 592 bp, Homo sapiens
ccaaattctgtcccatccacgtgtgtaacttttaagctccagcacccaaccttgaaaccatcctgttcctttcccgccttctcaacttcctttcctctcttttaaccccaacatacacaaaagagaagattttaataggttcctcctcacccataattgatttcaaatgttccctgaagttgcccagctgagtaaccacctgcagctccaagttgcaggagactgagtcactaagtccatggcagaattggagcctgagcccaggtttcttcatccgacaaatatttattgagtgccttccatgcaaagcacggcaaggccctgtggggagcacaaagatgtctaagaaactgtccctgacatgaagacaagttttcctcctctgaggatccgagcattagagtatatgcttgtgtagaacttgggaggcaggccaacctggcaacagattccatctctgacgcttatcagggctgtggtcttcagcgatccattgagcttttctatgccttcatttcctcaaatggaaaaaggagaaaaatatatgtatacaaaatatcattccatttaaataaaaatgaaaaaagctcca

SEQ ID NO: 251095 - DNA, 614 bp, Homo sapiens
ggggagctgctgctgactcattgttggaggtgagccacaataggaggcttagaaccccactctgcagcctctccaatctaataaggagatggtagtgtggtcggtgggggcatccacacgcagtcaaagggcacagggagtgatgtgtcccctggcctcctctttcagctgtagattctccctctgagttattggaacagcttctctatggccccatcagcctggagtgtggtgacagctcccagatgacgctaacaccagggacctgcgccatccctcatggttccccttggcccagcccacacctttgtaaacagctttttcttaatgatctttcagccacttcgaggtccctgccagcacctgactgccacattccccaaagggaccagactcctcggcacagtagctgaggtttctataggcacagagaaaacactgtcccaactgttggaatggagttgggagtggaaaaaagaatgttttttctcagtgcttagacttaccaattgcttcgttttatcacatgaaggctgtgtggcactttgaagtagaattagtaatttacataattacaaattatgtgttttttttgagatggagtctcactctct

SEQ ID NO: 251096 - DNA, 891 bp, Homo sapiens
tcaacttttattttaaattcagggaatacatgtgcaggtctcttaatggttatattgcatgatgctgaggtatggggtacaattgatcttgtcacccaggtagtgagcataattcccaataggtagtttttccttgcctctcactcttttgcagcccccagtgtctattgttcccatctttgtgtccatgcgtacccaatgcttagctcccacttttaagtgagaacatatatttacttttgttcctgtattaattcgcttaggataatggcctccagctttatccatgttgctgcaaagggcatacttttgggttttctttatggctgcatagtattccagggtgtatatgtaccacattttctttatccagtccaccgctgaagggcacctgacttgattccatgtctttgctattgtgtatagtgctgcgatgaacttatgagtgaatgcatcaaaaagaccaagttgaacttatgagcgaatgcatcaaaaagaccaagacttgatcccttgcccacaaagatacaaggctgaggacaaagccatgaaggaaaagcctcactgaagaagaggaacctaagagaagcaggttctgctctgatgaactcccataaaggcattcccataaaggtgtgggcctgagtgataatctagatatggtacagttgacatcaggtatatggcggcagccagaaattcaactttgtccatcagctctctgcacaacaggaaagatggtgaccttccaggcttatctgaggtccaagagtaacatcacaaacacagtaactacacccagccaaagaaaagcatacctgaatccaagagagtatttacactggcttcagggatgaggaaataaaggagtaagtgattaggatcattgtt

SEQ ID NO: 251097 - DNA, 332 bp, Homo sapiens
attaaacagatttttcctaagtgttaagagaagccattgaagaacctcagtgagaaagtggtataaagctcctgttgattgaagaacttgagtgagaaagtggtaataactcggcaagctgctcatatgtgtctggcctctccacttgctcttagctcctgagggcaaagcctgggcctcatcctcttgtggatccaggagagcagtcgctgaagagaaagaggaagaaaaggagtggctagaaaagaaagtttatttccactgcaggaagcactgcctcccatctgagaaatgtcccaagcaggaatcaggtaataagactctgaaaaatc

SEQ ID NO: 251098 - DNA, 442 bp, Homo sapiens
tctgtgagagctgctgtcagcttccagatggtgccttattgctgcatcctttaaggtgttgaaccctgtgtcttcacatggccaaaagaagagaagggtaaaaagagccttgctagttccctctagcccttttataaggtcataggaaatgaaacagactgctgttttcatgagaagcatttacagagggaaataaggacactcaccaaatagggctaatttgaagaaggacacagctgacttagtaggaagaaggcagaagaattatctcctggtaatcaagactctgaaaataagacttaagataaaagactggatacatgcaagaacagagttcttaaagatcaccagctgaagattgtgatttttcattcttctatgccctaagacagccatattttaccatttgaaacataaataaaaatgacttccaggcttaaaa

SEQ ID NO: 251099 - DNA, 337 bp, Homo sapiens
cggcctgttggccccagactgtgtggcaggcaaaaggtgaacgtcaaagcctgtccccggcttcttcacatctcgcgcctccgcgggcgtcgggccgcccccgtgagcctccccggatggactgggttttagggacccccgcagccggactgcaaagcttcccaccaacccttcccgcgaacctcccagcccgggccgcaagcccagctccgggcgcgacgacgtggggccggaggtagaaggagtctcagcgcggcgggggccggggggcggggaagcccccccacccacgagaaaggtcttacatcagccgccccacgtgcaatcggagagaggg

SEQ ID NO: 251100 - DNA, 574 bp, Homo sapiens
gccgaggcaggtggattgcttgagctcaggagtttgagatcagcctgggcaacatggtaaaagcccatctctacaaaaaatacaaaaactagccaggcttggtggcacacacctgtagtcccggctactcgggctgaggtgggaggatcccttgagcccaggatgcagaggttgcagtgacccaggattgccacagagtgagaccctgtctcaaaacaaacaaacaatgacaaaacaattaattataaagcaggtactcacggctgggcttggtggctcaagcctggccaggacacctgtccaggtgtccaccatatggggaacttcccatactacagtaggacatcatggggtcaccttgtaggggacatgctgtaaaactggaagattttcacgttgacccttccccttgtgggtttcttcctaataattcattgcctggaatagtttaggttcacccttccctgttagtggaagaatgtacagtggcttcatcactgcacttcagcctcaacctcctgggctcaagcagttgtcccacatcagcaccgccaagtagctgagaccacaggca

SEQ ID NO: 251101 - DNA, 385 bp, Homo sapiens
cgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctc

SEQ ID NO: 251102 - DNA, 224 bp, Homo sapiens
agggatgtgtagcaatcaaagggaaatgttatccttcctaggagataggatttatgggattcctggatcttttttgtgtctgattgttaaggtcttgacagcctttcaattgaggaatacggtcgtgtctgttaaactaattgtagctgttcactccactatataattttacaacatttcagcttcaaatagaatggcttcaataaacataaagcagactgaca

SEQ ID NO: 251103 - DNA, 282 bp, Homo sapiens
cttttttgtagtaagactatatagatttaataagcctcatgagacaaaatagaagcagctcacttttgaaaacacattctttctgggatcagtataccacagtatctttttagagtagcagcgaatatgataaatcataatgcattccagacatgaacagtttactctcatattttccataaaaagctccacaaaagagtttttattttttttcccaaatgtaccaaggtaatgaacattccctgtaaaatactgaggctttgcaaagaaatgtcaaaacaa

SEQ ID NO: 251104 - DNA, 378 bp, Homo sapiens
atcattcacccggggcctccctattccaggagacatttggtgaatatatctcctgtcctgtctcattcagtcattgacagactgatgattagggtctcaacttttccagttaatcaaggcagtgtgggtcaataaaaatggagcaaaccgatatacatttctacacatctcaggggagaatagaatttcaccctaacaaggccagaagattgtggtacctgtcttctctccatctccctatacccgctttccctgcatttttctcccatttatgtactgttcatctcccttccccccgaaagaatgttttgctcactgttgtatcacaaatgcctgggatacacagcaagtgctcaataaaaattgtttgggccagga

SEQ ID NO: 251105 - DNA, 414 bp, Homo sapiens
tgattttaaaagatttgtccactatgaagttagtagtgtgggatttagttttccccttgagaaatctgttacttacaataaagttcatctttttttgttaataaagtttatctttaaagctgattaaaatttttctcacaggagatttgaataattcacattgtaatactcatttaacctcgtatatatttattaaaattatctccacttaatagtaggaaaatataaagatttataaaattatgattttgtttgtgaaacattttgaaactcagtaattagagtcacctgatttatggcctaatttttttactctgtgatatcccacattttgatttaaaattggtggaggaatgagcagaaagtgattttgtaaaacaagagaggggaaatattaaggataataaggataat

SEQ ID NO: 251106 - DNA, 431 bp, Homo sapiens
agccaagagacctgtataaagcttgtagttagagtcgtttcgatactggcctgaattaagagcagtctccatggggttgctgtctgtggggtacgtgtttaatgaaaatccttgtttttaaataaatgtatcctgctttagaacacccaagatataaaatctagacttcatagacaaaaatagctaacatttgttgtgtatcacagtgtgccaggtgggctctaagagatgtttgatttctttaatccttccagctgccctgtgggctgggggccatccctaccctcattttacagacgaagaaactgaggctgggagaggtcaattaacttgctcaaatttggtataggcaaaactaggaattggcagacggtggttccagtgcctgccttttaattggtacttgaattatacgagtgttttcttccatc

SEQ ID NO: 251107 - DNA, 326 bp, Homo sapiens
cttccagctgtgcctctgctgccagccaagtcttcatttggggccaaaggggaaacttttttttggagaaggcgtcttgctttgatcacaccactgcactccattctgggcaacatagcaaaatcctgtctcaaaaatatttatcagtaggaaatgcaggagggcacagtggctcatgcctgtaatgccaacgctctgggaggccaaggcaggaggatcactggaggccaggattcaaggccacagcgagcaatgactatgcctctgtactctagccggagtggcagagcaaggccctgactctagaaaataaaaattaaaatggt

SEQ ID NO: 251108 - DNA, 337 bp, Homo sapiens
gaaaaaagaaaaaagaaacagcaaatatttctttctcacattcctggaggctgaaaagtccaggatccaggtgcggcatggttgggttctggggaggtcctgcttctgggctgcagaccgccgccttctcactgtgtccgtggtggaaagagtgggagagggtgagagctttctctggggactctttgatgagggcactaaacccattcatgagggctccactcaccttccatcactttgggcgttaggatttcaacatatgaattttggaggcggacacgttcagaccatagcacttccctttcccaattatgacaataaaatatcttcaaacatt

SEQ ID NO: 251109 - DNA, 383 bp, Homo sapiens
gtctgtccaacttagtattttgatctcacccctcgtcatggctttcccgtccctatacaagccagtctaatgacacagggagctgaaatggagaggggtatggtcagcaatttgattactcctgttccctcaactgagagtaggaggttgatatggccttcttctagcacaactcctcctcactcttcttctaatttcttttttctcttatatgggtacagtggtgtgctaaagccagctcctaccaattcattagagctgcttgttgaattttcagcaattttgtgagatgtttattaaacactcaccattaaaaattaaattatgtaaacttaaaattcaatggcataccaaaaataaagataatactcaaaactcaaaaa

SEQ ID NO: 251110 - DNA, 320 bp, Homo sapiens
ctcaaaaaagaaaaaaaaaaaggaaaagcccccttttcctttcccagcacgttgtcatctcagtatagacagcagaagtcaaaaacagcccagtcagggtgaggccaccagggatttgagagtagccaatgtgcgtaaacctagccgggacagagtagcaaagtggctggccaggccgcgaaccaggacggtgccagctcaggttcccacactcaacacggaactcaggactttgcttgtgacgggcttagctgaatggcttcttgatcctttctcatgctgcaggagcagaaagagccaactatccgacacaccatggc

SEQ ID NO: 251111 - DNA, 496 bp, Homo sapiens
ctacacagcagaattagattctctggtttaccagactcttttgcaatactctggtgccaggcagcaaatatccggcaaatatagactgcattgatcctcctgaccttagtgacattattacttccatgttacagatggggaagctgaggcatggagtggcaaagtgacttccctcagggcactggccggtatctgcacccagctttggggctgttggccatgctcctgtctaaccgcccctccccaaatccatccctgttttctaaggtgggagaaaagggaaatgcaggccaggcaccctcctaggctgggcggcagggttcctgccatggtacagctctgtgcacagccgcccttccacccccggtcagtctgagcccgaggcaccttctgggctgggccaaccacttccacaccaagccagtgtttagtttatacttgaattttggtttttacctttttaaaaaaaaataaattcttgatataaatttatgga

SEQ ID NO: 251112 - DNA, 417 bp, Homo sapiens
cccccccttgccagcctgaacactgcctacacatattttgattagttcagctttaaattactagtaacttttaaaaacagacttttttagcagtaggcagcaataattctttgattattccagtgttattcagaatttctcagcatgttttcggaaggaaaaataccatgttttaattatttagttaattctttatatattttttatgttcaggagtacacttgagtccttagagttgactcaaagacttgctggtaaaggaagctgacacagatttacgaaaccttccttgacgaccctttaaaattttttaataggtagataaccatcctagaaatttgctgctttatggagtaagttggagaattgttgatattattgtgagtttgtgtgtgtgtgtgtttaaaaacaaaaaga

SEQ ID NO: 251113 - DNA, 397 bp, Homo sapiens
aatgaccaggggcaagaaactggaaagacaccatgagatccaatcccaaaaccagagggcagagttctggtgccaaaattggccttgaggccttgccctgctacaggcctgtcatcaccaagccagcttggacaggtgcttggctggacagccagcagtcagagtcatttcagctgggatggaaataaatctgagggtagattgtggccagacaccggccaagcttcttatctagtcaatctgagtgttctgtaagcgtgtgaaaaacattctcagagattaaaatggactttttaaataagtggctctaggaaaacaggcaggcatttgaaaaaaattagagctcacaccatacacaaaaataaactccaaataagtcagagatctaaatgtaaaa

SEQ ID NO: 251114 - DNA, 275 bp, Homo sapiens
ctttatcttcaaagttagaataaaagcttgtatgacttggagtgggaaaaaactttatcagcaagatcattaataacttgggactcagcttttcaagttacaattagctgctcaacagctgtgaccttcaagagctactcattattgttggtcctgattgttcactcccactgtagagctcttttcagaaatagtttctctgacatcattgaccccaggggtcagagtgagaaatgagtcttcaagtactcatttgtaagtcttgtttctgcagg

SEQ ID NO: 251115 - DNA, 461 bp, Homo sapiens
cactgcccagcttatgaggacaaatggctctttttatattccagcaaccacggaactctctggagtgcccagggctgttttaggacatcctaaactgctactttcatgccaagtttggaggactgtcttctgaaatatcttttataaaaacaaatttaatgcaaaagcacgtaagtctacatgaaaccctcccagcacgggttttccagccaaatggtaggggcatacatagaaaaatgaaacatttgtggttgtgttttcaaggcagaaaagatgctgaagggaaaagtctatgttcgaaacataatcccagaataaaaagctccaagaaatgcagttttgaggaagtattatctaaacaaagagatgtattaatataattgatgtgcaatatttattcagtgttaatcttttcattaaaatgcatcctgagttttcataaattctggcagatttaatta

SEQ ID NO: 251116 - DNA, 731 bp, Homo sapiens
gaatggttttcacgttaacacatatatgtctgtcttttttttggagctccttgctgtagtacctttttaaaaaagagttgtataatattccattatatggaactgccctgatttacttaaccattcccttatttatttacatttttcactattacaaataagcctggattgaacattcttgggcacttatatttctgaacttgagcaagtgtttttattggatagagccctaaaaaagtgaaactgattggtcaaagattaggtacatataaaattttgctagctgctgccaaattgtcctccagaaaggttgaaccaatttatgaaacttgacatttcaagaaattgtatgtgtttcccatctacctaataaagaaacggtccacaccattaatatagttctgaatgcactgaaatataattgtatatgtctttcccactagattggtacttccttggggataggaatcatgaatttctaaactttagcatcccattgtttgcttaaataaaccttgaaatacaaaaatgaaaagaaagtactgtctttgtccataagtggctcacagcccagtaaaggaatccacagtcttatctatattcatgctctttactacaatgactagaatatggtatgtaccctgtaaatcattattgtataactaaaagcgtttctttttatttgtctaaaaatgaactcactttctattttaggcattgcctgttggaag

SEQ ID NO: 251117 - DNA, 769 bp, Homo sapiens
tccttctgccacgcagggaagcatcctgtagaataataccgacattaaaactttaatgagccgggctcgccagcttacccttcctgtgcagagatgtgtctaggggtggacgctgagatgttctgcttgaggtacatcagagaggggatgtggggcatggatggacatctctcgtagaaagtcctcacctttgccagccctctgctgttgtcaaagaatgtattacttttcaggaatgagccctatgtatgtataagcgtgagcaattcttttcagctattgactttttatccctagacgagttgttagctgggaagaaaaataccttctgatgcaaattagtggtggtgtttcttctcagtgtaactggtgtctacaggactacctgagacactgaattaaatgtgcggattgaaaagaaattcctgtgattttttttcatattgtatgctgatacagaagttgaaaccaatttagcttgtcatgagatattctcgttacagcctatcttttttcctgttgtaaaagtaatacaagtaaattgttaataaagatagaatcattttagttactggtttaggtataaaaggaaagtgtaaccatgtctagcaacattagtggaattatttctgattttgcacccaattctgattttcccatgattcgaatggcacatacattctagcacacggttttcaccaggtcatcagacggtagtaccaatcaactggtcagccatagccggtaacttcacagacgtgactatgga

SEQ ID NO: 251118 - DNA, 397 bp, Homo sapiens
ctggtgtctacaggactacctgagacactgaattaaatgtgcggattgaaaagaaattcctgtgattttttttcatattgtatgctgatacagaagttgaaaccaatttagcttgtcatgagatattctcgttacagcctatcttttttcctgttgtaaaagtaatacaagtaaattgttaataaagatagaatcattttagttactggtttaggtataaaaggaaagtgtaaccatgtctagcaacattagtggaattatttctgattttgcacccaattctgattttcccatgattcgaatggcacatacattctagcacacattttgcaaaggaatattaggattcagtcatatttcttgctttgtaggtaacttagagcgtggcgtacacatt

SEQ ID NO: 251119 - DNA, 263 bp, Homo sapiens
cctgttggcaacgtcaggacttatcaaagacacacaacttcaatgagaacctttctttggaattaattaattaatgatatggagccttgatctgtcactcaggctggagtgcagtggcactatttcagctcactaggaatgcatctttctcttctctttctccacctcccaggagaatcacttgaacccaggaggcggccgtgtcagtgagcctagatcacaccactgcactccagcctggaagacagaggaagactccatct

SEQ ID NO: 251120 - DNA, 257 bp, Homo sapiens
cctgttggcaacgtcaggacttatcaaagacacacaacttcaatgagaacctttctttggaattaattaattaatgatatggagccttgatctgtcactcaggctggagtgcagtggcactatttcagctcactaggaatgcatctttctcttctctttctccacctcccaggtttaagcacttctcctgcctcagcctcccgagtagctgggactgcaggcacaagccaccatgctgagctaatttttgtattttt

SEQ ID NO: 251121 - DNA, 327 bp, Homo sapiens
gattatatgctgttatggtagaattgtaactgaactagaatgataatcacccagggtggatcagctagctatgtgactgatgggatttggggtctcttattttaaggagcggatttaggtccctaaaagtccaaaaagatagactgtgtagacatggtgaactgactttcaacatccattccaaacacttcctcatactgcagaggctgcaaagataaaaactatttcccagactcccatgcagctaacattccgcatacaagttggagtctaccccatcaatggatgaaaaaataaagaaaatgtatttataaatgatggaatact

SEQ ID NO: 251122 - DNA, 234 bp, Homo sapiens
tgtataaaagtcttaaggcagatgttcacttctcttggttaactccctagaagtggaacagctggatcatatggcacatatatgtttaacttgtgtaggaagggagaaaaaggagggattacaggcacgaggaaacgtttcagggtgacggatacgttcaatattgtaatactggcaatggtttcatgggtgtaaaaatgtcaaaatttatcaaactgtacacttcccttttcc

SEQ ID NO: 251123 - DNA, 359 bp, Homo sapiens
gattataccagctgaaatcctgccagtttttactgaagggacaaagatgggacaaagtgaagaaagactgttggacttcttggacttgacaggacaatagggctttttggctgcaaacattcactattcttccaagagggaagttatcagggctactgccacagtttcaacaggtcagacaacctctgttcagagccttgagggcaggactgtcctggagtgatgtaagggtggggtttcctatagccttgggattcggacactggcctacagttatggaggtggtgctgccacacttgatcttggactttctctcctccagaattagaaaataaatttatgtttaagtcattcagtct

SEQ ID NO: 251124 - DNA, 416 bp, Homo sapiens
cactcacacatactcagggaaagatctcttcctaagtgacactttaatgaatctcttcataaatataataactcctaaagtttctagagcacacttttcattaatgtcactaattatgtaatgaaatgccatctaacgtttagaattttgtgacatttcatgtaaagaaatttacaaatctgaaaaatttttaccaaactatgagtctcaatttggattcctaaaaagatggtcaacattcttataaaaggtccctggacctcgtgggatgggatccctgatcaactagagacgctgcagagaggaccagcctggctccaccctgttaaaatccctatgtaacatttagagcgtgagctgctcagagcaaggataacaacttgccatttctgtttttaaaatgttgtcgtagtaaa

SEQ ID NO: 251125 - DNA, 445 bp, Homo sapiens
aagttatttgtagtatattaattcagcagatatttattgaccatgtagtaaatgccaagcactgtgcttcagaactgggtatttacagcttatagattccaattaattttttatgggaaaaataactgaaaagttttttgggtttttcttcagccatgagaaatgttctattttatttcttctttgggactatctgaagtgaaaataaaaaacaaacaaaaaacacctaaagggctgttaatattctagaatttttctagttatcttgctacttttgcaaagaatgatcttttgtcaaatcagaatataaagtttgtggtttaagtttcagggtttttttttttcattgtcaatattcaatataagaattttctgtttttaaagggggaaataccaaactgtgtaccactaagaaaatgatgaaatgaaaaaattgttttaacct

SEQ ID NO: 251126 - DNA, 353 bp, Homo sapiens
aaaagcatatcaatcttaaaatgaacagaaaaactgggttcactgcatctgaattaaatgtccgtaagtccaaaaaaatttcaagagagatgtccccttataacagagcccatctaatcctgtaggttctaactgtctgcaaagcagctgaagcagtgatttgcatcttttttttttaaaaacgtatcagagtgtgcatgcacttgtttgcaaggaagccatgcccacggctccccaccactgcccttgagaactgggaagcagtcattcctttgctggttttctcaggaggcctgttgtgttgtggtatggcttccttgcaaacaagtacatgcccactctgatacgttttt

SEQ ID NO: 251127 - DNA, 376 bp, Homo sapiens
aggcaaagagcaggcatagaatagggggcctggaaatctaccagatctaagtcacagaacagtcagtgtaaatacccagagacattccttgagacacagaggggcacagacacagcaagagaactgggcaggaggcaaagtccacatcatgattagctgtaatgcttcctcaggaagacaagaactcctcacagcagaaacacagggcagagaaatttttctgcccaacagtttgaacggtcaccctgcttcaacatgacaaaacaagccaacgaaaatattttactcaggacaagttttcaaaaagcataaatgcattttttaatggtttagacttttatttgaatacaaaatgaagtctcttactggtgaataa

SEQ ID NO: 251128 - DNA, 495 bp, Homo sapiens
gaccttaatcaccataggtttcattattaaatcagatgaatggaggaggttaggtaaaagtgaccatccttcttcagtcttactcaccactcataaagagaccatggtgggccagaggatggggtgcaaaatactggacaagagctgcattgtccattatggtagtcacattttagttgctgagtagctccatgttgctagtggcaatcctactggacagcacagatatagaacattcctgttatcactaatagttctgttgggtaacactattccagagagtttgggttcagaattagagtatataaaaaagcagttaaaagtatgaatagctttggaagttggccatggcagcagccttcttctctgttgttgcttttgttggttcattggtttttgagagagtcttcctctggttggagcacagtgggttgatcacagcgtcttccgcccgtacctccatctcaagcaagggagcaaacgaacaaaaaaaaa

SEQ ID NO: 251129 - DNA, 800 bp, Homo sapiens
cgcaataaacatacatgtgcatgtgtctttatagtagaatgatttatgatcctttgggtatatacccagtaatgggattgctgagtcaaatggtatttctagttctagatccttaaggaatagccacactatctttcacaatgggtgaactaatttacattcccgccaacagtataaaagtgttcctatttccccacatcctctctagcatctgttgtttcctaactttttaatgttcagatttttctttcaaggagagtagaccaacgtgtgcactgccagctgtgagaatccctccctggcatggagggttggactggcatggacaagagaagcaagccaactggacttgttcccccaggggtgtgtcgctgggacccagcaaatccacaattccagtcttccctgctgtatggcggatatggatggaaagcagcaaggccttgcctgccaagtgggagatggcgagggaggcacgtggcaggaagcagggatgaatcacacctctccaccgaggtggagcactcctttctcatggccatacaataccttaattttgctcttcatgttggagcaaaaataactctgcccttggatttcataaaatagacttggatgtttctaatattcctgccatcccccgtttttattttgtttgcctaaattagctccagtgaatttctgttcaatacaacccaatcacccccaaataagacagaaataaaacaaaatgggatggagggaatatatgaaatgttaataatttgaaaataaatagatttgaaacatcagattgtagc

SEQ ID NO: 251130 - DNA, 509 bp, Homo sapiens
cagttaataaaagagagagaatggaaggtggaaagaagggagaagccaaggtgtttctcaccagcaccctccccttctcctctcaggtaacatcccctgtggtggccacagctctccgatgggtccagttcccacaggaaagccagccatgattctaacttctaccaggtgaccctggccctgggctctggtgacactaaccttttgtttctctagtcctggggaggggtagtaacagcttcctgctattattaatttatggattgcctcattgcctcctgtgaggcttctcagctattgattaccatactactcagcaataaaaaggaaaaaactattgatacatgcaacaactttgtcggaccacaagagaattttaccaactaaaaaagccagtctcacattgttacatactatatgattccacttacataaccttctagaaatgacaaaattattgaggtgaagaacagattagtggttgccaagggttaaagacagggttgggg

SEQ ID NO: 251131 - DNA, 323 bp, Homo sapiens
gggtcgtgcagtccctggcttacacccagggtgcgtgtcacccccacgaggggcaccagaaagcgtcaagaaaacccccgagggaaaggaacaggagggacagcctttaaaggggaagatgaggcagtccgggaaaaaacttcccacggaaaacagtgcctgtccagccgaccctgggccgggatttgggaagtcgtggagtccttgacttgcacccagggggcatgccgtgctcatggggacaccccaaagtggcaagaaggcctctgggggaagggaacaggacgccaatcttaataggggacattgaggcaacacggaaa

SEQ ID NO: 251132 - DNA, 1226 bp, Homo sapiens
taaaatatacagtaggccaggcatggcggctcatacctgcaatcccagagctttgggaggctaaggccacaggagtacttgaggccaggagtttgaggccaccttgggcaacatagtgagacctcatctctactaaaaataaaaaattagccagacagggtggtgcatgcctgtagtctcagctacttgggaggctgaggtgggaggactgcttgagcctgggagtccaacacttcagtgagctatgattgcaccactgcactcaagcctagacaacagattgagaccctgtctctaaaaaaaaataataaaaattaaaacacaaacaaacaaaacaagcaaacaaaacaagtcaaggcagtttttatagaaactgacattgtagccaggtgcagtggctcacacctttgggggccgaggcaggcagatcacttgaggtcaggtgtccgagaccagcttggccaacatggtgaaaccctatctctactaaaaatacaaaaattagccgggcatggtggtgtgcgcctgtaatcccagctacttgggaggctgaagcaggagattgcttgaacctgggaggcagaaattgcagtcagctgagatcattccactgcactccagcttgggtgagagagtgagactccatctcaatgaataaataaatgaataaataaaccgacattggtaaagaggttatctttagttgggccttaaagacaatggagtggacactgtctgttggctccatagctaacattcattacttgccttcccattactaacagcgtccagactttaacttggataacatatatgctttaccataagctcaagtactttagggaaagctgatcccacttcaagcttcagtcggggagttggggaggggtctgtggcttgtttaaaaacaaacattggtacattcaatttcccctgcttacatcatttttcggttgagggtggggatggggaatgggaaggggagaacacgacccaaccagggtgaatttcaggacccttgtttgaaatgccagctaagaaatgtctgggaaaacaccaggaagagaaaacatctctgttcctccaacaccatgttgtatgcatgtgaagcctggaaccagtagagtcattttgctagatgtaagctgagggccaaggaaatatatggaggaggttactgccaagatactgtccaaatttccaattctcttataaaagttttttcc

SEQ ID NO: 251133 - DNA, 447 bp, Homo sapiens
ctgcaaagaaacagaagtagagccactggatcaagccaacgtgaagcctgtcttactgctggaccaatatattttcttactgtttaactcagtttaagttttgttggtttgttttgttttatgtagttgaaagccttctgatttagatgggtacatttcaaataagtaaagaagttagattgttccagaaacaagtagtactcaagaaatgcaagtaagttagaaagccctggaagataaaaagtagaacaatattttgaagatggagggtgtatacaatgtaatggtaaactgtaaaaagtgtacaaaaaaaaatggttcagaggcagatgcagaaaaatgtaaaacttgagctatggattttggaccttttgtaggcaaggtcagttaatgggttttgactggggaatgtaaaaacaataaacatttactggctacttattatgt

SEQ ID NO: 251134 - DNA, 375 bp, Homo sapiens
gatatggagtctcgctctgtctcccaggctggagtgcagtggcttgatctctgctcactgcaagctccgcctcccgggttcccgctctgacactttctactcctgttacctttgaaaaggccttttgcttcttgggcttcagtctttttaaacaccgaatcagtggtttttaaactaggttttgctgaatccctcaggatcagtgagtgataagggggaaaaaagagaaggctgaaggggcaagtggaataaagtcattttaatctatttctggttaatttcttttgaaagaagagtttagtttctaaaacaaaaatagttcaaaaaccactggactagaagttacctaaatccccttctggctgaacacttctg

SEQ ID NO: 251135 - DNA, 139 bp, Homo sapiens
attcaatgctggatttcatgtagagcagaatatgctaatgaaatgtaaatgtctacggcaaacattgcgtaatatagaaaaccttcaaaactgagctttgtctcttgcacggtgggaaaccaaactttattacatcaga

SEQ ID NO: 251136 - DNA, 494 bp, Homo sapiens
caactattgttttccgttttcatcacgagcgccactttccccctatttgttcaccgcctccactccacaagaactgctcttgacttggccaactttctgggacaccctcactacaaggatttatgagtcaaacaggtttttgtgctagcctggaaatctaactgctgacagcagttgtttcaagaagaaaatgctgttttggaaccaaacagcaggctgccaactgaaacaacataaacccacctccaagttcaaatgaaacaaacaaacaaaaagactggtccaagtgaggcaagctgtggtggctcacacctgtaatcccagcactttgggaggccaaggtgggctgatcacgaggtcaggagttcgagacaagcctggccaacacagtgaaacccgtctctaacaaaataaaattacaacattaacatttgtggggcaggaccattcagtccataattgtccacatttattccttttaaatgccagaaatt

SEQ ID NO: 251137 - DNA, 425 bp, Homo sapiens
agttattcaattcacttaagactttgttaagttaaatattaatgttaaaatgattagggctatttcgttcaagacaattgccactaatcacatgtgattatgtaaatttaaatttaaattcaacttaactaaaatcaaataatgaaaaaggtcaatagtacaaattctcagttatatcacgtgtcaagtacttaagaaccacatgtggctgtggaattagacagtgcagatgtagaacatttccgtcactgcagacattctattgggcagtactagtctagggcatccaattatagaacagaactagagtataaaactgccaaactgttcgtctagaaaatagaatgagagggaaaaatcaaagtaaaggaggcaacaaagcaagggaatataaattcagaaaaagtggcaaaagtagaagatac

SEQ ID NO: 251138 - DNA, 778 bp, Homo sapiens
tgacatcccgacgagttgtccgagttaaggttctcagagtagtcagtgtagctctcccttggtcctatgcaaaggcaagaaggaaagaccaagataatacattttgatggtgaaaacacagtagaaatatatttttataagccaaaggcaaagagatgtgtcagcgagtcacattaggtgttgaggctatcctgttactgaactgatggtaatggagaggactgaggatgagaaaagaagccactcctgtgacttgctgggatctaacgccacatcgcttcccagcacctatgattctgtctctgtgtgggtggcaccgtggtgtagatggacaagacttgactctggctgtgaggcacagctactgtaaagaacactgcgttttgatttatgggcattttttttttttaaaggacagcagccccgagatcatgcctgcgagcctttgtaggcaccgtaagtagggctgcaggcatccctgtgtgccctggcaggtgtctgacattctgtttcccaagagttcctgcggccggggctgaggtcccagcatctcagataaacacggtttgctttgtcagctgcgtctcaggtccacatagagcatggtgtctgggccttcctcagccgctttctgtctttgaggaagtcactggccttgcctgtgcattttcagtgatgacatacatgcccttaaacatgctcgagttaggccagtgacagaggcgtagattgtttttcttgttttaactcggacaactcgtcgggggtcctcggagtt

SEQ ID NO: 251139 - DNA, 122 bp, Homo sapiens
cttaccttccctgtttaggggggaaggatgggtactactcttctgccaattcaagaaatttataattctcaggtcatccttttttccttcttttcatctttctttcctttcctcactccctg

SEQ ID NO: 251140 - DNA, 340 bp, Homo sapiens
tttctaaccaagacttaaatcttgaaaccataaaataaaaatctgatataactgagtaaataaaaattgaaggaaaaaaatcttctaagtagcaaaaagaatctacataagtaaactgaaaagacacatgacaaaggcctaatcaacttaaataaagagttccaaagggtcaataaaaatgaatttcaatccaatagaaaataataggcaaaggatataaacgggcaatgcacagaaaaagaaatatgaatagacctaaatttgttaaaagatgtacttaacattacctcatcaaaactcaaagctatataggaatagcatattttatctatcagattgc

SEQ ID NO: 251141 - DNA, 500 bp, Homo sapiens
gccatatattttgtctctttttttttccagtgatggaacctagtcagcttccaacttttccccaccaaaaagatgccatacttagtttccctttagggacctgtatgagaatccttgaggatatagcaccaggagagaaaatgatgggccatgggatatgtgtatattaagtgactaagtactaccaggcaactcttcagaacagtgtctatgcctacactcccacaagcaacctcaccaacccttagtgttatccagctttctgattactttcatctttatagttataaagtgatcaatatcttgtagttatttgaacttgcatttctgtttttactaatgaattcaagcccttatttacatgttttagttatttgggttttctcttccataaattgcctgttcatatcctctgcccttttttccatcacggttgctgcttttgtcttgtctgtttgtaaatctttgtatattgtggaaataaagcacttgtcagcttt

SEQ ID NO: 251142 - DNA, 438 bp, Homo sapiens
gagagattcattctgtccctgagttcttttgtgggttctagagctccccaacccatctctgatgagcagcaagtacatcctaagctcatctctctgagccagcagcctggttctctagacatcccagggccaaaagctcctttaggtaatactactgcaccatggaaacccacccagggaactcatgtctctaagatgacaactcaataatcagatctgtgagtttaaggggaagatagagttcctcatttcatttaatgactctgtctaccccaggtaacacacagacatttcagcaatgatctttagaaggtaatggttccttatagcacctttggtggagccagtcagggttagtattaggagtaccaggaatcttcaaattatattgtatgggtcacagcctgtcttggctagacctagcaaagcaagtaccag

SEQ ID NO: 251143 - DNA, 443 bp, Homo sapiens
agattgcatggtaggtgacataggcaggggcagaatggagtttatgacaatggccataagatgatgaaaaaaattatttggggcctttgaagcagcagatgagctggctcagaggaaagttgcacaactgtagaaaaacaacttttgcaaaattttcctccactcagtgggcactacatacttattctaggatttgcattcattctttcacagactgtttacttattggcttgggcctacaatgacttttctgagagaggtgagggattagcacaacagcacacacacgcctgaaagaaatagtgaatttctaattttcagattttagtctctgacctaaccaaagaattgaccattgtagattttatctattaataatattaatgatgctcacaaatatgaagatttaagtacatcttatgataataagagatgctttcaaa

SEQ ID NO: 251144 - DNA, 283 bp, Homo sapiens
aaaaagaaaaagtgcttaggaatacatttaaccaaggaggccaaagaagtgtatcttgaaaacaacaaaatgttgctgaaaaacattaaagataacctaaataaatagaaagatatcccatgttcatggattgatattaagatgtagacgtgacccaaagcaaactacagagtcaatgtaaaatctatcaaaagcatagtcgcatttttacagaaataagaaaatccaggaagacccaaccaaaatggctgactagaggcattttgtactcgcctcttccatt

SEQ ID NO: 251145 - DNA, 374 bp, Homo sapiens
gtgagagttgtgtgtgtgtgcatgcatgcatccctgtgtgcatgtgtgtgttggggaggagagtaaaagagacttcatttggattggcattgaagtcacaagagtaacaaagcagcggttatcttttccagatacatattaggtttctttaattcactgtcaaagtatagtctgtgttctgcctgtattagaatcacctaagcccaagatgattgaaatcctttttcttggggctgacctcggaagcactgaattgctttctggcaagaggtccaagaaatacactttttaaaaattcccacagtgattctcaggcttgctgaagtctgagaatttctgctcaagttccttaactctgaagagtttagtttaaa

SEQ ID NO: 251146 - DNA, 410 bp, Homo sapiens
tattgagtgaatttgatatcaaaaggcctagctattttggctatcatagcagcaatgttttgccattatgctgcatactatttattttcatgcttacatcttgttttagactgaataatgtcagctgctataatatagaattcaaaactctctatgacttaatacaaaacaatagactttttttttgatatgggccagactgctctgctaggtggctttctctaaagggtaatacagggatttagactcatgtggctctaccattttgaaatgcatccctctagccataaagatgtgggagattttaagagccaggcttgtaagtgatgttcatcgtttttgcacacattgcattgcccagaactagtgacagggctcaactctaagggaagatggaaaatgtaatcttc

SEQ ID NO: 251147 - DNA, 330 bp, Homo sapiens
tccatgaccctgctgaatatctaggaaaacccaagaattcgagggaggccgtgttgtaatatctggtctgagtggccctctttggatttggaggctgtttccaatagacacaagataaaaactgaagatttaacagagcttagtcgttagccaagttgggcccttaggcttcaaaatattgttacccaccgtcctccccaattttttaaaactatgtccccccatacacatttttgacaaattaatatgtatcttaagattaagcagatgtttttctttgtattataattattgacatttttaaaaattaaagtgttgcatcattcttga

SEQ ID NO: 251148 - DNA, 497 bp, Homo sapiens
ccggtgaggagggtgccctagctcccatagtaaccccagaattagtctccttaaaggctggggatcatggcttgttcaatagtttttcttcaggttcgggcatatagaaggggctcaataaatagtcacagaatcaataactattacaaaagccccattgatggaatgctcgctccgtaccaaggctgagaagggtgatctgtcacccaaagtaggacccctttgttgctccctgaaccaacaacccagaagagcctgccagttttgtagttttgtttttccttttcttgctatttggccaggagcagcagtagcagcagctccaagaaagcactggctccttcttagtcccatggaagcacagatcaacatcattgcccttgcaaacttctctcagcttaggagagtctactcgctctttgcacattgttgacatgaaatgaatattaaacaccaaacctcatagaggccagccctgctgggcgagcaatgaaaaa

SEQ ID NO: 251149 - DNA, 229 bp, Homo sapiens
caaggcctgtcagggggagggctccacttctcagcccatctgcagtaggtccacattcgggagcactggctccttcttagtcccatggaagcacagatcaacatcattgcccttgcaaacttctctcagcttaggagagtctactcgctctttgcacattgttgacatgaaatgaatattaaacaccaaacctcatagaggccagccctgctgggcgagcaatgaaaaa

SEQ ID NO: 251150 - DNA, 330 bp, Homo sapiens
tcccccccaccccctgacaagtcctggtatgtgatgttccccttggatgactctgttacttggccatctgatgattttggactgcaactttgaaagaccaaattgtagcatgctgcatagctttcaaagaatttagatatttttttctggttggcatacattttgattttaaaataattaaattctgtgaaatttgtttttatatcaggtgactataccatcaccataaattgctagtcatgaaaatacatacagttgacccttgaacaatgtttgaactgtgctggtccacttatatattcatttgttcaataaatatattagaaagtt

SEQ ID NO: 251151 - DNA, 219 bp, Homo sapiens
agagacaaggtcttgctctgtcacccaggctggagaccctggcttactgcaagcttcaacctcctgggctcaagcgatcctcccatttcagcctcccaagtagctgggacttcaggtacacaccaccacacctggttaatttttgtatatatatattttttaatagagatggttctcattttgttgtccagacaacaaagaacgcctgggctcaaggga

SEQ ID NO: 251152 - DNA, 265 bp, Homo sapiens
cccagcctgctctctaggcgttccatcagccgtccatgctgaaatgtccttcaacctcaccgccccctgcaagccctcccgctctccagccgtgcgcaggcaggccacggtcccccccacctgtgtctcgtgtgacaacaaagcagaggaggaaagggaggggctgagcttgtcacgggggggtgggggcctgcgacacaatagcgcgcagtcctagctgctttattgaggatactgtgttgaataaaccaatgactaagagaga

SEQ ID NO: 251153 - DNA, 339 bp, Homo sapiens
ccgtctctcttcttcaccactgaaaatgtgggcctaacacagcccagtgcacagaaagaacccaatgaacagctaccagatgactgatggaccaggtgatggtgaatccttctgagatccacaacacaccttagcctcatggaagctgcccagaatgggaggtcaggatcgctggcttggatcccagctctgccccaccatgcagaagccgaatgtccttggtcatttcacaccacttctctaagcctcagctttcttatttgtcaattgaaacaatttctcacctctcagggtttggggggaaataaaggacagagagcctgtgcaattgccaagcac

SEQ ID NO: 251154 - DNA, 462 bp, Homo sapiens
gttttagttgtaaatctgctcatctacattagcacaatttctgacaacttgaaaataaattatagaagtgaccccaaagttccagagaattggctccgtgtcccattttttcttccttgttcctggtttgtcattctgttcatttctcttcttggatttgagaaaggaatctgttgactcagcagcccagggctgcggttctttctctctgggatccctgctcattagcttcctatgcgtggctttcttccctgctggctctgggctataacctctcctctcatcctcttcagggaatggagaaaatttgcttataactgtgatctaaacataatcatgcaataggtaccctaaaaatactcaaggaaggaagtacaaaggacagactaccaattgataggacgtcttcttggatttcatgattgatacattagatttctttactctgggcaaaaaaaaaaa

SEQ ID NO: 251155 - DNA, 480 bp, Homo sapiens
tggggtggttcacaagcctcagtgcctccatttctggttcctggcattcctgaaaagcccggagcctctgctttctggcttcatcttcccttcagcttcaccaggactgccctgcactctaaatttcaccatcatcctttcctttcagctctgggcttttgccactatggttccctccacctggaatgcccttgccctactcgtgttgaaatccaacacgtcctctaagggttcagggcccccacctccccttctccctttgggtcagctctgcctaccctccatggtcttccgtgactacctgtgtcatttcctccacttctccacccacgtggcttggcattagggttgtctgtggatgagtctcccccaaccaggcgtgggtctgagcacattgctgttccccatggggaggaagggaagggatcagctggttatggagcgcctactgtataaaaggccagagctggacactcaaga

SEQ ID NO: 251156 - DNA, 567 bp, Homo sapiens
cattcgtagaccccaccatcaaggtggactccggctaccgagttcacgaggatctgcggaacctggggctgtatgttaaaacccgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattcttatggccgtattaccaggggatacatcataggaacagct

SEQ ID NO: 251157 - DNA, 622 bp, Homo sapiens
cctgttgtgttacagcatcttctggtaatgccacttgtaactggcgagagagcatggctgttacatctcagcacaatgatataatcgagatgcttgtgcaggatatctttgtgccttctggtaacctctatatcatgccatcggaagggattctgtcatgagcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattcttatggccgtattaccaggggatacatcataggaacagct

SEQ ID NO: 251158 - DNA, 207 bp, Homo sapiens
tatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaa

SEQ ID NO: 251159 - DNA, 487 bp, Homo sapiens
gccctatccggtaccgccttgttacgtagaagttactcagcagactgacacccaatccccctcgggcgatcatctgccctgtcttcccacctccagggctacagtgggcagcaccgccatccccagtgtgacagggccctgggagcctcagggctgcccggccaggttggtctgctctggttacattctggccaagctgccccttcctgctgacctgcatgtgtattgttgtcaccttcagctctcagcacctcggcccccttgggcagtgaggaagggccctggaggcgaggttgggagaaaggatagctagaacaggatcctgcggggaacaagggtgtgggcagctctcacccggggctgcctcactgagagcaccgccgagtgggggtgggggtgtccaactctccagccacaaaccgcttcctccttgtctgcaggctgtgcaggtctggcctgtgagtaaacacatttatcagcaacccaa

SEQ ID NO: 251160 - DNA, 346 bp, Homo sapiens
gtgtaaagaaaactttcagctatcttcaggtttgtgtttggcactttgatctgtaagcaatcaacatggagagatgctatgccaaagaggaaagtctgcaggaaccatacaaggactctcccacatgactcagccaggcaagccaatacccactgcacaggagggtgtgatggtggcccaccaagtactgagtgaaggagtccaggggcccaaggctctgataaaggatactccaaggccaaaagacaacccatgtgaagcagtcgagccccaggaccatgaccagcaagggcaagggtctggctggacagaagtaggtggcagctgcactgctggcttccaactt

SEQ ID NO: 251161 - DNA, 393 bp, Homo sapiens
ttgtgagattcattcatggtacgagcagcagtttcattgctgtataattttcttttgcatgagtatgtggcaatttatttttctagtcttttcttagtagacattttggtttttgtagcttgtggctgtttcgattagagatgctgttagcattcttttgctgtacagttgcactcatttttgttgggaattattgggggagaagataggtacgtgtttagttttagtaggttcttcccgttttcctgtatggttgtattaattcacaccccacgtggcattgcgtaagttccaattgttctgtatctttgacagcacttggtatcgccagtctttcatatttttcaaagctcgtttcttttttttgagacacagtcttgctctgtcgcccag

SEQ ID NO: 251162 - DNA, 422 bp, Homo sapiens
acacccaccccagcctttcccggtggaggagtgaggaggatacccctatgctggtgtgctctttgtttatggccctgctttcattgttgagtgagcacatggttccgggccctgtccccaagcgctcacagctgagctgaagagatacaacacatcatgccaggatttctagttgttggtgaggcctgggataacctgggcccacttaagccaggatgtgccaggaggacctctgagaagaagcctgctctgcagaaaaagagcaaacacacaggccctgcctcctctccctctgtcctcctctcctgcctctcctgagccatggtccacagtggccttcccaccagacctaccttctgtgctcctgtccaaggcctggtggccccaagcctggcacccactcccttctgtctgcctgggtc

SEQ ID NO: 251163 - DNA, 478 bp, Homo sapiens
atttatgaaaaggatcatggagtcatagaatcccatgtcatcctataactcctcccttgaagggtttttagaaccacctcttgggacgtgagccaagatctgagagaaaggcaaggtgaaggagaatgctattcagaaaaactgaaaagcagattcatttctgaaagcatttattgagcacttacggtgtgcaaggtaggaacttggaggtgaagaataacttagaaatatttaagagaagacactggagaaactacagtggaatacctagggcaagtccaaagtactggctggagatcagtcttatctcatttgatgagtgttcccaggtcagccctggagagtaaggggtgtgtattagtatctcagaaatgggaccaaaagtggcctaacagaactgaaatactaaacagttaaacctgaagtgcatgtatggggaatgtggaaacccaggaaaaaataaaatattaccttgtca

SEQ ID NO: 251164 - DNA, 389 bp, Homo sapiens
acgctgctgtgtttagtgttgaacagggtggtcaaataacagttgtactatgttatcataaaacatagtgttcttactatggtgttaacagaccctattataatttgatatttaattctgatgtaaggataatagattttgtccaagtctagtaacatgttataatttattttagagggaaagagaaaaaaaacagcctaggcaacatagtgagaccccatcattacaaaaaataaaaaaagttagccaacttcatggtcctagctactggggaggatgggttggaaggatcacttgagcccaggagtttgaggttacagtgagctatgaacatgccactgtccttcagcctgggtgacagaccaagacctaccctgtctcaaaaaaaa

SEQ ID NO: 251165 - DNA, 504 bp, Homo sapiens
agagtgagggcccatgtttgaaggcagtgagtttgacttgctgagaggtagtggagggaggcagagcggtagcctcaatgatagatgtggaagatactatagcatagcctgccttttttggtgagtggcgatcaggcctggtggaactgccatcaataaaccaaatgtgatcagggtgaggaacaggaaagaaggaaatatgcggaaatggggtgaatgtcagctggatcagagagatacagtcatgggagtcaggtgttgtatctggaataatgtgggaggccggattgaagtctgggccaggaacaatggtaattgtgggagactcaacagagactgagtatagctgaaggagccagggagcagaaagtatatgtgtcaggtgtgaggaagacaatagattttggaagttatgagaactgtagagagtgagttgagcatagtttgcgattttgagggcctctaaaagtattagggtggcagcagccgctgcatggagacatg

SEQ ID NO: 251166 - DNA, 649 bp, Homo sapiens
  misc_feature (649)..(649): n is a, c, g, or t
cttttttctgggggttgacgctgggtgggcagagggcagaggcctgggccaggacagggcccgaagaacgactcagatcccggactgtcctccgggcgcgacggaggcggcggccggggcggaacagcggcgcccgaggcaggggcgcggcgctggctctgcgcctgcgcggcggcccatggtcaggatgcccgcggcgtggttgccgctggcctgcaagaggcgctgcagccgaccctggaggcccgggggcccctcgtgccgaattcggcacgagaatccaagaattatgatggaaatatgaacattttaaaagctccctgcatgatccacatgtgaccatgatgggtaatttctgatttgggctttctgaaccccgggaacttcttctagagaatggtggtaagatctgcctccctgccatgattgttatggagaacaaatgaaatactggatgtgccatgttggtgtgctgcatccattaactcgtcattaacattaggtatatctcctaatgctatcccttcccccttccccaccccacaacagggccccggtgtgtgatgttccccttccttgcgttcgtgttctcattgtttaattcccacctatgagtgagaacaagtggcgtttgtttttggcctcgcgn

SEQ ID NO: 251167 - DNA, 426 bp, Homo sapiens
gtcatgaaagggcagctgccacctcaggccatggtggcggagacaaaggctatgggccggtgtagacgtctaagaaaccaacaggaagtcccagccggaaacacagaaaggatatggagaaaattattattctgcccctacagtttcggtgacccagatgggatctctgggacaccctgcctgctctacaattgggatccctggaaaagtgacagaatctggcaacagatgagtaagaaaggtcacttcctggcagacctcaggtatattggggacatcaagaaaagaataattcatcaaagtctacagatattgcaggcaaagttgaaacaagccagacaagttctctttgtattcttgagagacttggaaagtctaacctgagattccttattaaaagttccagcaaaacagaaaaaaaaaaaa

SEQ ID NO: 251168 - DNA, 612 bp, Homo sapiens
gcgggcgctcccctgtctggggggtgcttggctgggtgtggagaaggatcaatcacagctgactcctcagaggtgacagcccctgcccccttaaaaacaagaaaagacctagcagtgtgaagccaaactgcacccccagccccggtgacatgaggaaaccgtgaggcgctcagcctgaggttcatcgttcatctccttcctgcttggaatcagaatgtcctcactgctgagtttctccgttttatgggattacattagtggacaaaggaggaagtcccagccggaaacacagaaaggatatggagaaaattattattctgcccctacagtttcggtgacccagatgggatctctgggacaccctgcctgctctacaattgggatccctggaaaagtgacagaatctggcaacagatgagtaagaaaggtcacttcctggcagacctcaggtatattggggacatcaagaaaagaataattcatcaaagtctacagatattgcaggcaaagttgaaacaagccagacaagttctctttgtattcttgagagacttggaaagtctaacctgagattccttattaaaagttccagcaaaacagaaaaaaaaaaaa

SEQ ID NO: 251169 - DNA, 379 bp, Homo sapiens
tccaactcctgggctcaagtgattctcctgactacaggaagtcccagccggaaacacagaaaggatatggagaaaattattattctgcccctacagtttcggtgacccagatgggatctctgggacaccctgcctgctctacaattgggatccctggaaaagtgacagaatctggcaacagatgagtaagaaaggtcacttcctggcagacctcaggtatattggggacatcaagaaaagaataattcatcaaagtctacagatattgcaggcaaagttgaaacaagccagacaagttctctttgtattcttgagagacttggaaagtctaacctgagattccttattaaaagttccagcaaaacagaaaaaaaaaaaa

SEQ ID NO: 251170 - DNA, 2174 bp, Homo sapiens
  misc_feature (1)..(2): n is a, c, g, or t
  misc_feature (4)..(4): n is a, c, g, or t
nncncgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggctaaaaactg

SEQ ID NO: 251171 - DNA, 1849 bp, Homo sapiens
  misc_feature (1)..(2): n is a, c, g, or t
  misc_feature (4)..(4): n is a, c, g, or t
nncncgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcaggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggctaaaaactg

SEQ ID NO: 251172 - DNA, 1053 bp, Homo sapiens
gaacccacattgaaccaaaccccagccgtgccagagccagagcagctgatatgggggaagcttggtgcagggaggaggatggatgagatctggtatccgttgattaaaggggacctaggatacggggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggctaaaaactg

SEQ ID NO: 251173 - DNA, 1054 bp, Homo sapiens
aagatgaagaggttgaccagcggggagagcaacccccggggcagctcagtgaccttgttgtggtccaggtagaggttcggcatggcccggaacgaattggcagccagcaccgggaagttgttgcgctgttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggctaaaaactg

SEQ ID NO: 251174 - DNA, 565 bp, Homo sapiens
gctcacccactcctctgccaaccagcccagggtggggattgctctgcccttgacgaagctgactcctggccaggccagcccctggtcccctacccatacccctgtgagcttgcgcagcctcacgccttacctccctccctctggtctgcagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggctaaaaactg

SEQ ID NO: 251175 - DNA, 919 bp, Homo sapiens
  misc_feature (1)..(2): n is a, c, g, or t
  misc_feature (4)..(4): n is a, c, g, or t
nncncgggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggtagggcagaggtctccaggccccaagcccagatggacacatgccccctgtccctgtgacacttccgcggggatggggagacagcagaggagagc

SEQ ID NO: 251176 - DNA, 174 bp, Homo sapiens
gttgcttatggaaccacagagaacagtcccgtgacattcgcgcacttccctgaggacactgtggagcagaaggcagaaagcgtgggcagaattatgcctcacacggaggtgagcccctgaccaagactccaaagtcccacctcccgtcacccagctggggtgcacccagctggg

SEQ ID NO: 251177 - DNA, 469 bp, Homo sapiens
gcaggtccttggctccctggaaggcgcctgcgcgcagctcacggatcttgttgttgttgagctgcaagatgaagaggttgaccagcggggagagcaacccccggggcagctcagtgaccttgttgtggtccaggtagaggtaggtcagctcggtcaggtcgtcgaaggcacctgcgcgcagcacgcggatgtcgttatgggacaggtacaagtagataagttgcttgaggccgcggaaggcaccggcggccacctcgcggatctggcagtgctgcaggtgcaatgacacgaggttcggcatggcccggaacgaattggcagccagcaccgggaagttgttgcgctgtaggttgagcagcttggtcttctctgacaccttggggatcttctgcagccccaccttgtcgcagatgacgtgctgcaggtcgctgtggcagtggcagttctgggggcaggcggccagcgccgg

SEQ ID NO: 251178 - DNA, 706 bp, Homo sapiens
gcagcatgggaagatggacagcaaagcaccgatgtcctgctagaacgtcctggcaggttgcttatggaaccacagagaacagtcccgtgacattcgcgcacttccctgaggacactgtggagcagaagacagaggaagcagtggatcaggacaagtggtattggacaggcaccgttctcgccgctagaggtccagaggaaagtaagatgagaaggatcctgctttttggaggaagacagatgatgcccaacatcgataaataacaccaagaaaataggccaggcgcggtgactcacacctgtaatctcagcagtttgggaggccgaggcgggtggatcacctgaagtcagaagtttgagaccagcctggccaacacagtgaaaccccacctctactaaaaatacaaaaattagccggacgtggtggcggcacgtgcctgtagtcccagctactcggaggctgaggcaggagaatcgctgtaacccaggagatggaggttgcagtgaaccgagatcgcgccactgcactcaagactgggcgacagagcaggactccatctcaaaaacaaacaagcaaatgaacaaacaaaaaacactaagaaaatgaaatagggttataggagagaaagtggctgtggtggggaggggagcttcccttagattgagtggacagagaagatgtctggagacatttgagctgagacctg

SEQ ID NO: 251179 - DNA, 1165 bp, Homo sapiens
ggtcgagactggcagcagacagggattagggtagggatgtgacaaggtgaggaagggaggtggcagagctgctcaccttggagatagccagagggacagggaacctggggacgggggatggtgccagctgtggccctggctcctggggcctccaggaagggaagaaggaaccagggcagagccacagccaggagctcaccttctccaggttggtgttgtccagccagagggtctccaggttgcttatggaaccacagagaacagtcccgtgacattcgcgcacttccctgaggacactgtggagcagaaggcagaaagcgtgggcagaattatgcctcacacggaggcccggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggctaaaaactg

SEQ ID NO: 251180 - DNA, 1013 bp, Homo sapiens
ggtcgagactggcagcagacagggattagggtagggatgtgacaaggtgaggaagggaggtggcagagctgctcaccttggagatagccagagggacagggaacctggggacgggggatggtgccagctgtggccctggctcctggggcctccaggaagggaagaaggaaccagggcagagccacagccaggagctcaccttctccaggttggtgttgtccagccagagggtctccaggttgcttatggaaccacagagaacagtcccgtgacattcgcgcacttccctgaggacactgtggagcagaaggcagaaagcgtgggcagaattatgcctcacacggagagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatgcaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgatttggcataaagagcttctgttttctttggctaaaaactg

SEQ ID NO: 251181 - DNA, 273 bp, Homo sapiens
gcttggctgggtgtgccatgcccttggttccagggagactgatctgggacagtcaaacccatagctcctctccctacagttccagagaggtggatcgcatggtctccacgcccatcggaggcctcagctacgttcaggggtgcaccaaaaagcatcttaacagcaagactgtgggccagtgcctggagaccacagcacagagggtcccagaacgagaggccttggtcgtcctccatgaagacgtcaggttgacctttgcccaactcaaggagg

SEQ ID NO: 251182 - DNA, 634 bp, Homo sapiens
gtagaaatctgaaatgcatagaagtgcatcctgacaacttgtgggtatttttttcccagttaatgataattaaagtatttctaatcagtgaggtgtggtggtgtgcacctgtagctacttggaaggctgaggcaggaggattacttgagcccaggagtttggggctgcagtgagctatgatgtgccactgcactctagcctgagtgacagagcaagatctggactcctttaaaaagaaacaacaacatgtatttctaataatgataggtaatatttaataatgataggtaactccaacctcatggacttgtattttaaatattgagaagttgggaaaataatggagaaaactggccttggtaggaagtaaactgtgctttttagtactaaatggattcctaatatctaggaaacaggaaaatagtgactcctagtgtatctcatatctttttattactaaacaatgccttgctaaaactgcatttcaatctttattagacttatattttgtgtgttgatattctgacaatatccagataaagttgagagtgttaggagaatttcatttctctacaggaaagataacatcttaattttatgcatactatgagtgggaaagaccatataggatatc

SEQ ID NO: 251183 - DNA, 466 bp, Homo sapiens
  misc_feature (442)..(442): n is a, c, g, or t
tgctcctccttcaccttccgccatgattgtgaggcttccccagccatgtggaaacatattcgcagagcacccactaggtgccagtaaatgtatgagaagtcctgtggaataagactgaagttgtccttgccttcaagcaacttgcaattgcctaagaacacagtttaaaaccacaaaactaagccttggaaatcacatgctgtcatttctgcgatcggtcataaccagtcctgattccatgttagaggagactacataaggacacaggtaccagaagaaacttctaagtgctgctgtatttcaccaagctccagttgatatccaaattggacaactcctgtgtgccaggacaaggtgctaggcttgctttaaaatgatacatacaaataagataaagcaaagagacttggctttaacattcagtaaaacaataatgtgtttnttaattttaaacatttgcacgtat

SEQ ID NO: 251184 - DNA, 606 bp, Homo sapiens
tgctcctccttcaccttccgccatgattgtgaggcttccccagccatgtggaaacatattcgcagagcacccactaggtgccagtaaatgtatgagaagtcctgtggaataagactgaagttgtccttgccttcaagcaacttgcaattgcctaagaacacagtttaaaaccacaaaactaagccttggaaatcacatgctgtcatttctgcgatcggtcataaccagtcctgattccatgttagaggagactacataaggacacaggtaccagaaggagactaaccagcatgggctacatcaaaaaggctgccatctactttctgctgggtaggggcaccagagagacttgtcagaaactagaaggaaggtagagtgcgaaatctgagtgttaattccctggcttcatcaaaggacactggtcttcacaaggaaacagactacatgattctccttttgggcttcagtaaaaaccccctcctttcatcccttagtctagggatggtaagaggtcagcagctaagaattctaggttctttgtggttttcccgtatacatgtctttgatgatagcccctttggaaataaattctcctagacttttttt

SEQ ID NO: 251185 - DNA, 343 bp, Homo sapiens
cctcccaccccgcctttccccttcgagtgagtcatcgaacccgtgcttctagacgtgtttggagcagagcacctggaaatcatgatgttctctagataacagggaatattgataaattcccttgtggcgatgtcactgtcgtccatacagaagacaggaaagtgtaacgcctgcaatcaagcctggaaccaggcttgattgcaggccacctactcatgcatctaattggaagcgccaccctagcaatatcaaccactaaccttccctctacacttatcatcttcacaattctaattctactgactatcctagaaatcgctgtcgcctgcaatcaagcctggaa

SEQ ID NO: 251186 - DNA, 618 bp, Homo sapiens
aatgctttattaatgcattaaataataaattctagcagcagatataagtaccagaattttgaagtagtgatgagcataaatatttcaaagtatctgcaacaactataatatgatatgaaaagatgtaagatttctcttgttaatggagtcacctaatactacctaatttagtatactagctagtatactacccaccactacctaatatactaccctgtgtaattactaatatacccagtactgcctaatactaccttgttaattgcctgcatttgagagtgaaggaaacaccaaatttcaggctgtgtttaataataatagagttgtgtctttttctcatttaaattcatagacccctgattctatccctggacccattcttgtagatctcaggtttaaaattcctgtgaaaaaaatgtaccgtttaaatgaaaacaaaattcaatgaaataagcatgatacataatagataatacataaagtattatgaaagcgcagggaagctttacaagtcgaaatacctcttgagagtcttactgcgcatcacacaggtggacaacaggaaagtggcattctaggaagacagaaaaacctcttgccctcctgtccaactccaaa

SEQ ID NO: 251187 - DNA, 448 bp, Homo sapiens
aatttgccaattatacttcttactgtaaaatgataaattagcattctcacataactttgggagactggttcacctatcagagatctgtaggccttatcaagcagctaatacaagtcagatttttggactcatgaaaatggcttggactctggaatcagctgatgcagtactttaccctaaaatggcctgagcagcaatttctctctttaacatactaaattaaactagccagatcaatgcacaattagatggaatatggagccaagctattaactatctagatgaagccagaaacaaatacctaaatgaattcttacctctaaagcttggataactgaaaattagtacaatcactacggtgtctaagagacacaaaattatatatttactattcacctaaaatgttttaaaacaatatgtatttttatgtacaaataaaaggtctaat

SEQ ID NO: 251188 - DNA, 562 bp, Homo sapiens
gagaagcttgataaatgttcgttctctggatgttgtttcaggcctaagtagtttagtgtgatgttgcagcagtcagtttcacagttaattaatagtcttttcaaggcagctgctttggaatgtatagtggaacaccagtagtctttactttcctctgaaagtctgtcattacacttacaaatatttattgcccttcctgagggtcctttggcctagaagattgttttcatggaatctaatctatgtcaaattcttttaatttactacactttattaatagattgaaagccatttttctgggacaacaaagttgttattctcaaaagttggtaaaattttttaagaagatataattcatactacaataacagcatcttcatactacatagttctagcaactttgagacactctcaaaaagtttgagaagttttaactggagattaacaataacaaacaccttgtattagttttagcaacccaaagttgttctgtttccagaaggacatcaaagtgagtgtagttgcaatctgtcaaataaaagattggtatctactatgtatg

SEQ ID NO: 251189 - DNA, 539 bp, Homo sapiens
ttagcctccaagtgcttgcagctcactgatttcatcctcaagtttccgcacagtgcccatcagaagtatgtccgacaatgcctggcagatcgcagatcatcaatacaaaatggctcagccacaccatgggccaagaagaaaaaagctcatagaataaggatataaagaaaatatctttgtgcagctgtacagtgtatttgcgttttaagctaagtgttattacaagagtcaaaaagtgtttaagttgataaagtaaaaaagttaaactaaggttaatttattcttgaagaaagaagaatatttctttataaacctagtgttgcctaagtgtacagcgtcatggttactcaccactcactgacgcacccagagcagctgccagtcctgcaagctccatgcctgggaaatgccctatacagctatgccatcttttatcttgttttttgttttttttttcccaagacagaattttgatcttgttgcccaggctggagtgcaacggtgcgatctcggctcaccgcatcctctgcctcctgggt

SEQ ID NO: 251190 - DNA, 527 bp, Homo sapiens
acagagtctcactatgtcacccaggctggagtgcagcagcgcattcttggctcactgcagcctctgattcctgggttcaggcgattctcctgcctcagcctcccaagtagctgggaccacaggtgtccgccaccacgcccagctggtttttgtatttttagtagaggcggggttttgctgtattggccaggctggtcttgaactcctgacattgtgatccgcctgccttggcctcccaaagtgctgggattataggcgtgagccgctgcgcccggccttatgaatcattaaatgagactggttcaaataaaagtcacagtaatggccagaagttttctgaaaatgaaactaaaaacaagcctgatatgcctttaccagtaagaaacctgtggatttgcgctggacatggtggctcatgcctgtaactgcagcactctgggaggccaaggtaggaggatagcttggagccaggggttcgagaccagctggggcaacaaagctagaccccttctctacaaaaaatgaaa

SEQ ID NO: 251191 - DNA, 415 bp, Homo sapiens
gtattttagcacagacagggtttcaccaatttgagcccaggctggagtgcagtggtgtggtctcggctcgctgcagcctgcacctcctgggttcagttcaagccattctcctgccttggcctcccaaagtgctgggattataggcgtgagccgctgcgcccggccttatgaatcattaaatgagactggttcaaataaaagtcacagtaatggccagaagttttctgaaaatgaaactaaaaacaagcctgatatgcctttaccagtaagaaacctgtggatttgcgctggacatggtggctcatgcctgtaactgcagcactctgggaggccaaggtaggaggatagcttggagccaggggttcgagaccagctggggcaacaaagctagaccccttctctacaaaaaatgaaa

SEQ ID NO: 251192 - DNA, 372 bp, Homo sapiens
agacagtaaagactgcttgttgtaagaatgatttcggttgattcctatgaatgatatactagtatctgatttccagggtatggtggggagtaccagatttatccaaagtgcgaaaaactggcaaaatagggattaaaatcaggcctctgattgcaagcctgaatttgttcaacttgaaggcagcccatcttctcagaactttcattttcccatagggagattaaggtattaaatatctcatagtgaagatgtatcccagttcttgatgtgctgaaagtctgagcgttcaggagctccagcgggatcaggtccttaaagcagcatggcttagatggccatgggcaagatggtgaacctcatgtgggaagagtg

SEQ ID NO: 251193 - DNA, 864 bp, Homo sapiens
catactggccaggctggtctcaaactcctgacctgaggtgatctgcccgcctcagcctcccaaagtgctaggattataggcgtgagccactgcacctggccagaaggtattgatattaataggtcatgacagaaagctgcagggaacaaaactgaaaggaggggacccactggccaaagatgaagcatctccagcatgaataatgatggacaatgcctgagttcataatgacactaaagagagtcactgatcaacactgaagtcgccggagcgccaaagaatcgattatttatctggtacttcccacccaactgctgatgaagaaaaattcttctttacaagaattatcaactaatgtatgagcagggagagaattagaaaagcataatttgcaacccttaacgaatttgggcaatcaccaattgatagtaaaatgattacacaaagcactgatagggaactttacaagggaagacccagacctgagcctaatgatcaatctcaaaatcagttcaaagcagaacaaccagctatcacagcacagactcagcaccacctacagggtcttcttgacgtcaagaagcatcctgagttctaactatactacaaggctagagtaaccacaacagcattggtactggtaccaaaacagatatatagtccaatggagcaaaacagaggcctcagaaataacaccacacatctacaaccatatgatttttgacaaacctgacacaaacaagtaatggggaaaagatcccctatttaataaacggtgttgggaaaactggctagccatatgcagaaaactgaaactggactccttccttaaaccttacacaaaaatcaactcaggatgcttct

SEQ ID NO: 251194 - DNA, 285 bp, Homo sapiens
gcagtgggagggaggagtagccacctgtggactgtggctccctgctggagacgggtgtgcgtctcgcttcgcccctgtgaaggttatgcctgtcgccctgtctatcatgagtctgtctctgcagcttgtggcttctgacccgctgcgaccatctgcctgtgctcagtccccacccaggaagtgaactgattctgtcactttcttctaaagaccacagatctgcctggtttatacaacgaagctcgtctgaattggagtcctcaaatttgtgaatttaagttttaa

SEQ ID NO: 251195 - DNA, 257 bp, Homo sapiens
atatatagtgttggaggagtgtaacctcattttttacctgtagatacccatttgtttcagcatcattagttgaaaaatctattccttccctattgaattgtttcggtaccatgttgaaaataaatacagtgtaaataagagggtccatatctggattctcagttccattccattgttctatttgtctatccttatgccggtgtcacactcgattcattactgtagctttgtagtaaattttgaaaacaaagtgtgaa

SEQ ID NO: 251196 - DNA, 298 bp, Homo sapiens
aaaaaggaaagtcaacaaaatttatgtaaggccagtacaccaaaaactacaaaaaattgctttgagaaattatgaaagaactaaattagtggggagataaaccttgtcatggatcagaagagttgttatgtttaaagagtcagttcttcgtaaattgatctccagatccaatgcaattctaataaaaattccaagcggcattttggtagaaattttcaagctgattctaccatttatatggtaatgtcaatgatcaagaataataaaatagcaatattataaaagaataatggtgaat

SEQ ID NO: 251197 - DNA, 2317 bp, Homo sapiens
ccccggcgcgctaggctcacaaaggcaggcacagactgcaaccctgctcagtgctccgggcgcttcaggctggcttgggtcctgctgctccaaccccaagggccctggagcgctccctgatacctccatcactcaccatggccagccagttctgcctccctgaatccccatgtctctcgcccctgaaacccttgaagccacatttcggagacatccaagagggcatctacgtggcgatccagcgcagtgacaagcggatccacctcgctgtggtcacggagatcaacagagaaaactattgggtcacggtagagtgggtggagaaagcagtcaaaaaaggcaagaagattgacctggagaccatactcctgctgaatccagctctggactctgctgaacaccccatgccgcccccgcccttatcccccttggctctggcgccctcttcggccatcagggaccagcgtaccgtcacgaaatgggttgcgatgatcccccagaaaaaccaaacagcctcaggggacagcctggatgtgagggtccccagcaaaccttgtctgatgaagcagaaaaagtctccctgcctctgggaaatccagaaactgcaggagcagcgggaaaagcgcaggcggctgcagcaggagatccgagctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaaccttgaaggacctggatatcatcaccgtcccctcggacaatgtggttatggtgcatgagtccaagcaaaaggtggacctcactcgctacctgcagaaccagaccttctgcttcgaccatgccttcgatgacaaagcctccaacgagttggtgtaccagttcaccgcccagccactggtggagtccatcttccgcaagggcatggccacctgctttgcctatgggcagacgagaagtgggaagacgtacaccgtgggtggagacttttcaggaacggcccaagattgttctaagggcatttatgctctggtggcacaggatgtctttctcctgctcagaaactccacatatgagaagctggacctcaaagtctatgggacattttttgagatttatgggggcaaggtgtatgatttgttgaactggaagaagaagctgcaagtccttgaggatggcaatcagcaaatccaagtggtcgggctgcaggagaaagaggtgtgttgtgtggaggaagtgctgaacctggtggaaatagggaatagctgtcggacttccaggcaaacatctgtcaacgctcactcatccaggagccatgcagtgttccagatcatcctgaagtcaggagggataatgcatggcaagttttccctcgttgatttagctgggaatgaaagaggagcagatacaaccaaggccagccggaaaaggcagctggaaggggcagagattaacaagagtcttctagccctcaaagaatgtattctggctttgggtcagaacaagcctcacaccccattcagagccagcaaactcgcactggtgctccgagactcctttataggccagaactcctccacttgcatgattgctaccatctctccggggatgacctcttgtgaaaacactctcaacactttaagatatgcaaacagagtaaaaaaattaaatgtagatgtaaggccctaccatcgtggccactatccgattggacatgaggcaccaaggatgttaaaaagtcacatcggaaattcagaaatgtcccttcagagggatgaatttattaaaataccttatgtacagagtgaggagcagaaagagattgaagaggttgaaacattacccactctgttagggaaggataccacaatttcagggaagggatctagccaatggctggaaaacatccaggagagagctggtggagtacaccatgatattgatttttgcattgcccggtctttgtccattttggagcagaaaattgatgctctgaccgagatccaaaagaaactgaaattattactagctgacctccacgtgaagagcaaggtagagtgaagccaatggcgagagatcaggtccgaaatgctgcattgctgcagtttccaccactcttatacaggaaaactgtccaaattatctaaagatcctcctgagaagcttaaaacatcttaaaatacactgatgggaaacatgctctttcttctgcctctgtt

SEQ ID NO: 251198 - DNA, 521 bp, Homo sapiens
aaggctgccagaggtccttcagcagctcccgtggctgacagtgactctacgtttcctagatttcagggaccacctggaggggagcggaccagagagacttcctcggaataggctgtggctcttcacaaggtgtcttctatgctttatttgggagccattgccttgagcgttatttcccagatggttttctaatgtcaccaactgaagaaaagacccatgcacacaggacacagcatgatctgatgctcacagcgttttccttcctctctgaaaacggactcagcgattctggcaagcggtacttactctgagatcacccgtttgctaaggaaaaatcttagtactgagaaaggtgacactttcctccctgcttttgctggagagacactttggttatgagttatttctagcataacacagtttatttcagaagtccagctcaatagcagaccaaggcatgaacaacacatgaaaatttatgttgggaaaatatatattgtatgtctgcttgaaaagtgggt

SEQ ID NO: 251199 - DNA, 379 bp, Homo sapiens
tcatcattgctttcattctcatcatcctcatcatcttcctcgtccttttcatctacaccttgccaggagccatcagccgaaggatcgttgtgggctcatagaggatcatggaggacccagatcctcgccatatactaatcctctcttccttatctgggagcatctaagaacatgtcccatgcatggcactgtgctgagtgctaaggggacagatcaacccttcttggaagagatggaaaagaaacatttcctccctgctccaacccctgcctccaagtttcaaacttgtaaggcatgttttatcccttgggcagcatgaaataaggcactttcacctcatggtaatcaacaatgacctcaaattgacttagatcaatgt

SEQ ID NO: 251200 - DNA, 537 bp, Homo sapiens
agagattaagctgaaggaagattttgtggtaaggggtgatattgtggggttgttagaagaaacatttgtcatttagaattattggtgatggcctgggtacagttttgtatgaattgaaaaactaaatggaataagagaaggagaaaaacaggtataaaatgtctaagaattgggacgactcaggacatctgattagagagtgcctaaggagattcagcatagtcctgccagcaaagattatttgtttacttcaggagttaagagtggcagtttggggatagcacgaggagatatcagctgtgatggcttggagaaacagtgtaaaccggcagtgtgaacaagagcagggcacgtatgagtagttgagaacggagaataggagtatgactagacagaagatagtagggatgacaagttttttgggggcacagtctaagttggtccggtgtctggaatgagactggggcctaataaaaaggattgtccatacaggagctcaaataggctgtaccctgcagcattctgagaagcgaaaga

SEQ ID NO: 251201 - DNA, 263 bp, Homo sapiens
cggccacgtggcgtcagcaggacggcaggtgcattcttgaggcgggcacacacctgtgttctccaggacaagctaggaggtcgccggtctgcaggtcgtggaagcagagcacgtggccgatggacacaggaaggaaggcctcgcctcgagaggggagccgtggagctgtgagcaggggccacacagggcacatttgacaggggccacacagggcacgtttgacaggggcactggctttggacgacggcctggatgcggatgtg

SEQ ID NO: 251202 - DNA, 616 bp, Homo sapiens
ttaccatctgtagatatgaaggatatctgaagaacaactggattcatttcatattaacagtgaagaaatgagatgggcccctttcctttgaagggtatcttgctaggaatacagtggtgctttagtgtctaggtagcatttataagctggcaaagctgatggcagaaataaagcctcagctaaggcccagggagagggaagcagatgagatgtcagtgatgggaagaaaagggtctgtttcaattggcatgcttccaaacacccctcaaatgatccacacgaaacaaatcagaacaatttgttgagcttaccagacggttactgcgttagcactttgaattttcatagtgttttacagaattttagttatccctgtcactctgtagaggtggttggcatcattatcacagaatcagaaatgcacagaggatgaatctgcctcccaggggcattcgttaccaagtgtttatctttcaccgcacatactgactcttctgttatcacacagccgattgggctgttatctcgggcctctccaaaaataaatgtgtcccttttagaaaagccctgctttctttgtctttcttctgtctgtatggcctatttgtgcagaatg

SEQ ID NO: 251203 - DNA, 564 bp, Homo sapiens
ttaccatctgtagatatgaaggatatctgaagaacaactggattcatttcatattaacagtgaagaaatgagatgggcccctttcctttgaagggtatcttgctaggaatacagtggtgctttagtgtctaggtagcatttataagctggcaaagctgatggcagaaataaagcctcagctaaggcccagggagagggaagcagatgagatgtcagtgatgggaagaaaagggtctgtttcaattggcatgcttccaaacacccctcaaatgatccacacgaaacaaatcagaacaatttgttgagcttaccagacggttactgcgttagcactttgaattttcatagtgttttacagaattttagttatccctgtcactctgtagaggtggttggcatcattatcacagaatcagaaatgcacagaggatgaatctgcctcccaggggcattcgttaccaagtgtttatctttctcccgtccaccacgcctgatatgggaatgctcaggccatgggagtgctatatcgggccttttcataaatacctgtgtaccatctacaaa

SEQ ID NO: 251204 - DNA, 616 bp, Homo sapiens
gagaggtcaccttccattcctattccctcccttactcatgctttatgatctcgaacaagtcccttcccctctccgaacctctgagtttcctttccctacagcaaggaagacattagaggagaaggtccttaagtggctccctgcttagtgttgacctgaccttattttgggcttagagccagaaggacacactccctccccattgggcagatagggaaactgaggttggggtaagaaatggaatatggttctgaaggaagaaaaaagaagtctattggcccatgaaatacccagaagttgggagaaggaagaagctctcataggaaccagacctggacaaccctttgagcaccagcttggacagcttctcagcttccctctcttctccagccctgacccaggctggagtggacagatggaagtgcagtctcacttgaactgtcgcccttttccaggcaggcagctcttccccaacccatcagtgaggagggggcgtggctctctagattttaaggcttggccagcctagggctcccgtatctcaccccaccccaagccccacccagtccagctatgcagaggaataaaatgctttattgattaaatgattattcag

SEQ ID NO: 251205 - DNA, 380 bp, Homo sapiens
taagttatttaatttcaaatccaactcagaaagcacagagagctgcttatgctcattgctcaagtgacagcctttttgacagacccacataggtgcctctctagtcaaagacggaaaagacagtcactataatacttcatcaaacaccttctagacatgaggcaaattttttcttcatgaaatctcggaggaagcattggaatatctcccagaacaacttataaaatatccagtgaaattataataactggaggctgcaaaaactaatcacttattttgatgattacataatgtttttatttttaaacgtagattacaaaagccaaaacttaattttttctgcacacttatttgagctattaaaacttcttataaatgcc

SEQ ID NO: 251206 - DNA, 411 bp, Homo sapiens
cctataaaacacagaattaatggaaagtgagtatcttggatttcagatctgaagagatttttaccattagtggtttgattttaatctgcttggttaactatcatatttttcatacacttctctgggtttaaaatgtcttgaggtattttgccactggcttcatgctggagtaatgggtaacatatctttggtatggttcccttagattcacttacctagtcagacccagaagaacttcttttactagcttgcttcctaaatgccttttttcctttccttttggtctccaaatggcctggtcagcttttggtaatattcttcctcatcttccacctagcttgagaaggatgttctccatatagagttaagcgagtgcctaatcccaccttttgtaagattttgttccctcat

SEQ ID NO: 251207 - DNA, 364 bp, Homo sapiens
ttccttatgatttttaaattggtttaaaaaatttaacatacataaagaaataatatgaagaataaaatactaatttttattttttatatatagagtcctaaatttggtaagaaatcactaatccattaagtagaacagtaaaatgaaacaacaaatcataaggaaaaattaacaatggccagtacatatagtgaaaactttcagctattcaaacatttaaagaaacagaaattaggtggctcatgcttataatcgcagcgctttgagaggtcgtggcgggaagatatcttgaggccaggagtttgagatcaggctgggggcaaggtagtgagacccttgtctctacccaaaaaataaaaataaa

SEQ ID NO: 251208 - DNA, 465 bp, Homo sapiens
gctcttccttctcacccaggacttcacattcacccttgcaatccatgtggggacactgttggataggaggcgtggtcccagcgtggtctccctgtctgggcctctgcctatgccaaatgtttgccttacgctgcacactcaagaggttccatgtatacagatgggaattccagagctacagaaaaggcagcaagcaccatgatttaagctaaccagtgtggattcacaccttcctctctctctatcagtggcagaactaccagctagagtaagaagtggttgatccaggacctaaacattctggaaactcttgcccacttctgggagaaatgacccaatccatagtactaagcacaccttaactttcgtaggacgcaggcaagttgtcataccgtgtgcctaaatatagaaaaatgatccactggactaataaagtgttaaataaaatatgtcctgactgtctac

SEQ ID NO: 251209 - DNA, 516 bp, Homo sapiens
ctagttacctaccttacgatttgctgtctaatacatagaatacatcattacagaatcaatctttctcaaattcattccaatactatcaagctcctctttagaaaaatttaataacttcccattgtccttagaattaagttgaattttcctgccttgctaagcaagacttcctgcagccttgcttcaacacaaattgaatgtttttttaaaaaaagatattaattttagttttttgtttatcctagatttattcatatacgatacagtgataatgtcttgtaaaaattgttaaggagagaaaatattctgatgtacatgaaaatgttaagaaatgattattctgtttgtgaattcattgactcactggtctgttgatatcaaaacaatttctcctattgacatgagagcaaagttgcaggatagttttcatattcttaagtgtaatctcccaaaacaaaaatcacagcactgctgtgccaatagaacaataaaggaaatattgtttcataagagttg

SEQ ID NO: 251210 - DNA, 413 bp, Homo sapiens
tatccctgcctgacatacatgcagtaggtgttttgtagaggaaagtgttcactgaaagaagaagaatttaaacaacaacagaagcagttcaaaactagaacctggagatagtactcagaaagcagagcaccttcttacgtcaagaatgtgttcaggcttggagcctggacagggatctgtgctacccactctgagtgcccactggcctccgctgacacacaggcctgcctcgcccagtggactggatcctcgtcacgtcgcatcccgagttcccagcagagtgcctgcctcagcctgagactcagtacatatttgccaccatagccctgatgccagaagaaattagtttctctcttcttgatctgttcatgttagattaaaaatcaagactttctagccctcaaagatcctcc

SEQ ID NO: 251211 - DNA, 612 bp, Homo sapiens
agaacctgtcggccgccgagttctgcagctcgatggcattgcgaggccgaaagcagaatttccaggacctctgagagttgaagtcgttattcggggggaggggattctgtgagcaaaatgtgctgctgttagcattcacggtcacctggtgatgaagagtgctggggatttggccacagtaatggccctaacccagaaccctctttgtcctggagcaacatagcagctctagtggcagtggcgtcaaacatcagattggctcatattctagccgataccctcttagtgtgtgccagtcttagtgttgactgatacaccctaagtgggactgtggttgctcatgaggagggaaaccgaggccaggtgataggggtggaaggaaacacgctttccctctaaatgctttgggacctgtgaatatcataccatgtgcatttcttattcactctttaaaatcaaatgtttttaatatcacttcttcaagaaagtgttcactgactcccccgagagtaaataagatagattaggtttcccgtcacgattccattgcagtctgtacttttaccgcgagagctcttcgcagaattatgaataaacagtaatgagtgtgca

SEQ ID NO: 251212 - DNA, 422 bp, Homo sapiens
gactgctgttaaccatatttgcttataaaacatataacaaattaattagggttgtaaaattttcttaaatatgaggagttaaattagtaataaaaaatacaaaatacattttggttatggaggtattaggtacctcttacttcctctctagcaagttgggttggtctgaggcaccatatctcccagctgtctaaacgcaggtcagtagctgggtctgcgcgtggcgcctgtaatctcagctactcggcaggctgagccaggcaaattgcctgaacctgcgcgacagcggttccagtgagccgcatccacgccactgcactcccgcctcagcgacacagcaagactacgtcaacaaagcaaggaaacgcaacaacggaacgacaaggacacgacagcaagacaagaaaagcacggcagcaagg

SEQ ID NO: 251213 - DNA, 1389 bp, Homo sapiens
ggcgaaagtgcttcccttaagcttctgaaggttggctgcagttccggctacctgtgtagtccgagtttccacagccaggtactactccgccagtgaccctggacagtaacaaaacatataaagcccgagcccaaaccccgccaccatcataggtctgtagttactgtggaatcaataagccatggcatctaagaaatttgctgttaaatgtgggaattttgctgtcctcgtggatcttcatatcttgccacaaggttcaaacaaagatacaagctggttttctgaacagaagaaagaggaagtctgtttactgttaaaagaaaccattgattcaagagttcaggagtacttggaagttcgcaaacagcacaggccatcaaatgcagaattcacaagatccaatcccttgtccttaaaaggttatggctttcaaatcacagcctatttcctcaagagagggatacgccttcgctgcatcaggagcacacagaatgctgaactctgtgtattccctgacagatttgtggtttgtgtcagtcagcttgcattcagtcgtgatcttttagcaagtcagaatgaagatttgacagaaagagttctccatggagtgtctgattactttgctgagtgtgcagagagttcacttcctcccagtgcaaagctccggagaaatgctctgaaagaaattgtgaaaagaactgaaacaaaaagcagtgtcacgagcaaatcgcagaccagaagagacactgtggaaacatctagtgactcagtgattgcagagatagcaaggaggaggaatgatggtcaggcttcctccagtcccccatcagaatccatgggacaagcaaaggattccataaaggcagctgagagccactgggggcttcctgttcaaaagctggaaaaagttaatcagacccagccagaagacactagtggccagcaaaaacctcatcctggggagcggttaaagacagggcttctaagcaggagccccgtctgtagctgtgagtcagcatcaccatgtccaaaacaaagtccacgagtggccaaaacccaacagaaacgcaggaactgcagctctgcggaagacttcgaccaccacgggagagtttctcttggaagtgatcgattagtcccgagagaaataatagtggaaaaaagcaaagctgtcagggttttgccagcttcagagttgtcagatccagggttacttttgaaacaagatttggcaaaaaccacgtctaaggaagagttgcatgttttggaaagtctctcctccagacatcttatgaaaaataacccagggcaggcacagcaaaccggcttagccacaaacactgaaagattatctacaattcagaacagcccaaccaagaaaaaaaaaaa

SEQ ID NO: 251214 - DNA, 210 bp, Homo sapiens
ggcgaaagtgcttcccttaagcttctgaaggttggctgcagttccggctacctgtgtagtccgagtttccacagccaggtactactccgccagtgaccctggacagtaacaaaacatataaagcccgagcccaaaccccgccaccatcatagagaggatcttgctgtgttatacaggctgctcttgaattcctggtctcaagcaatcctg

SEQ ID NO: 251215 - DNA, 1049 bp, Homo sapiens
ggcgaaagtgcttcccttaagcttctgaaggttggctgcagttccggctacctgtgtagtccgagtttccacagccaggtactactccgccagtgaccctggacagtaacaaaacatataaagcccgagcccaaaccccgccaccatcataggtctgtagttactgtggaatcaataagccatggcatctaagaaatttgctgttaaatgtgggaattttgctgtcctcgtggatcttcatatcttgccacaaggttcaaacaaagatacaagctggttttctgaacagaagaaagaggaagtctgtttactgttaaaagaaaccattgattcaagagttcaggagtacttggaagttcgcaaacagcacaggccatcaaatgcagaattcacaagatccaatcccttgtccttaaaaggttatggctttcaaatcacagcctatttcctcaagagagggatacgccttcgctgcatcaggagcacacagaatgctgaactctgtgtattccctgacagatttgtggtttgtgtcagtcagcttgcattcagtcgtgatcttttagcaagtcagaatgaagatttggtgagtatgaaaaaattctataaacaaataagtctgcttaaatgctgagttactgtaaaaaatagaaaacaagaattgtctgctgttgtcattcagctgatgagcacccaacgcatgttttaagggaacaagaagccctacctgttttacgtggtaatatcaactaattcgtgtattgttcttcttttcctcaagaccattttaatcagcagtaccttttccatatcaactgtaaatgagaaagcaacacatcacaaaagctgtgatggtgcttatgatagtgtttaaatgaaataaagaaaagtctttaagtgaaatgaagcaaaatccacatgtttccactggaggctttcattggggtcagtggcttttaaattttattccatggtgaatcaccgacattttcatgagaaccagtacttttccccagtgtattatttcatagctgatagggttcattttc

SEQ ID NO: 251216 - DNA, 1033 bp, Homo sapiens
ggcgaaagtgcttcccttaagcttctgaaggttggctgcagttccggctacctgtgtagtccgagtttccacagccaggtactactccgccagtgaccctggacagtaacaaaacatataaagcccgagcccaaaccccgccaccatcataggtctgtagttactgtggaatcaataagccatggcatctaagaaatttgctgttaaatgtgggaattttgctgtcctcgtggatcttcatatcttgccacaaggttcaaacaaagatacaagctggttttctgaacagaagaaagaggaagtctgtttactgttaaaagaaaccattgattcaagagttcaggagtacttggaagttcgcaaacagcacaggccatcaaatgcagaattcacaagatccaatcccttgtccttaaaaggttatggctttcaaatcacagcctatttcctcaagagagggatacgccttcgctgcatcaggagcacacagaatgctgaactctgtgtattccctgacagatttgtggtttgtgtcagtcagcttgcattcagtcgtgatcttttagcaagtcagaatgaagatttggataaccagagcaccattgcctgcttccttcttcctgaaggaaggggaaaatccacccttcacaattaaagtcctggcactgagccacatccagaggaggctgatctatgccctcccaataccaggggtgtcccagacagaagcatctggcagctacccaaggaattctggggtcctgcagaatccaagtttacaaaccaccagaacaaggttttgcttcaggatagtgtttgactccactgctgcgaaatgactgtctcctggctagtaggatctagatttctccctccctttgaccccaccttgtggaaacccagctgtctactggcagacattggtgagaaagcggagctacgctagggcagggagatgtcatggaaacctcaactcttcgctgtccgggtccttcaggccacctccccaatgagccaaaacagtgttggccct

SEQ ID NO: 251217 - DNA, 979 bp, Homo sapiens
ggcgaaagtgcttcccttaagcttctgaaggttggctgcagttccggctacctgtgtagtccgagtttccacagccaggtactactccgccagtgaccctggacagtaacaaaacatataaagcccgagcccaaaccccgccaccatcataggtctgtagttactgtggaatcaataagccatggcatctaagaaatttgctgttaaatgtgggaattttgctgtcctcgtggatcttcatatcttgccacaaggttcaaacaaagatacaagctggttttctgaacagaagaaagaggaagtctgtttactgttaaaagaaaccattgattcaagagttcaggagtacttggaagttcgcaaacagcacaggccatcaaatgcagaattcacaagatccaatcccttgtccttaaaaggttatggctttcaaatcacagcctatttcctcaagagagggatacgccttcgctgcatcaggagcacacagaatgctgaactctgtgtattccctgacagatttgtggtttgtgtcagtcagcttgcattcagtcgtgatcttttagcaagtcagaatgaagatttggataaccagagcaccattgcctgcttccttcttcctgaaggaaggggtgatctatgccctcccaataccaggggtgtcccagacagaagcatctggcagctacccaaggaattctggggtcctgcagaatccaagtttacaaaccaccagaacaaggttttgcttcaggatagtgtttgactccactgctgcgaaatgactgtctcctggctagtaggatctagatttctccctccctttgaccccaccttgtggaaacccagctgtctactggcagacattggtgagaaagcggagctacgctagggcagggagatgtcatggaaacctcaactcttcgctgtccgggtccttcaggccacctccccaatgagccaaaacagtgttggccct

SEQ ID NO: 251218 - DNA, 677 bp, Homo sapiens
ctaattgccattgagaaaaatatgcctaggccagaagattggtgatggtgggaatagcagggacatagtttagacaaggtcattgagcaagacgtttctgagaacttgaccactggttatctgagaagagacctgaatcgtgtgaggagtgagtcatgtgaatccctggggagcaggtacatgtgggagtcagagcatgggtaggtggcagaaatagggcagagcactgacaagaggctggtgtgagtggagacaagtgagctgggctgagaggagtgggatgagcccagagttgacagaggggccctgtgttgaggggcttgtaggaaatggtgagacattggggtttcattgcactaagaggggaagaagctagagtggctttgggatgtggtggtgatgatgtgctctaattcccgtttgaaaggtttactctacctgttgtgtgggtgatggacagcggcgtgaatgtctcttcatgtccattacccatttttgaatggcgttgtttttttaatggatgagttgtagttttttatgtattttgaatattaattcttcatcagatgtatgattggcaaatagctcctcccattctgtgcattttctttccactcttttaataatgtcacttgttgcaaaaaagtttttaaatctgataaagtctaatttatcat

SEQ ID NO: 251219 - DNA, 383 bp, Homo sapiens
atgaaataaaccaaaataacatgaaagtaaaaaatgcatggttcatctcatgagactagagacagctgatatccaagccacaatatatttggaagagaggccaaaaccagagaagaaaaaataaagtcaagagaaaacagagacaggaggtctgttggtaaaaatctcagaattaatcagcaatgtacatttctcctaggtaaaagacatggtattagtcaaggttctccagagaaagagaaccaataggtgatgtgtatatatattatatatacatatatatatatattatatatatataatatatatacacacactatatattttaatatattatttataatctattgtttctgattatatatacatacacaaacacatat

SEQ ID NO: 251220 - DNA, 389 bp, Homo sapiens
agttggggcatcagcccctacaggtgtgggtccttcttcaggactgtgtggaacttttccttttgaagaactttcctggggatgaccactctgcttggagtctggggtggagcctggtgtgagggagccagcgtagggtttgggtgcctgccccaccctcagaagcaggagcccagcagcccttggactgaccggtgctgttctggggctcccactggctccttccactgtggagcactcccgtgaacactgctttggtttgagtaccagtacaagtgttgggtgtatgttcctgaccttgaggcattcttgattgtgcagttacctagggtatgcttgtgtctgacatgatcattttttttttttaataaaaaatggcatggaaggag

SEQ ID NO: 251221 - DNA, 895 bp, Homo sapiens
  misc_feature (892)..(892): n is a, c, g, or t
atgtcaatttcattcactgtcaaatttaacactcaaaaactgacacattatatacactaaaacatactttttttatatttataagttaaatataaattttgcatcatttgtttattgtctgcatttcccacatgattagaagttcactgacggcaggctctatgtcctatactttataaaatgataagcaactagtaggtattcaataataatttttaaatgaatgaatatgttcatataaagtacatatcagggctggacgcagtggctcacgcctgtaatcctagcactttgggaggccaaggtgggtggatcacctgaggtcaggtattcaagaccagcctggccaacatagtgaaaccctttctcttctaaaaatacaaaaattagctaggcgtggtggtggatgctgtaatcccagctacttggaaggctgagggaggagaattgcttgaacccgggaggtagaggttgcggtgagccaaaatcatgccactgaactccagcctgggcgacagagtgagactctgcctcaaaaaataaataaataaataaataatttaaaaagtacatatcagtacaattctataacgtacatgtcctcaattccttttatactcatgcagatttatcatcatggcaataagcatgaagctgatttattgctattcaccacgagaaacaaaggggaagtagaaagacatctctgaaactagagagagttgctaagaaaatagaatttataaggaaacataacttacaaacagcataggtaaagtatctttttcttaaaatgggacgcatttacgtgcaaatgtttattattaagaaacacattattgttttactgaatgttaaagccaagtctctttgctttatcttatttgtatgnaca

SEQ ID NO: 251222 - DNA, 802 bp, Homo sapiens
gctagcttggatgggaacaatgatgatgactttggaaactgcatcttgaacaaggcaaacgtccttcagctggtccctggtcccctgaggtctccttcacctgaatcctgcttctctgccttttcatgaaagaatattatatgagcaagaaataaacttctattgaattagcttctaatttgaggcccatagatctccaaggggtctgtagattgaattcaaggggtctgtgaacttggaatgggaaaaatatgatttttactaatgtctttcttacctcaatttagcattttcttttgttatgagtataaacaacaaaccagtcgcattagcagtacctatgaaaagtatttttgtatcacattacaattgtaacaaatatctgaaatttaattcatactcatcaagattttaaaaatatagtagtaatgaacctgctggtatattttatttgatgttttaataaataagcatctttattattatatcataaattattttaatactttagcactgcatttcaatgtaattagtttcttttgaaactttaaaaattttctttcatgtatttaaaaacactattttgatgatgtgtacacatgggcatagagagtaaaataataaaggttggagactcagaaaagtgggagagtggcagggggactatgggcgacaaatccccacgtccatgctacttttcggggttctctacacaaacacccgtgctttcccacggaatcgtcttcgtgcacaaatccccctggcccccctaatgcaacaggaacactgccgcccacccaac

SEQ ID NO: 251223 - DNA, 816 bp, Homo sapiens
gctagcttggatgggaacaatgatgatgactttggaaactgcatcttgaacaaggcaaacgtccttcagctggtccctggtcccctgaggtctccttcacctgaatcctgcttctctgccttttcatgaaagaatattatatgagcaagaaataaacttctattgaattagcttctaatttgaggcccatagatctccaaggggtctgtagattgaattcaaggggtctgtgaacttggaatgggaaaaatatgatttttactaatgtctttcttacctcaatttagcattttcttttgttatgagtataaacaacaaaccagtcgcattagcagtacctatgaaaagtatttttgtatcacattacaattgtaacaaatatctgaaatttaattcatactcatcaagattttaaaaatatagtagtaatgaacctgctggtatattttatttgatgttttaataaataagcatctttattattatatcataaattattttaatactttagcactgcatttcaatgtaattagtttcttttgaaactttaaaaattttctttcatgtatttaaaaacactattttgatgatgtgtacacatgggcatagagagtaaaataataaaggttggagactcagaaaagtgggagagtggcagggggatgatggatgagaaattaccaggtacaatgtatattatttgggttatattacactaaaaacccaggctttaccaccacacaatatatccatgtaacaaaactgcacttgtaccccttaaatctataaaaataaaaaatatataaaatacaaaga

SEQ ID NO: 251224 - DNA, 634 bp, Homo sapiens
cgaggtcttttcctcaaatgatccacctgcctcggcctcccaaaatgctgggattacaggcatgagtcaccatgcctggcccctgttaaactttctacctagcaatgtggttagtcttcccatcccactgtatagcagtttcaggatgatgctgcctctctaacttggagtgctgaacaggaagtaagagttggctttacggtaggcagctgccaggctagcataaattctggcataccagaaaatccctttgatccttcctaaatgcttgtcttactttgtgccaaatgactaatgatttaaagcagtggttctcaaccctgcctgtatatcagaaacacccacagaacttttaaaaattatctagagaaactgccccacctgacattttgattcagtagcctcgggtgtagtttaaaaagctccacaggggagctctttcctttcgctgctgtggccgcagccttgagtatgctcaggcttcagaagaggcttgcctctagtgtcctctgctgtggcaagaagaatatctggttagaccccaatgagaccaatgaaatcaccaatgccaactcccgtcagcagatccggaagctgatcaaagatgggctgatcatccgcaagcctgtgatgg

SEQ ID NO: 251225 - DNA, 470 bp, Homo sapiens
ggtggatctgacctagcagtgtgtgtgttcacggcttcccagaggacacagatgagagtcacgttcgggaacattgcagtaaatagacacaaatgcgggatggaggcagtgcgtggtggggaggaaatgcagagacctcgtggaggaaatgagaggcagctcctctgacccaggaagccagcagaggctgtttccatagggacagagcaccgcagtgtgagagaggattgggctgggactgagaagggcgttcctgctgtggtgaggcagccctcagggtctctcctggcacacagctgccagcgtgatgggggatcccttcagaatagcagcaaaacccacgatactgaggagtaactcaaaccaaacttgtgggtctcacagagaggatatcgtcttgcccatgtaaagattccttttagatggtttctggtgtttactaatgttgttaataggtgtatttttctacc

SEQ ID NO: 251226 - DNA, 529 bp, Homo sapiens
gtgtttgcattagatttcgcattggaagaagcggcgatcctggcggccaagccccccgggtggaagcgcggggcaccaagtggcgctccggcggggtgacactgtttgatctgtgactgtttggaaggtggagcagcgcctgacatctccccccggcgcatgtatgtacgggggcttcactcctctgtcttgtttgctttcttcctcttagactaagtgcggggaggaaaaggacagcctgcatcggcctcgctggcgcacaatgagaaagctgcgacccgcgcactaaaaacactcgccgcgacccccaaacagcgaggagagagggggagagaaagttgcgctcggcgactctcggctcgcggaagaaggcgcaggggagcgcccggagcggcgcgccgggaggagcgcccgcccagcagcagcgcggcggcggggaggccgcgccggggatgactccgggctcggcgcccaggccccgcgcgctccgcccgcagcccggcggccgggacgcggcccgcgcggccgc

SEQ ID NO: 251227 - DNA, 590 bp, Homo sapiens
gtgtttgcattagatttcgcattggaagaagcggcgatcctggcggccaagccccccgggtggaagcgcggggcaccaagtggcgctccggcggggtgacactgtttgatctgtgactgtttggaaggtggagcagcgcctgacatctccccccggcgcatgtatgtacgggggcttcactcctctgtcttgtttgctttcttcctcttagactaagtgcggggaggaaaaggacagcctgcatcggcctcgctggcgcacaatgagaaagctgcgacccgcgcactaaaaacactcgccgcgacccccaaacagcgaggagagagggggagagaaagttgcgctcggcgactctcggctcgcggaagaaggcgcaggggagcgcccggagcggcgcgccgggaggagcgcccgcccagcagcagcgcggcggcggggaggcggcagcatggagcgcgggccgcgggccggcccgccgagcgcccgctgctgcgcccgcggcccgcgccggggatgactccgggctcggcgcccaggccccgcgcgctccgcccgcagcccggcggccgggacgcggcccgcgcggccgc

SEQ ID NO: 251228 - DNA, 230 bp, Homo sapiens
tagtggctaccatctcagatagtgcagctctagagagttttctggggagctacaaatttttctctcgactgttaaactttttttaagtttagatgaaaattgttctaaagcttatgttggcacttcactacctccttaatgaaagaacactgatctactgtttttgatgtcttgacatcaaaactatgaccaatttctgtactacgacagaataaaacgatgacctactg

SEQ ID NO: 251229 - DNA, 434 bp, Homo sapiens
gagaccagagctgggactgtataatatgaactgggtcttcaaggatgggttagcagtgtctgacactgtatatggggggaaaagaaacttctagactgaagaaacccttcaacatatgcctagggctggggaaataatgatgcagtcccagaaagaaaaagtagatcctgtgctttcaaagcgaattaggcaagatacaggaaaggaccaagccagggaggatgaggagtgcctgggtgagaagactgcagcaggagaagtttcagtggaaagggatgtggtcagatccgtgctcttgggtgatgtttgtaaatgaatctgatgagaagggagatgaagccatgaaatcattagaagttcattagaataattggatgtaggagacagcaaagataataataataataaaagaggatttaaaattatgattcaaa

SEQ ID NO: 251230 - DNA, 388 bp, Homo sapiens
tccacgtggggaatgctgacagcctagcactcagcgtcagagctcagcagccacaaggggaagagggcatcttcccagagctctagtggagaagtcttggggaaggtgtgaacggaactagctttgctcaaaggtccatttctgagccaaactctgtggtgagggtgggcatgctggccacagcattctggtcagccccacctgagcggtgtggaatgggctctcctcgggagagggtgattctgcctctagaaggaggagaatgggatactggttagaaaaacaaaaccaaaaaccagatgatactatctttctttgtgttttaatttcttgaagtacttctttgttgcacctatatatggtccacattattagtaagttcttattt

SEQ ID NO: 251231 - DNA, 458 bp, Homo sapiens
tacagttttccttaatgaggaaaattctgttatttaataattcacagtcaaaattacattgcatatctaaagaaagtttgagattatctgggacaaattgtttcctccatgctatgagttgcataagatagtagaaatagattacttctctaaaagtaggaatgttatttcttttgtgatttggcatttttccttctcatttgttctgatttaactcactacaaattctacttgctcaaggtagatcctcactactccatggcaagcctttggttcatctctcttactgacaaccttatatacattgccaaattgcaattttcagacctttgctcttgactcaatttcccctattttctcctcttcttattatattaaaggccatcagagctaaattatttgttctttctatttgcttgtaattctcagttagtggctgcttctacttccttattatt

SEQ ID NO: 251232 - DNA, 609 bp, Homo sapiens
ctccggatttgatgcaccaagaatgaggagaaatggcctcccgtcttgtgaacttcaatggggagaaatagttagaatgagcaatagaaatgcactgattcccatacatgcatatacagataaaaatatatgatttgcaatgtagaatttcagacctataatttaaattatattatatatgtttacatcataatatatatatattatatatatattatatatataaggaagataattatataataaaacatgttagtgtatcactacatatgactatagtgtatattatatattatatgaaagatatatttacaatatatagtataataaatttcaagtgttatagttaataaataaatataggtattaatgtaaatatattatctattatgtatacattatgtataactataatagaaaaaatattttatatttaatcataggtttatatcaaatataaattatacattatatattatagtgaatatatgtaacatatattataagttataaatcatatacaattaacattatatacattaaattatatgtatatgtcaagattacataattaaaaatatatttgttatatattatacatttgcataa

SEQ ID NO: 251233 - DNA, 420 bp, Homo sapiens
gtgtgggaaatatgttgtccttggtaaaacctccccttaggaaagaaggcaagagaattgagtaagagaatgatgggccaaaaggagaaaatagagaaagaggctgcatgctacagagaacaagagcaaaattcaaaagcctggcacagttgggcttgaaaccatctgtgtaaaggggactaataatgctgacctcactgcatcacaaatgacagagtttaaaatgatggtgtttttaagggacctagcacgtattaagaatttaatacacattggttttcctcccttctcctagggattagggaaagcacatcactttgcttaaatgcgtataaaaaggcttcagactgcttcttaacaatgagaatctttgacagtgaatatgcaagccaaaaataaagagtggttgagaaactttga

SEQ ID NO: 251234 - DNA, 471 bp, Homo sapiens
gaatcagaattctggacttacacttttgttttagcttcttcttacattattattcatcttttaatgtgtccctttctacttccaactataaacattcagtatgagtttcatttatctgttaaatgttttcctcatctagagactgaagcgtgtcattagaataaattgctgagattggtaggaggattctaagataagtaagaattaaagtgaaattaaggccgggcatggtggctcaggcctgtaatcccagcattttgggaggccaaggttggtggatcacttgaggtcaggagctcaaggccagcctggccaatatggtgaaacaccatctctcctaaaaatacaaaaaattagcctggcgtagtggcacactcatgtaatcccagctacttcggaggcagaggttgcagtgagccaagatcccgccactggactccagcctgggcaacagagtgagactccatctca

SEQ ID NO: 251235 - DNA, 237 bp, Homo sapiens
gccgccgcctactactactactactactacattctcgtccgctacgacgtggctcacgcctgtaatcccagcactttgggaggccaaggcaggtgaaccactgcccctggccccaacactcattttcaaatgagcttttagcagaagtgggtatctattagtttcacctaagctgcctcaaaacctatcgcagccttcagtgagtttcaggaacttcagtatcctaatgaatatttg

SEQ ID NO: 251236 - DNA, 285 bp, Homo sapiens
aatgctgtatagtattccagcctgcgagtataccacagtttatccatttctgctattcatggctatttggtgttttcagctttgggctactgcaaatcaagctgctgtgaacattcttgcacatgtctttcagtagacataagcactcatttctattggtgtatacctgggagtggaattgttatttcatagaatatatgtacgtttagctttggtaggtgtgacaaatatccatatatttttctaaatttattttgtatactgataacctatgatttaccagaa

SEQ ID NO: 251237 - DNA, 417 bp, Homo sapiens
ctccacaggtgtcagatgtgtaccgtgttctgaagactctccccaccttctccagcaccctccccctttgtccttcacaggcatttcctccaatcagtctttcgtcttctgcttcatggaagacctgacggacacagacaactcatctttacatcctccatgcctgggacattggcagggattctgcagcagtgatgaagagcatggacacaaatcataacccgggacttgttccatgggtagccttgagagcaggtgacttcaacctctctgaaaccgagtttgaggtcctcatctattaagtggtattgatattaatagctatgtcttacggctgtttgagaatgaataagttaatgcatgaatacgtttagcacagtgcttaaaaatcacaataaatatctaatacaatataac

SEQ ID NO: 251238 - DNA, 358 bp, Homo sapiens
gctgggactacaggtgcctgccaccatgcctggctagttttttgtatttttagtagagacagggtttcaccatgttagctaggatggtctcgatctcctaacctcgtgatccacctgctctggcctcccaaagtgctaggattacaggcgtgagccaccgcactatgtgtttttttatgtgtaggtgatctcaatatctcatagatatttaattcaacatttgccattgcattactagacataaaatatttcatttaacacccaattcttccaattgattgatgaaaataaatccataatcaaaagaatttgataaaaaataattacttgacagttattattttttttcccaattaac

SEQ ID NO: 251239 - DNA, 200 bp, Homo sapiens
tgagacaggaatctgttgaaaggatttgaacagttgattgaatatgttaggaactttgaggttgagttgagcttctaagatgattgaatggtgggatgaatctgttgtataagagaataccaatttggcaggaggataacacattctgcatccctcactgaattcagtaataaataaaaatgtgtacctgtgatgaaaag

SEQ ID NO: 251240 - DNA, 967 bp, Homo sapiens
tgttggccaggctggtctcgaactcccgacctcaggtgatccgcccgcctcagcctcccaaattgctgggattacaggcgtgaggcagctcgcccggcaaccctcagctgcctctcatatgtccttggccccctggccatctctgaccagacatctaggaggcccctcctgccaatatgcttccccgacagccgagcccaaagctgtctccagccctgcaccttgtcttggttccccgggtgctccctttcccaggctgaagcctggacagccccaggcaacctctctccctgaccacagtaccacctggccacatgccacactgctttctacagcagacaccgcctggccacaaagacttaagccacttccttgggtcctgctcagcgctgagcccagagcccaatctcagggactgggagagagcccagtacatggccagtgggattctcccgatgaaaatcccagccatgcgaggctggcttctccaggttctctgaggcctgtgagtccagggctggctggagggaaagcccctggccccttaaagccactgatcatgttcccatagagggatcctgagaatcccctgggagagaaaatgtcggagccccagtcctggcacccccctgaccagcttgggcctcagcctcctcatccatgaaaagaatggacaagaggggtctgggtgcggtggctcacgcctgtaatcccagcactttgggaggccgaggcgggtggatcacgaggtcaggagttcaagaccagcctggtcaacatggcaaaaccctgtctctactaaaaatgcagggattagccggttgtggtggtgcacgcctgtggttgcagctatttaggaggctgaggcaggaggatcactggaacccgagaggcggaggttgcagtgagctgagattgtgccacggcactccagcttgggcaacagagccagactccatcttaaaaa

SEQ ID NO: 251241 - DNA, 324 bp, Homo sapiens
tgttggccaggctggtctcgaactcccgacctcaggtgatccgcccgcctcagcctcccaaattgctgggattacaggcgtgaggcagctcgcccggcaaccctcagctgcctctcatatgtccttggccccctggccatctctgaccagacatctaggaggcccctcctgccaatatgcttccccgacagccgagcccaaagctgtctccagccctgcaccttgtcttggttccccgggtgctccctttcccaggctgaagcctggacagccccaggcaacctctctccccccccgccccaaccccggacacggattaggatc

SEQ ID NO: 251242 - DNA, 594 bp, Homo sapiens
gtgtgtccagatgagaaaggctgggagggtgacctggttcgggaagaaaaaagtaacgtttaaagttatagggcatgtcatgattagagatgcctgtgagccacatgaagctattaaatgtgcagtgagatatatgaatctgaagacagactcaccagactataaatggtgtatcagcttcacatatgctgtaacaaattaccacaaaattagggtctttaaaacaactacaaattggccaggcgcggtggttcacgcctgtaatcctagcactttggaaggccgaggcgggcggaatcacaagggtgaggagatcgagaccatcctgggcaacagagtgacactccgtctcaagaaaaaagaaaaatactgtgaggcaaaacaaatcattcatggtttgtcaatttatatttattttacaaagaacagtaaatgttccatctggcagtactaaaatgcctcgtacttaccagttactcaaaggttattctacctaaactgagagcaagctggccatatgagtaaactgaaaaatagaacaatgttacctaaggccaggtttatagacaagcttgccttcatcttgaactcact

SEQ ID NO: 251243 - DNA, 386 bp, Homo sapiens
ctagtacgtgaattggagaaaaagtttgggggaagcatgttgtctttattgctcagaggagaattctgcctaagccaacccgaaaaagctgtacaaaaaataagcaaaagcatcccaggagccgtaccctgaaagccatgcatgactcaatccccgaggacttggtcttcccaagtgaaattgtgggcaagagaatccacgtgaaactggatggcagccgtctcataaaggctcatttggacaaagcgcagcaaaacaatgtggaacgcaacgttgaaactttttctggtgtctacatgaagctcacaggcaaggatataaatgttgaattcccagagtttcaactctaaacaaaaatgactaaataaagtgtattcacagtaaaa

SEQ ID NO: 251244 - DNA, 359 bp, Homo sapiens
tgtcacagaagccgggcatgcagcactcactgtgaagcaggaaatgaggcttgtccagaatgccttgctctggtggaaccaaactgagtttgagaggccattcctgtgtttcagagcactttcaaaactattttctaaataccctgttacagaatttcacccaagctattggtggtcaacatcatctttcaatagctactatcttgtttttctttaaattaggatatttgccttctctagtgttctgtcatctctcctaatctccacaactatcaagtatttcggagagcagattagcaacctcaaccgaaagttttgaactttatcaatatcatactttatttttttaaaactgaaaa

SEQ ID NO: 251245 - DNA, 580 bp, Homo sapiens
tcttcctagtgacaactggttggagcaatgttcgctctctagctagtatctagacatagagtaatgagcatcaaccaagtatgtgcccaggcttgagaatctgccctatagaagtacacaatattacattaaatatttacaaagatctcactttccaacttgggcctggcagagtggctcccgcaaagaagggtggtgagaagaaaaagggccattctgccatcaatgaagcagtgaccggagaatacaccaacatcattcacaagcacatccatgaagtgggcttcaagaaacatcccccttggacattcaaagagatctggaaatttgccatgaaggagatgggaattccagatgtgtgcattgatactaggttcaacagacctgtctgggccaaaggaataaagaatgtcccatacagtatctatgtgcagttgtccagaaaacgtaatgaggatgaagatcctcattaagtaagttgtatactttggttgcctatgtacctgctaccgctctcaagaatctacagacagtcaacgtggatgagaactaaccagtgattgtcaaatatatcaaagtt

SEQ ID NO: 251246 - DNA, 397 bp, Homo sapiens
gccaccatgccaggcctcctttgttctgtttctgagtgcatgaatcagcagccgtcatgcatgttcctatctttcttcatttcagaccccacagaggaggggttaaggtctttctactgcaatatgaagcgtgtatacacacaccacctgtgtagactgtggagtggttctgctggccacgagggaccaacacattgcaagtggctggatcttgtgaaccctccatctccataagtaaacattgtacctcttgagcttggtgggggtggtgtcttttctcagtgacctcaagtcatacactgtctcttccttgggtgacacctagttgccttgtaactttggctacagagccttatcacctggtgtacagtaaagcagttatgttgatgtataacaa

SEQ ID NO: 251247 - DNA, 889 bp, Homo sapiens
cttttttttttttttttttttttttttttgcagagagagtatctatgttcctaggctgatctcaaactcctgggttcaagcaatcctcccgcctgggcctcccaaagtgctgggattacaggattacaagcacgagccactgcatccagccttatactttggctcttgacagcctacactgcccaagcaatgccagagcactgccagagcaatgcctgcctcctaccagaacactttctttgcaataaatgagtatggaaaaaaatcacagaagtgagtacatgtctaatgtttaatagcagcacattttatgaagaatttgcttgcaatatattacataaaaaggcaggatgcaaaattgtaccacatggagctcacattaaaactcatacacagccagatgaggtggctcaggcttataatcccagctactgaaaaggctgaggcaggaggatcgcttgagcccaggaggttgagactgcagtgagttatgattgtgccactgtactccagcctgagtgacagagcaagaacctgtctctttaaaaaacaaaaacaaaaaaaaaaaggccaggcatggtggctcatgcctataatcccagaactttgggaggaagaaaaaaataagttataggttattggtgattgttcctttcttcttaaatactttcctaaattttagtttttcacaatgaaaatttttcacaagtgtataatgtaaaggattatacatgtgaaggacaataagctatctattaaacaacccattccaggctaggcgcagtggctcatgcctgtagtcccagcactttgggaggtcaaggtgggaggatcacaaggtcaagagatcgagacaatcctagccaacatggtgaaaccccgtctctac

SEQ ID NO: 251248 - DNA, 471 bp, Homo sapiens
agaacagtgtcctgggggtgtctggtttgctaggtgtgtggctggtgcagcaatgggaaggtggcgctttgactgcctggcccctcacatcttgctcctcccttttcactgctcctctggcctccagagtagccatgtaagcctgtgctttcacgtacagaattgctgctctaccctgttcttggcatttgcgtcaaaatttactgtgttccgctgacaaaattctagaatctcaaagctggaatggagttcaaagttatatacccttcttctttcaaagcatgaatatccaacatctgccgagcagtcatttttttccgtacttaaacacctataagcaaagaggaacttatacttcctccactttcagggatgtacggcttttggaaatttcgcctttctgttgactcaaacattgtttcccagtagcttcagttcactggttctggaccacctataaggggtagactt

SEQ ID NO: 251249 - DNA, 286 bp, Homo sapiens
ttcacttccaaatcatgatggtattgtcctctgtgctcttttgaaaagctttattgtttttgagaacacatggacacaggaaggggaacatcacacaccagggcctgttgtggtgtggggggaggggggagggatagcattaggagatatacctaatgttaaatgacgagttaatgggtgcagcacaccaacatggcacatgtatacatatgtaacaaacctgcacgttgtgcacatgtaccctaaaacttaaagtataataaaaaaaaagaaataacttcaagaa

SEQ ID NO: 251250 - DNA, 515 bp, Homo sapiens
gctctttttttaaatgaattttattgtatatatttcaggtttacaacgtgatattataggaaacatataggtagtaaaatagtcaccatagtgaagcagattaatgtaccttcatctcatgtagttactttttgtgacaggagcagttagaaactacttatttacaaaaatccctattacaattttatttactacagtcttcatgttatattaaatctctagactttttcattctacatatgactactttatttttttgacctacatctccccatttcctcccccaccctcacccctagtaaccactagtttattctttctgtatgtatcttatgtataagtgagattacataaatatttttctttctgtgtctggcttacttcacttagcataatgtcctccagctttatccatgtggtggcaaatggcaggatcctttgtaagagtgaataatattccattggtgtattagtccgttctcacactgctatgaagaaatacccaagactggata

SEQ ID NO: 251251 - DNA, 151 bp, Homo sapiens
tgatcaagtagagatactgaatgcctgaaaatgaaatgatggactctataaacataaattctgttctgtcaatgtattgcatgaactaattttgatttgcctaaatttatggcattttgtattcaataaaggaaatatttcttactttcag

SEQ ID NO: 251252 - DNA, 706 bp, Homo sapiens
ctcgtgccgattcgtcacgagctcagacttagctttccggtgtcttcgtgccatggtagggagttttaaggagccttcacccgtatctcctgtgcacctggagagtgacccgtcgctggccctttagctctcctctgttgatttactcctcgtttttctccctagagaatcatgagtggcttttaaaatgtaggaagaggaaaccatttaaaaataagtagaaaggaaagcagaaatgtccagaaaaggcaaagccatagggacagaaagggactcgtggtgattggaggctggggacatgaatgtgcaccagagacttgccagggacgtggaaatggacccgatggtcgggtcggggtgaccgcaacctggtgaacttacttaaaaatcttaaaacaaaatttttttttaagagttagggttttggccaggcatggtggctcatgcctgtaatcccagcactttgggaggccgagatgggtggatcacctgaggtcaggagttccagaccagcctgaccaacatggtgaaaccccatctctactaaaaataggaaaatcagccaggcgtggtggcaggtgcctagagtccaagctactcgggaggctgaggtgcgagaatcacttgagcctgggagatggtggttgcagtgagccaagatcatgccactgcgctccagcctgggtgacagagcgaaactccttct

SEQ ID NO: 251253 - DNA, 779 bp, Homo sapiens
cttttacatttgtgtgtccatttttcagatttttattgatttatagaagctctttatgtgcactggagattaatcacttgtctgttacatatcctataaatgattcttcccagtccattactcagttttctaccttaaatttatgatactggaagttatttttataaaatcaaagatcgccatcttcatttttttgatttctttgttgattttgtttattgtttaattatggggaccaaatataactacacttggtaaaaagtctctacatcctgctttgtctccttagctctgaagactcaggacaacgaaacaaaaccctaatgccctgaattcccaaggaaatgacctaaggttctctttctgtcgtgaagctaggagacctctgagatgggagtcagtgtgaggtctccagagatgtaaatttataattgagggccacaaggaatcagggagctggaggagactgcgttccacctggcatctagttttgctgcgaaagcaacccatggagataatcaaacaacttggcaacaagtcatatggaagagggaggaaaaaaagactaacttcccagagctggagggaaagcagaaagccatgcttaagctctcatcagtgggagccattccatcccaggatcctttcagcaaccaatttggaagtctaggcttttcagtaaatagttttatcttgtgtttcgaaaaagccacacttcatcttctgagcctcatattctcttacatgaagttactaaataaatctgtatttcttttatt

SEQ ID NO: 251254 - DNA, 591 bp, Homo sapiens
cttttacatttgtgtgtccatttttcagatttttattgatttatagaagctctttatgtgcactggagattaatcacttgtctgttacatatcctataaatgattcttcccagtccattactcagttttctaccttaaatttatgatactggaagttatttttataaaatcaaagatcgccatcttcatttttttgatttctttgttgattttgtttattgtttaattatggggaccaaatataactacacttggtaaaaagtctctacatcctgctttgtctccttagctctgaagactcaggacaacgaaacaaaaccctaatgccctgaattcccaaggtgagaaagcactggttacctggaagctcttgttgttactgaaaatcttgtcgaggtgcttgacactgctactcagtgtcaaggaaaatcaagtcaggataatcaagaaatttgagttctcctttgctgatgaaagactgcatacagacattatgctaaccacaaactttcagtttcatcattaagaattggaggaagaggagctagtgctgggacagtctaagagacacttagcagtttttttctttta

SEQ ID NO: 251255 - DNA, 385 bp, Homo sapiens
attcacccttgccatttaatatattacaggtgtcacctgttaagatgtgggcatatttgaggggccattattcggcctctcctagccagaactgcatctgacaaagaatccaaagaaaataagacatactcataaagaatccagagtatgaaaacttagaaaaaattcagtgctctaaaagctctccatgtttgaagtttgtgttgtgatttttcccagtgatgatctcaaaaataaaaatcctcatggtttatatttgagggccacaaggaatcagggagctggaggagactgcgttccacctggcatctagttttgctgcgaaagcaacccatggagataatcaaacaacttggcaacaagtcatatggaagagggaggaaaa

SEQ ID NO: 251256 - DNA, 840 bp, Homo sapiens
gcagctgaagaaatagtacagaaaagatgtctacgaaatactggaggacttaaaaattgcatactaattcgaattatacatgtaaatgccaaaatgtcaaaaaatcaaaaattatgacttcagtaattgtgcagaaacaatttggacttgacattgtcagtataaaatatgtttctgaagaatgcatatagcagaaattatgtaactatgaaaaaaaaccctaagcggtaattaccattttaagcagggtttgcatatcaggatttgcataagcaggcggctggtcatttacatgaatgaatgaaggtccaggtagggctgaggtcaacatgcccatcatgttggatagccactgcccagctccagcctatcattgccatgctggagaaggcaaccctctgcctactcttcctgttgtaacagaaaagttaaaaaaaaaaaaaatctgttttcatgtgttatctttcatgtgctgacaagagatttttttaaaaaactaaaatgccctgtgagcaaaacaacctatctacaggccagatagtctggtggcagctagtttaacctctcattaaagcttatagaacttacagtttttattgggattcacagttctatgattatccctttctttgagcagttaggacctttgttatctggttctagtttaactttccagctgatcttgctatttttctgttaatgggtccgtaactataaccacattattatctttctcagttcccaatttatcacgtacttttctgatctggttcctctggtcttacctttccctatttgtattttccatttcttctcccctgaacttgcctttagccacca

SEQ ID NO: 251257 - DNA, 447 bp, Homo sapiens
cagttatacatttattagactctacatgcattttagaatcagcttgtcgattttgatagagaagtcagttatgattctggtagggattacattgaatctgtagattacatatgttacaattaagtaatctacattgatgtattatcacccaaaataaatagtgtacattaggattcactcttggtgttggcttttcatagcttttagacaaattcacaatgatacataaccactaatacactatcatacagaggtttttttttactgccttaaatcccctgtgctcttcctgttgatctctccctctccctaatcctggcaaccactactccttttacatttatagtcataattgctaaaagtttagaaacaaccaagatgttcttcagtaggtaaatggatgaagaaactgtggtgccttgagacaatggaatgttattaccacta

SEQ ID NO: 251258 - DNA, 603 bp, Homo sapiens
  misc_feature (62)..(62): n is a, c, g, or t
atatgtgaggagggcagagctaaccaattgttaaagcaagaaaccacaggtctcttcactantcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctactagtttgcatgtttgctattctagatatttcacatagttcagcgtctgacctgaactaacttctgagccacatagttcagcgtcgtcagacgctgaactatgtggttttatatggaagcatattaataaaatccagggacatgttgagcaacacatgtagccatcaagttttctccctcttgtcacaaatcataacactaaaataaagtcataacaaacattggccaagaaaataatgtaagtgagatcttatcagtttaactttagaaataacagtgagagagaaac

SEQ ID NO: 251259 - DNA, 462 bp, Homo sapiens
tctctgggtatttggtggttcttttgatgctattataaatggtattactctttgaatttcattttctatttattggctgttggcacatgggaataaaatgaatttttgcataaaaatgataaaattagagtattaccgttttgcaactcccattgaattaatgcatctaggtattgaacatcaacagctgttaatatcacagaaaggcagactttatgagctcctgataaaaggaatctaacaggagtctgatcaagcctctgcgtccagctgccaatttgtgggaaacacaaagaatggagaaagacgatcttcctggtgagagtgtaatcagcaaaactgctactatgggaaattctacatatggatcaagatgctccaggctcttgaacagatcaactctaaggaaaataaagggatgcacagggaaacctgtggattaaaagagatttggaagacaaa

SEQ ID NO: 251260 - DNA, 944 bp, Homo sapiens
catgagatcatattgtgtatgctgttttcttcctctttttccctcatttactgtgaacatgttttatatactcttaaatattatttgaaacctagctgttagtagttacttagttgtaccacaatttattaactaatcccttgtagttgaacattaggttgctacccttgacttactattataattaaaatttaaaaagaaatacttcatcactctagttttgtactatctcaatatggtagccacttgctacatgtggctgttaagtaattaaatatggctagtcccaattaaaatatgctcaaaatgtgaatgcacaccagatttcaaagatgtaatttgaaaaaaagatggtacaatatttcattaataatttttatattaattacttagtgaaataatattttggttatattaggttaaatgtgatatatttttaaagtgatttcatttttgcctttttgcttctgaaaaaagcaaaattactatcagaaaattaaaaattaaatgtatggttcacattatatttttattggatggcactatcattaattcttgcttagatttgtgtaacagcattttaacttgtctcctgactcctgcggtctaatgtcaatagagtggccacagtaattcttccaaaacatgttatcagatcatgtctctcctctcctcaaaacactccagaggcttctcatcttattttttagtaaaccaagtcctcagaagccatgtcttagaaagctggtccctgtctaccttttgactttatttctccctatcacaagccaaacatatttccatgttgggcctttttaattgctcctcccccttcctggagtgctgttcctccaggtgtctgcagggcctgtgcagtcacctctttcaggtcttttctttgtaaaacctttaccgaaaacctacttaaactttttttttctcaa

SEQ ID NO: 251261 - DNA, 538 bp, Homo sapiens
aagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagag

SEQ ID NO: 251262 - DNA, 1154 bp, Homo sapiens
aagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggtgcagaaaataacacaagtgccaagtgcaggagtagtttcatgactgtaaatgactcgtagttgaaaatacgcttattgtttacataggtgcttctctacctacctccaagttcttgaaatatttgaaaatgtaacaaatctttacattctttctgtgaaaagaatctgtatgcaagttgtaaatatggatatatggattagagagataattcttcaatggtgaaatctttatatggtgtattgtcagtgtgaaaacattaatctgtgaagagatttttaaatgcaactaatataagttggcctgtgagatgatctgaggtttcaaatgagggagaaaaaaatgaaacttgaaattataatagatgttatatttaacaaacttttaaaaatagcctgtaaatattattttcttacaaggaattaggaccacaggatctacacagtcgaacttcaacttttatgttaagagttttgtgatgaacttcaaaaacaataattctaagtggaagacctataaaggaattgtgaataatgaagaaaaggtaagaggtaaccctagaggcaagagaactgagtaggagaacaggcctctatatattttcatcaatgtgtttacattaaatatctcattaataaaagacagtgaggccaagcatggtggttcatgcctgtaatccccaagctttgggaagccaaggcaggaggatcatttgagaccatcctgggcaacatagcaagaccccaccactacaaaaaaaaatttttaattacccaaatgtggtggtgcacacttgtagtcctagatacttggaaggctgaggcaggaagatcacttgagcccag

SEQ ID NO: 251263 - DNA, 2070 bp, Homo sapiens
aaagccttgtgcaagtgctctctgccttcacgcttgcttcctttgggagagaaccttcctcttcttgatcggggattcaggaaggagcccaggagcagaggaagtagagagagagacaacatgttacatctgcaccattcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcagcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaatatctggagaccgtggctgcagccctgctgtggcccgttccccctctgctggtgccttagggaagatgacccacaataaatgtctgcagtgaaaagctggagccccgattcctaaattttgtcactcaaattgaaacaaaccagctggccatggtggttgtcatcccagcactttaggaggccaccacaggaggatcactcccgtgatcaaaaccaacctgggcaacatgatgaaactctagctctacaaaacaaaaat

SEQ ID NO: 251264 - DNA, 1744 bp, Homo sapiens
aaagccttgtgcaagtgctctctgccttcacgcttgcttcctttgggagagaaccttcctcttcttgatcggggattcaggaaggagcccaggagcagaggaagtagagagagagacaacatgttacatctgcaccattcttggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcagcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaatatctggagaccgtggctgcagccctgctgtggcccgttccccctctgctggtgccttagggaagatgacccacaataaatgtctgcagtgaaaa

SEQ ID NO: 251265 - DNA, 2192 bp, Homo sapiens
aaagccttgtgcaagtgctctctgccttcacgcttgcttcctttgggagagaaccttcctcttcttgatcggggattcaggaaggagcccaggagcagaggaagtagagagagagacaacatgttacatctgcaccattcttgagacagggtctcaccatgttgctcaagctggtcttaaacacctgggctcaggcaatgctcccaccttggcctcccaacgtgctcagataatgggcatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcagtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcagcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaatatctggagaccgtggctgcagccctgctgtggcccgttccccctctgctggtgccttagggaagatgacccacaataaatgtctgcagtgaaaa

SEQ ID NO: 251266 - DNA, 1833 bp, Homo sapiens
  misc_feature (1750)..(1750): n is a, c, g, or t
aaagccttgtgcaagtgctctctgccttcacgcttgcttcctttgggagagaaccttcctcttcttgatcggggattcaggaaggagcccaggagcagaggaagtagagagagagacaacatgttacatctgcaccattcttggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcagcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaatatctggagaccgtggctgcagccctgctgtggcccgttccccctctgctggtgccttagggaagatgacccacaataaatgtctgcagtgaaaaaaaaanaaattatattattaaatttttttattatattcctcgagggggggcccgggtccccaattcgcccttatggggagtgggtttta

SEQ ID NO: 251267 - DNA, 1036 bp, Homo sapiens
aaagccttgtgcaagtgctctctgccttcacgcttgcttcctttgggagagaaccttcctcttcttgatcggggattcaggaaggagcccaggagcagaggaagtagagagagagacaacatgttacatctgcaccattcttggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttggctttactgtgcagtcataataagagttgggtcatgtgatttatgcacaata

SEQ ID NO: 251268 - DNA, 216 bp, Homo sapiens
ttgagagactcagggagagagaaacttcaaacaagtgaaacaagcagaaaagttaaatcagccaggctgagcatctatttctggtttttaaccactttcttttgtttctgttcaaacccaggtgggaagggcatgggaggatgggaaggtgggatccgcgtgcccgggatcttccgctggcccggggtgctcccggccggccgagtgattggcgag

SEQ ID NO: 251269 - DNA, 247 bp, Homo sapiens
atcattaagctacaggagtacattgaaacccaatccaaggtagctaaaaatgatgataaaacaatgcagtacctgacagaaaaatttagcaagtatagaaaagagcataactggcctgatagagctgaaaaacacactaatagaatttcataatgcaattaaaattattaatagcagaatagaccaagcagagaaaaggattttgagctggaaaaccaactttctgaaataagttaggcaagaatag

SEQ ID NO: 251270 - DNA, 451 bp, Homo sapiens
tcatgtcctggggtgagagggagtggatggcatgagatttcatcaggctactcagaatgaaacttgaaacttataaattatttatttctggaatttttcatttaatatttttggactagagctgactgtggtaactaaagcatggaaaaccaccagataagggaggactactatatactatcagaaaatagaaatcatttccagtattattgttatggcaaattgaatcatatgatatacactcttttatgtctggcttctgtcactcagcatcattgttttcagattcatctatgtcattgtgggtaccaatagttctttcctttttattacggttgagtagtcttctattatatggataatcaatattggcttcttcattcatctactgatgggcatttggattgtttccagtctatgtctttcacaaataaaaatgttatgaacattc

SEQ ID NO: 251271 - DNA, 326 bp, Homo sapiens
catttgttgtatttccagctttcacacagaaaaattgtgtgtgcatgtgtgcacgtgctcaaataaaagaatcccttcaggggcactatgttgttatgtatccagatattctcttttctccttccacccctcccccaccaccccctcccttcttgtaaattggcttattaaaactggttcccaagccctccttttttccctttgtgattgccttggtcttggattttcagtgtagaactaaaaattcaagtcagatttcagttactaggataattttctttgaattttaaatttttctaagtaaatgcatagatttttaatgaacc

SEQ ID NO: 251272 - DNA, 658 bp, Homo sapiens
cagactgggtgtagaagggaaggatggatgtgagaagtcgcagagtcacacttcctggcatgtacagggagtcagggtattcaatgtcatgacacgcctgcctcccagcagaaatgtgaggtacatcctggtcacctgataaatacttgctgactgtgcaagtgcacaagtctgcctgggaaacatggaaaagtttgagctcacaggtgcagatcagtaggaggaaaggcgagggactggcgaggaacgtcaggcagagagaagagcaacaccagcgatggagatgcagtcccaggacacaaaagacaagtagacctacctttataagaggaggtaaagatggagaagacggctgataaaagaccatgaataagaatatagctaatacgatgagcccggcagtgtcttacacactttgaatggactatcagtataatagtaactctaatcctttcactgaccctatgacacacggtattgtcatcctcatagatacggaaataaaggcatggagaagaatttgtccagtgtcacacagctaagcaaatggcacagtcataatttgaacccagatactctggcttcacagtccttgttcttaggcctgtagtaaggaatttgaattgtgtgctgtagataatggaaagccattgaataa

SEQ ID NO: 251273 - DNA, 1185 bp, Homo sapiens
tactccctctgtgcctgggtgtcctcaatactacatgcaaacagtaacactactcacctcataaacttgtttatttcatatttacaaagcccttaaagagtgcctggaacatgcaagtcctgtgtatgtttgcaacttgcattgattttcatgtttctgccattctttctctgaatgtttaatcctttttttgcctgtcctgtcacccttcaggtatctgtctcttgcctctggacatgcatggtcatgaccacatggccatatcagtgccattagaggactcatagtttggagtctggcctatggtgcggcagtatgtccctgtaaccagcttaactaggaataggcttctcaggttagagtaccctggtacattgagttgtcctgtctcttcttcactggtgcctagacacccttctgtagcgattacttcagcaagcacaatccaaaacctgggttcttcaagggttcccagggtcactctgattggcctggtggtctgggtggcagccctcagctccagtactctggcaggaagtcccaacaggcttccaccacatggactcagcccatggctggactgaggcctgcctactcccatctagggccacagggttcttagtttttgtttctctgtttttagataaatgaagacaatctaggttttacagcaaaaacatgattaatgtacaatccctttacaggatcattctccatatagatagacctgtcaacaaacctgtcccaacaaaactgggttgtaaagcagatcacagaaaggggactgggttttcccataggaaaaatggtagtaacctggagaaagcattccagatccccagctcatatcaacaaaccatgtatgtgatcagcagtgtgttataaaaacaaggctcagcaccatccgagttacactgtttcaaagggacccttatctgtccactgttcccaaaccttagtcactggacaactgctcttgaaaactctgcccatatcatatctgcattctacttactctaaataatttttctttaaatcaattatatcagtatgcttaaaagttaaacccatcccatggaacagcacccataaattcctgacttttctgtgctagttggttttccatgtaaaaatgatgtgtttttaaaaacacatagttattaaactttaaaatgtttgctgtgt

SEQ ID NO: 251274 - DNA, 710 bp, Homo sapiens
tgtgcagggccagcagatactgatggagcagatgttctctgaggctgtaggtgctggggcacagatcttttcctcatcctactacctagtgaaggggagaaatgacaagcgaggcaactgcaggtgaaaagtgtttggagagaggtttctatagggctccagtctatgcactgagcccaggcatagacttcagagatgcttcctgaaaagaagttggcaagatatgagggaggagggcgcagctcctgattcctctgacctttctattgtgggtttgatgccccctccccacctgagtcctcatgggcagctgtgttttgtttttttttgttttgttttgttttgtttgagacagagtctcgcactgtcgcccaagctggagtgcagtggtgcgatctcagcagctgtgtttttaagaagtgtttctactcctttccttactcaatcctgaccctgtaaaattcccacttgctggctgccccctccccaaggaaaggccgcccctctgcccctccacagtgggtggtgcccagagtcaggggacaggtctgggctttcctattcttgctgacccagctatagagaccgtgctctttcccattcagagagtcatagctacttggtttttttttgtttgttttgttttgttttgttttgttttgtttgtgtgtgtgtcttttattttacgcttggggttgtctttttaaaac

SEQ ID NO: 251275 - DNA, 439 bp, Homo sapiens
gagatcccaaacattgtgtagctcaacagggacagggacagggacagtaggatggcagaatatagctctctctctagtttgagcctagttttcattgctattcaaggcctctgagaaaaaactacagggtattgtcctaatttatatcctggatgccatagaggtcagcctgaggaggcagcagttacttgacatcctttgatgtttctgaaagcaacatgaaattgttctcttgttcacaaggaatactgcatcgtgttcagtgccagtgggggaaatctgttccccaggtcctgtatgccttgatatcctgaattccacagggtagcaccacaggtggtaagattatagtaggaattataattgttatagaagtactggattgatagagagtggaaaactgcaataacactgcaataaatagaatgtgcccctttta

SEQ ID NO: 251276 - DNA, 603 bp, Homo sapiens
gagatcccaaacattgtgtagctcaacagggacagggacagggacagtaggatggcagaatatagctctctctctagtttgagcctagttttcattgctattcaaggcctctgagaaaaaactacagggtattgtcctaatttatatcctggatgccatagaggtcagcctgaggaggcagcagttacttgacatcctttgatgtttctgaaagcaacatgaaattgttctcttgttcacaaggaatactgcatcgtgttcagtgccagtgggggaaatctgttccccaggtcctgtatgccttgatatcctgaattccacagggtagcaccacaggtggtaagattatagtaggaattataattgttatagaagtactggattgatagagagtggaaaactgcaataacactgcaataaatagaatgtgccccttttacagaggtttccatgatgttcgttattatggctcttaaggatgagcaggtacagaaatcctcaggacctacagaattgtgtatcttgtgtagctgaggtcattgtcagaaattttatggaatcctgtagcctctgggattttcacctcaaggtcattgctatgca

SEQ ID NO: 251277 - DNA, 474 bp, Homo sapiens
atctgtaaagctgttagtgttctttctgatgctggagcttagagtccacacggcagtcagttaagggaagacgggtgtaaaatgggaggcagttaagaacaagtggaagtaacaagcacagacaaacccatgtccgtttttatcatctctggccttgatagtggttgtcctgtgtaaccccatatccaacacaaacatgtggtttagagaaacctggttagagaaatgagttcatccaacaaccagagggaatttggaagtatatcttctcctagtcaagcctctgataagaacacaaccccagccaatacctggattacagcctggtgagaccttgaagcagagaaccttgataaaacatgtccaagcttttaacccatagaaactataagataaatgtgtattgttttaagcctctaaatgtgtgatatgttaggcagcaatagaaaactaatacagcaaaggtctccacca

SEQ ID NO: 251278 - DNA, 427 bp, Homo sapiens
atctgtaaagctgttagtgttctttctgatgctggagcttagagtccacacggcagtcagttaagggaagacgggtgtaaaatgggaggcagttaagaacaagtggaagtaacaagcacagacaaacccatgtccgtttttatcatctctggccttgatagtggttgtcctgtgtaaccccatatccaacacaaacatgtggtttagagaaacctggttagagaaatgagtgatccagggaagggatgggaagttgtccagctgcagcttgtgagctaacacatgtatgagctataaaacagctgctgcttcacatttatcctccaaattttgctcaagacttgtggcttaccctaaccagaacattgagggaagataattctggaaaatgtagttctgcctaaccaagctgacattacaaaccacc

SEQ ID NO: 251279 - DNA, 448 bp, Homo sapiens
gaagaagaaatgagagacaagttttgggttaaaaactgctgaaatctccttaggggtaataaaaaatgatggtctcgggggtaggcaccttagaccaggaaaattgacatctacgagtcattggagattttgctgtaaaggtttgaaaattaaggactccattgaattaaatcacacatcttttttaaagagctaccctttaggagtgcttgccttatgatttttacatagtcatctttctttaaccatgctactgtcaactagcatgaccagctctcattgctatgtgtcatgtctgaattctagccattaaagaatgcctgcatttgtctggaggcacaaaactgtccttaaaacaagtatctcctctatgaaagaagtccgtgggtagataggaatgcttttcaatctatgatgcatctctttcttgtagtaagaatgtaaaaaa

SEQ ID NO: 251280 - DNA, 993 bp, Homo sapiens
gagtggctctttaccatagaccttgctcatagttctcactacaggcttgctctgagccaacttccaagttctctccttctccttccaaacttccctgtatgtcatcttgctcctgggccacctgactgatgtttaatgcctggatatttgctttcacctctgcatgaccaagccttggccaagtcactgttgactcagttgcaacatctgtcccctgctgagggctgttgtagctttcatagctcacagtccagcttgaatctaaccttttctgtggtcattcagagtagcaagaagcattgtgttttggatttactgcagaactcacacacttaactgtacacagtcagtttttatagctatcactgcatccagattggacagtgaccttggctgagacatcctttacctctgtttcagattaatttaggcggcatataaaatctctgtgcactgccaggggaaagtaaagacttcatgaagaaatggagaagagccgaatagttgaccattgttgctgtataaatcttggatccagggctaaaaggtggcagtataaatgcagatggtgctgctgccatattttcctggcacacctttaagcagcacatttcaagccttcagggttggaatggcatttccaaatatagactcaaaaaatcctcagatgtttgattctagaatagagctgggaattctgtcctgcaaatgccttctgcagcatgggagcaaacccactcttctgtgtctgttgcttcaaactctctattttctggaaactggagaaagatgtgggtctacattttgaaatatatgccttgaacaagaattatgcacctatagaaaacttgtcatacattgaataaactctcagtttacagaaatctatggaaatatcaaaataaaacatcagaaggagcagtaactatagaggttattaactaaggggataacctgaaaaataaagttatatttgctaaaaactgtaaaaaa

SEQ ID NO: 251281 - DNA, 205 bp, Homo sapiens
aaaggctccttaatgggcagtatcattgcaaggctcagacgatttataatgttgctttgtggctgttctatcccactccttctggtaagactgctttgggaaggctgcgtttctaacatgctgccttctaacaggcacacacatgctatggagcagcacctgaaaggcactccccagacctatacacccccaccaaaaaaaaaaa

SEQ ID NO: 251282 - DNA, 83 bp, Homo sapiens
ttctaagcccatgttttatcctgaagtaccccctcgacacagaaaaacgaattcatagcacaaaatacaccagcttaagacta

SEQ ID NO: 251283 - DNA, 490 bp, Homo sapiens
ggagagaccccccctttgctccctcctcccacaaagagaaccaggggtgctcctgaggagggcaatgtcggaaaagctctgaataattgtttctcaactgagtctgaacttgtaacattgacagtatcattaacctaaactctaatattactctggagtccttgcgttgaacatttagtctctaaatattcagtattgatgactcatttccatatatacctgactcccatggatcactatgacaacatcccccatctcatctctgcttaactattgtttaatacttaagtctcatttaattgtgttctttattaagggcagatacttagaaaatcgctttttaaaaggtgagaaccatgtctttaaaattgtctctttcccagaaaacagatatgcatcaatacaaagaatggtctaatctgacatctgtttatttctgtaaggaaccttgattttgctaatacagttctatgcatcagagcaaaaaaaa

SEQ ID NO: 251284 - DNA, 260 bp, Homo sapiens
ttctgaaaaaattttataggtcgaagaaaagtttggctttcacagaagggatgtgaactttcaatgaactatgaaggataacagcatcttccagaaaccattgatatttaaatgtttagaaatcatagactgtgtgggccgggtgcggtggctcacgtctgtaattccagcactttgggaggccaaggcgggtggatcacgaggtcaggagatcgagaccattttggctaatacagtgaaaccctgtctctactaaaact

SEQ ID NO: 251285 - DNA, 786 bp, Homo sapiens
cgcgggcgaggggacggcgagcccccgctgcctaaacagaaaacggaggcgatgatctgggtaactacgggcggagtgggaggaaacctgctctgcacagttaagataacccgggtccccagagcaccatcacttctaagactgtgacctgcttacagatccactcctctgcccccacagttcacatgtccaccctgggggccatggcttattgattcttccatgtatcagcccaagaatcccctgctgccttctgaataaagggtgcaaatacacgaagcctgctcacgaatcaacataaaacttggcttccgatcccgcttccctgcctgtctgcttccacacttttcactcacggactttcctgctcccccgggcaccttgtctccttttccatctgtgctgaccctttggcttagtgactcagcttttggattggccacttggctgggcccttggtccctgcaaaactgagtttcctgtatctgtgctctgtcaactctgagtcagccaaacagctgaggtcattctctacttgtcaccaccgatgaggacggagagccaacaccaccagtcagtcacccaagctggaaatttaagcatcatcatttcttcttttccttcccagccctcccatcgctgcttgcaggccagtgagttccaccccaggaatgttccaccccagtgtatatatttccttctgaagtcccatccccatactgcttgagatcggggctcataattcccccaataaaccactgtccagcctcctgcctcacctctatc

SEQ ID NO: 251286 - DNA, 378 bp, Homo sapiens
aatgtggtcttccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggaggatcacttgagaccaggagtccgagaccagcctggggaacatactgagacctcatttctactaaaaatacaaaa

SEQ ID NO: 251287 - DNA, 390 bp, Homo sapiens
cagcaatgaagattctgtggccatttttgtcagtgctttatatgtcttaaaggaggaggctttctttagcttttctgtctttccaggacaatgccgtctacacagacttccaatggaagatgttgattcagcgacaatttactagaaagctggatgctgtgaaagcaagacacagaaagcagagaacatcaagcagtgggagtgtggaggagagggagagagcatgtgtgcttgagcagaggggtgataggaggcctgaggggagagctggtggaggctgtgaaatgagatggggaagtagggagttgggtggaataatgaggagatggagaagtaattaaattcaagctttcaagcctcctcctggtggtggcttctctttatcaaaaa

SEQ ID NO: 251288 - DNA, 1720 bp, Homo sapiens
catcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctctactaaaaaaatacaaaattaaccaggggtgatggcacattcctgtaatcccagctactcgggaagccgaggcaggagaatcgcttgaacccgggaggcagaggttgaggtgagccaagattgcaccattgcactccagcctgggcaacaagagcaaaacttcatctaaaaaacagaaaatattaagatgattaccatgtgaaaacctttttaatattcaggatttggaaagtatagttgccccaggcatgtggttgttgccttaggtcctgcgaatattgctgaaaatcggattttccacattcactttcttccctgttttagggaagaaaatgatcatagacattcgattttccaaattggcgctcttattttcaatgctaattggattacttctcttccaaccctcctgcccatccatccatcccagtccccaggcatcttaaccttaccatctgagcttcagctgaaatctgtttataggcaacattgaaagtaccagattggggccaggtgtagcggcccacacctgtaatcccagcactttgggaggcggaggctagcggatcatgaggtcaggagttcaagaccagcctggccaacatggtgaaacccccatctctactaaagatataaaaaactagccgagcgtggtgttgcatgcctgtgatcccagctactcgggaggctgaggcgggggaatcgcttgaaccggggaggcagaggttgcagtgagccagatcgtgcattgcactccagcctggccgacagggtgagactccatctcaaaacaagagaaagtaccagatcgtactttctaaatctgtctagcgtattgagaattttaatgggagctgtggatctatttctcaggccatacctgtgccaatctgtctcattgtcgcctctctcttatcattactttgtttggaaca

SEQ ID NO: 251289 - DNA, 392 bp, Homo sapiens
ccggggctttggtttagccaagaacagtcaccctcagaattagtgctggcaacagacagaaagtggcatccctttgatgcccttggaccctttgaattagtgctggcaacagacgaaagcagcgtcccttgtgcttggagcctttggccctgatcatggatgtagggctcggggtctctaacacctttacggagagggagcgatggcactctactgggtcctagcccaggaaaccagacaaggagagacacggctaggtaaacatggttaccagacaaaaagagcaagaaaggtaccaaacgaaagtatttttcatatttctttaaatcttgtcctacattagagccttcctttaatagatataaaaatgttgtaaattggtcattttaaat

SEQ ID NO: 251290 - DNA, 427 bp, Homo sapiens
ccgacaccttacgacacttgtgacgactgactcacgtgtcgagggcaggttcatggttgatattgctcgggtggcgcttccaattaggtgcatgagtaggtggcctgcagtcatgttcgcggttaggcgtccggccagggctatgggttgaatgagtcggctgatggtttggataataactagtatggggataaggggaagcttcagtaggcctgaaaggaagagccaaagtcaactcaattaaaatcaagaagagtacccttccccacccttgatgatggtgcatgcagaaggcggccaaaaaagccaacaaacaaaaaaatttaagagtccatcaaaatgtagaatggagtgaaaagataaatcactccctggaacaaaatattagcaatccctataaatgaaaaagaattagcctacagagtaa

SEQ ID NO: 251291 - DNA, 641 bp, Homo sapiens
agccagcctggtggcaggcacctataatcccagctactggggaggctgaagcaggagaatcacttgaactcaggaggcggaggttgcagtgagccgagatcgtgccactgcacttcagcctgggcaatgaagtgagactccgtctcaaaaagaaaaagaataacaaagctggaagtcacacactttctggtttaaaacttacacaaatctaaagtaatcaaaacaatgtgataatggcataagaataaacctgtagatccatggacaaggatgccaagacaattcaatggggaatgaatagtctgtttaacaaatggtacagagacaactgaatatcacatgcaaaagaataagagggactccctatatcacagtacatagaaaaattaactcaaaatggatcaaagacctaaatgtaagagtgaaaactataaaactcttagaggaaaacataggggtaaattttcatgtccttggacagtggattcttagatatcctatcaaaagcataagcaacagacaaaatagataaatttgattttatcaaaatgaaaaacgtttgtacatcaaaggccattattaaatgaaaagacaaccaatacgagggagaaaagacttgcaaatcatgtatgtgataagag

SEQ ID NO: 251292 - DNA, 491 bp, Homo sapiens
  misc_feature (140)..(140): n is a, c, g, or t
  misc_feature (145)..(145): n is a, c, g, or t
ttgaagtccattagcagtgagagggccagcagagcacaaaggcgtctctgaggggcacaggaggggcgtgggccacgcattcagacaagcctgatgtgcttgtgctgcggggttttttttccccaacccctgggggttcnccctngttcgttcactggtcctgttgtgctcatagctcaaggctgttataaagtaaaagcacctgcgtttctaagagagtgatttcatttctccatacttaatatgttcctgtttcttcttgataaatagcatcattttaacttttcattcagtaatcataaaaaagattatggagaggagacatggaataggttatttatttttttatttttattttcttgagatagagtctcactctgtcacccaggctgaggcaggagaatgccgtgaacccgggaggcggagcttgcagtgagctgagatggtgccactgcactccagcctgggcgacagagcgagactccgtgtca

SEQ ID NO: 251293 - DNA, 449 bp, Homo sapiens
ttgaagtccattagcagtgagagggccagcagagcacaaaggcgtctctgaggggcacaggaggggcgtgggccacgcattcagacaagcctgatgtgcttgtgctcgttcactggtcctgttgtgctcatagctcaaggctgttataaagtaaaagcacctgcgtttctaagagagtgatttcatttctccatacttaatatgttcctgtttcttcttgataaatagcatcattttaacttttcattcagtaatcataaaaaagattatggagaggagacatggaataggttatttatttttttatttttattttcttgagatagagtctcactctgtcacccaggctgaggcaggagaatgccgtgaacccgggaggcggagcttgcagtgagctgagatggtgccactgcactccagcctgggcgacagagcgagactccgtgtca

SEQ ID NO: 251294 - DNA, 265 bp, Homo sapiens
agtaaaaagctaaaaagaataaaatcagtccaggtatcaatgattagcaagataccttgtgatccataatttggttttctgggagaacctgcccactgagaagtggagcccttgtggaggtgtatgctgtgtggtgagatcatgagctggtgggttggtgtgtgggtgtttgcttgtgtggatgcatctgaatacacacacatgcacatgaatgaatagggggagaggtgttctggattctattccataattgcttcatttttct

SEQ ID NO: 251295 - DNA, 152 bp, Homo sapiens
cacttcactttttccaaaagcaaagtcagaagctgcactcagggtacttcacacaggcccactccccctaaagggcaggttgcctggagtcacccctgtccttggcagccatcattggaagattaaagccatacatattttggatcctcaaa

SEQ ID NO: 251296 - DNA, 404 bp, Homo sapiens
caatagctgaagctggagagcgcgtcaaagcgagggagggagcagtctaatccctgaggcttggcagtacctgtgttcacttcccctccctttacatcctgttctgtatcttcccaaaggtctgcggaggcatgcaagaggaggaaagtttggtggttgttaagataaagaggagtgactgtttttgaactctttcttttgcttaagttttggtgcctctttgttttcctcagttgtcttctaaaaacaatcagcactgtagctgctttagactaagaacatatataggtccttaaatggattcttatattaataatcatagtactagtccgaagtgctgctggcttgccaggaatgtgtgtcatgtttattttcacttattaaatatttattgaccccgctat

SEQ ID NO: 251297 - DNA, 340 bp, Homo sapiens
atgggatccttaaggatgcgggctcagctccagcgctcctttcaacttcccctcccaggtgcggatggttcagaattaagggatctcaggtagccaaggactgcaaggacagccattaggtttagctttgaagacccactggccaaaggtttctcgacaatttaatgcgcaaggggagtcaagtgagaaatgggaagaggccgcgttggaaagccactgcgcgtgcggggactctcggggcagccgcggctggcggtcgtggcccagagcccagctccgccgccgggtcccgcacaccccgcgcccctcaacctaaagttgggccgtccgtcagcggccg

SEQ ID NO: 251298 - DNA, 673 bp, Homo sapiens
caggctggagtgcagtggcacaatctcggctcactgcaatctctgcctcccaggttcaagcgattcccctgcctcagcctccccagtagctgggactacagttatgcaccaccacacccagctaattttttgtatttttagtagagacggggttttaccatgttggccaggagggtctcgatcttctgacctcctgatctgcctgccttggcctcccaaagtgctgggattacaggcgtgagccactgcgcccagccccgaatcctccattcttaagggataacaaatccagaatttcagttctccaaaagatataatgtgtttaaacacattgtgcaaacatgaggagttgctatccttaccacagaaaacctctttctctaagcttgaagtcctcaggataagaggaatagtgcccacgctgctctgggcctagaaagggattacagaggtcccaggctggctcagatcagaccaaactcacaatagaccaaggggattggaaaacagagacacagatggaaaaccagtggctgccaccacagcctggtcactaaggcagctctttatctcctatgccattgtttatagcccagaggacaccatccggacctcgtaaatgaaagtgtccattgggaaggggaaaaaaaacacacatgccccctccacacac

SEQ ID NO: 251299 - DNA, 484 bp, Homo sapiens
atttgaatggatgggatgggttattttgaagttaaaggactataaaaagacataggcacttagtggtaggagaaagtgtaggagaaaataaattgcagtagagattttccaaagttcttcctaaagggaggtctgcttcacctgtggtgtgggctttgaggatggtccaagtacggccatctctagcagcattaaatgtagttctctatgttacatttccttactccctaaattatattaaggtaatttgattgacctaaggtggtagtcagtaactgtcactcaccttagcaacattcatcaatatactttgcaccctctaaagagagcaatggtcaggagggtgggtgatgctatttaatgctaaccacactgcctgacttcactgacataattgctttacatgtcaatttccttgtcctgtgtagttaaattagaaatatcccttatctaacctaggagaaaactgcacctgcctaactga

SEQ ID NO: 251300 - DNA, 413 bp, Homo sapiens
gctaaatagtcagagtattttcagtcaaggggaattaccatatggtgttgtctgcagagggaaaggaagggctgaggagcccaactagagcagtaggcaccccagagagtgagttgcagagtgaagatatatcagttgtggctgcaacgttgctgcccaaggctgaaacagaggagatgcacccaccttccattcctcccacttctcctccaaactcctgctaacctgtcccattgctgacttcagtaacaagccagctaatagaagctctgttggggatgtcctccttgccatgcagagctgaagatatacaggaagtagaccagggaaatgggtgacaggaaagctggtgtagaagagaaccactactcacaatgcctagttgaagacatttgtctagtttcttcagtgat

SEQ ID NO: 251301 - DNA, 167 bp, Homo sapiens
cacacacacacacacacacacacaaagatttcctatacctactatagattaacaagattcacgacaattcaattagactttcaggtaaagacggtagactgaacacacacattcaattttagttcattaaaatcattaaaataatggtaaagggatttcataagaat

SEQ ID NO: 251302 - DNA, 351 bp, Homo sapiens
gaggaagaatttaaacccagggcttttccactgtaatgaaatagtcattacctttaaaaaggtaggggaggccaggtgtggtggcttacacctataatcccagcattttgggaggctgaagcaagcagatcacttgagcccacaagtttgagaccagcttgggcaacacggtgaaaccccatttctacaaaaaatagaaaaattagccagacatgttggctaacagctgtggtccagctactcggaaggctgaggtgggggatcacctgagcccggggaggttgaggctgcagtgacccatgattgcgcgcctgcactccagcctgggcaacagagtgaaaccctgtctca

SEQ ID NO: 251303 - DNA, 546 bp, Homo sapiens
gtcagtattagctcttcatatctgactcaacctcttcctcatttactgaagagaaatttaaagtgcagagatggccagtgccttgctggaggtaccatggggtgggggtcagtagtgggacagaagccaggccgctggtctctccaactagggaccatccctctgtgtgcagatgacctgggcactgaggcagggctgaattgtaggcgtggtggggtcaggttgaggggaggtgtgggactggggctcctgaacaccagggccaaaggctggaacactagaaactgggagtggaggtggggaatcccagagagaatgacatcagagtcacagcctcagcctgcactccttagcatgctgccagttagagccggtgaccttcctgagtgtctctaagtctcatctaactcataggatgatggagaatcttagaatcttaatggaagcagcagcatttctgaatgtcagagccagtatggaccttgtagatcatgttaccagcttcctgctctgtggatgcctggctaggctgtgcggccgcttctg

SEQ ID NO: 251304 - DNA, 311 bp, Homo sapiens
ctctcctgccatgcttgtgtcacttaactacctcaagcacactctagttctaaagcatttactgtttctgtattagcaaaaatatatagcttggctgttgacatttttacacaagcgttacggatataaggctggcttatagaaacttctggaaatctgacccaaaaaatggagataccactctgaaaacatggaagaagtgaactcaatagatagattgtaagtgtattatatatccctgtgtaaactgtcacgtctctctttaccaataaagcaagctttggggaaagctttgtatttaaaagttcact

SEQ ID NO: 251305 - DNA, 442 bp, Homo sapiens
tctccatcacattaatgataaaacctaaacccttagaatcttatgagctgctacctatgactgatctcccaacactaacaccctaccatccagccattccacactgatcttactggtcaaagtgccatactattgtatgcctccacttgcctctagtttacctatgcaagagctacatactcaagactcagctcaagcactccctcatctataaaagcctccctgacacttttcccatgacactgtggtccccatcttactgtaccaagagttttccctatgtcctcagagactctgtccatcgctcttcttagcacctatcacacggtgatatcattgataatttgtagccccctgcccattaaaatagggaaggaacagagatgtaacttcatctctgtgtccctgtatttgtcatatgttgatggtttttttttttaaa

SEQ ID NO: 251306 - DNA, 611 bp, Homo sapiens
atcatagacagaaatgtgttctgattgacagcaattgggtcaatgatagcattggatagccttggatagccaaggttcaggcatccactgcgggtcttagaacacatctcctgcagataagggagggctactatataacgtttctttctttttttcttcaattataaagcattctcctttttcatataacaatttgccattgatatcactttaggtataaagatattaggatatctttatagtagataaaaagctaactcattatttgtaagagttaaagtatcttccattatatcagcatataaaatgctaaagtacttttgccaccaaaaatagtgcttctgtaaatattcttttacttatacctttattaatttttacttctgctgaaacaaatagcgtgaggaaacaaatgtatgtgtataaaatgtaatatatgtatatatatttaatatgtgtatatacacatacatacaataacatacccaaatttttggttgttttttgaggtggagttttgctccgtcacccaggttggaatgcagtggtgtgatttcagctcactgcaacctccacatcttggattcaagtgattctcctgcctcagcctc

SEQ ID NO: 251307 - DNA, 166 bp, Homo sapiens
gtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgc

SEQ ID NO: 251308 - DNA, 750 bp, Homo sapiens
ccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaaattagaaaagtccaatattgagcttgattgcaaacttagagcacctttaccttaaacaatattttctcctttaattattgattttgcaacattttgggaaagttggaatttaaataatgaataattttctaaaccagaataccagttcaacagccaaataattctggcttttcatgctgtaattttaaagcattaattttccaactttttgttcatactcaagtgtatgaacttcctggctgggcacagtggctcatgcctgtaatcccagcactttggg

SEQ ID NO: 251309 - DNA, 804 bp, Homo sapiens
ccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaaattagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaatttaaataatgaataattttctaaaccagaataccagttcaacagccaaataattctggcttttcatgctgtaattttaaagcattaattttccaactttttgttcatactcaagtgtatgaacttcctggctgggcacagtggctcatgcctgtaatcccagcactttggg

SEQ ID NO: 251310 - DNA, 680 bp, Homo sapiens
  misc_feature (539)..(539): n is a, c, g, or t
  misc_feature (562)..(562): n is a, c, g, or t
  misc_feature (590)..(590): n is a, c, g, or t
  misc_feature (680)..(680): n is a, c, g, or t
gtggaatctggctcaacggtcaccctctggtagcaagcaagacctgtctctgtgacaggtctcaatcaatggagaagcttattttgccgacgttaaggacatgcctaggctcagcgtcctaaactaagccaagtgcaccaagccaggtgctcaggctcctaaactaaggtgcaattaggcaatcagcatggattgttagactgtacaaaggtggagatgccaattccccaactgttttcctaggggttgtgttcccacacacgcactttctccttagtaacagcgcacggctcctgacctggatgggtggccttagatctgtgaagcacatctaccttgccttgagaaagatgcaactcaatgttggcttccttagctccgtgccactcagcattgcagcaccgaaaggaaaactgtttcctctctactctcccactactctcaattcttccaacaacagatgtgggttgttttcccccccttcccagccaaggcctttgacaaatgagtggtctgcacttaacttctccctttctctnctcttcatgtccagatattcctnccacagctcttacacattgctcccacangggccactacaacctctgtgctgtcagagaagtcattaacatcgtcttatcttacccaagctgtcagcggccttcactcgtgccctcctn

SEQ ID NO: 251311 - DNA, 536 bp, Homo sapiens
taagcagtttaaaacctacaaatagaaaagattatttagtttgactataaaaacattggaaatttttatatggcaatacacagggcaaaaatgatgagaccaggaaaaatgtttccaacatgacaaaagttaatattacaggttgactattctaatccaaatgtttgaaatccaaaatgttccaaaatccaaaactttttgagtgccaacatgatgttccaaggaaatgctttttggagcatttcagattttggattttcagattcagaatgctcaactgttttataatgcaaacattacaaaattggaaaaaaatgcaaaattcaaaacacttttagtcccaagcatttcaaatagggagatactcaacctgtattactctgtgaagaactcttagaaatataaaaaaggaccaaattatcttttgcctgtttttctataaggaagtaatagaataattcatggataaaatatacatgtcaataagcaatagaaagatgtttggtgtaaataaaagaaacaaaactgtaataaga

SEQ ID NO: 251312 - DNA, 168 bp, Homo sapiens
tcaggctgggacttcgataccaaagcagtaggttaaactggcacctgttgtatagtgggattcagaacatgtgcctatcaaggataaaatgtaaaagggcctgttgttaaaaggtcggatactaaaatatatcaactattacttgttagtttttagtaatgtccttta

SEQ ID NO: 251313 - DNA, 1023 bp, Homo sapiens
tcctggctcccattaagatgacatctagcctataggccattgaatagaaaaaagacattccttcctcaagcacttaacttccattcagccaaagcttatgtgtattgattttgttgcaagacacggtactgccgtctgctagaaaatggtgtagcaataaaatccaaatgtaaaatttctacattgtgaatagtacttcccagatgtggtgcacagtctgcacaagcataggcactggccctacatctaaatagatttttctggaatgaaagaatgaatgtattctattgatcctggttatgctttgaagctgtaatctgtcagtaccctctgtggtcactagataggaagttggagaatattcagagtgataaagagaagggtaatgggaaagtctaaatgagtgcttctcaaattttaatgggcgtatgaatcacccaggaatcttgttaaaatgcaaattataatttggatgtggggcctgggattctgcatttctcacaagctcccagttcacttatcatctgataagaatgctgttggtccataggccacacttcgagtagaaagactctaaaacaacagtcaatcttggcttcttgctaagtaaatgttttttagtaaaaattgtcactcttagttcattgaaattgattcagtattctattaatttctgtgttgaatcttggaatggaaagaaacttccaggtgattctaatgtgcagccaaggttgagaaccactggtctagtgaaaagtcatgcatccaaagcacctaaatgtagggactacgtgtaaaaggcattcacaaatgaaaaacatcaaataattgtgattttacattttaaaaaaagaattattcttcgtctgaatatatttatcaccacatgaatgatatacattactaagtattgcaggcgtgtccaaccttttggctgcactgggccacattggaagaagaattgtcttgggccacacataaaatacactaacactaacaatagctgatgacctaaaaaaaaaa

SEQ ID NO: 251314 - DNA, 692 bp, Homo sapiens
tctttaatcttgcaatgttcatcttaaacaagtctgaccatataaaaataggaacattagggagaataactcagtatatggataaatattctgagtgaggaacacagcacctactacaagaggagctttttgctttatcttttttcttaccttatcagcaaatgttactttatctgtgatcaggtcagaagtgtaggaagattgacttagaacaaaacataacaaagacagaagtgtcagcttgactaaaggtgttcctccattgtacaggattttaggttagcttccttccacagtgaaagttatttttaatgtaagtgtatgcttaaaagagaatacggggaggtttttacctttaaaattgatttaggaaaaaaatgccaggtggtgtaatagtccctggagtagattgatttgagaatcaggagtttttaaaaggttttacagaatacagtttagagatgatcagtcagtattgcatagcaatgcaagattttagccaaatctaatacttactttaaaagttttttttatttgagatttgtggacagaactagtattcagtgattagctgcccttatactcattttctgaatgccagcatagttattccttagaacccagataaagcaccatgtttttgtttctcacttatactgtactttgcagacactaacagactaaaaacaaaa

SEQ ID NO: 251315 - DNA, 306 bp, Homo sapiens
taaaggaaaaaataaataaaaataaaaataataaattcttactggtagtggagtaatagtaaagcaataaatcagtatcagcaatgttcatttttctgttagtactgaattagaccatgtaaaactcaaacacacagaactcaacttttcagctggtcgcagtggctcacacctgtgatcccagcactttgggaggccaaggcgggaggatcacttgaggtcaggagttcgagaccagcctggccaaattggtaaaaccccatctctactaaaaatacaaaaagtaaagctgggcgtggtggtggg

SEQ ID NO: 251316 - DNA, 473 bp, Homo sapiens
ctgtctttcatcaagtcagggagataaacagaattgaaaaattgttcacaaaggttgtcagttattagggtgtggctgacgaaccacacctgaagagctacctagatgaaggcaactcacagagttacttaacaacctccaccccagttgatggtccagagtgtttccaagggaggtgaactaagccaatgttgagactgagtgggataaggccatggtgacatgcataatagatgcattcatacacattgcttcaatagagcattttcttggatggaagcatgggaaataacacatgggcgtatactcacgcttgttgttagctttcggggtcactgctgatatccttccttgttcagttaccctttgggacttgaactcctgcaagatcgttgaaaatcttcatgttctcagaactcaaagggaagaagacttgacccctaacccttcagaaagctggctgaaaaaaaaaa

SEQ ID NO: 251317 - DNA, 559 bp, Homo sapiens
attctttataagatactcaatgcttgctttgggattctaaagggaacattaatatgtctcgtaaaaataaggaatccttaaatgagtaatttgtgtacaacactgcagatagtgcctggcacatatggtatatttagtaaaagttggttccttttccactaatcatgttttgagaattcagtatcctctatagttttattttacctttatcagtggtaacctgcatgttttgaacaggagcaggtatagaagttcagtaacaggggggcaggggagggagagcatccagataaatagctaatgcatgctgggcttaatacctaggtgatgggttgacaggtgcaacaaaccaccatggcacacattttacctgtgtaacaaacctgcacatcccacaagtgtatcctggaacttaaaaaaaattaaacacaatttttaaaaaaacaagaagttcagtaatattgtcttttataggagatagaaatttttgtttccgttactagtattgcaaaagggttgtttggattcagaaaattaaactatctagttataaaatcca

SEQ ID NO: 251318 - DNA, 405 bp, Homo sapiens
accctgccctttcactgctgtccccaacacctaatatagtgcctggcccataaggggtcctcagaagtgtttgttgaataaataagtgaagaatcatagggtgaggtggtaaacatgtgtgtgtttgttgggggctaggatgcacataatatttttttcctctctccaaagagttatttgatcattttaaatgtctttagcttgtgaggactctgctgttcttcagtatccaaggggcattggtcccaggacagcactcttccccacaggataccaaaatctgtggatgctcaagtctctgatataaaatagtgtcatatttgcatataacatgcacacatccttccatatactttaaatcatctctagattacttataatacctaatacaatgtaagtgctgca

SEQ ID NO: 251319 - DNA, 398 bp, Homo sapiens
aataaaaatagtctgctccattcagttaggaaaataaattgataactttaaattgggggagtagagtgggaagagactttcttaaagctattaaaaaaaattttagctgggcacggtggctcatgcctgtaatcccagcactttgagaggctgaggcgggcggatcacttgaagtcaggagtttgagaccagcgtggccaacatggtgaaaccctgtctctactaaaaatacaaaaattagctgggtgtggtggcgggcgcctgcaatcccagctactactcaggagctgaggcaggagaactgcttgaacctgggagtcggagggttgtagtgggcggagatcatgccactgcactccagcctgggcaacacagcaagactatatctcaaaaaaaaa

SEQ ID NO: 251320 - DNA, 433 bp, Homo sapiens
tgctgttgacaggtggggaaattgaggctcagagagggcatgtcactatccaagcctgcacagcctgcttcagcactcaaagccgtattgtgcttgaataccttgagctatggggagctcactttcatgcaggactggggttcactttcagggtttcaggggacccataaagaaaacttacctggctttaccacccccaaactggcatgtgggcctaccccctttctctagagccttagggggtgggcatcactgaaccccgctcttgggctaagctgggtgggagacattcagagctcaagttctgagtgggtacatacttggggaagactttgctcctccctgggccttagtttccccatctgtaacaaggataaaatagaccctgcctcagaggaataaatgggacgtggtaacgaaagcctggtacatg

SEQ ID NO: 251321 - DNA, 369 bp, Homo sapiens
cgggatattcttatatttttaaaaaaaatctccatttttctgaaattcaggtttaaatgagctctcctgtatttcgtgtggcaaagctatgttattattatggatatgacaatggatgtgaagtccttagcttctgtaaatcctatgcacattaaattttggatttgatccgtaagtctttttttccctactgcaaacacagtgacttgtttccacagaacatttcagtcaagccagagtaacactactttaagttacagcaatgctttaccgttcctaaagcgctttcaaagccaggcaatggcggaaggtcttgcggaaccccaccataacgtgggggtcgaggaaggtatcctcagcccgggcaca

SEQ ID NO: 251322 - DNA, 543 bp, Homo sapiens
caatgaatcagtattgatctggtcacaaattattaatgatttgaattaaaaagaaaagtttagaaaatgatagctttgacaaattaaggtagcatttcatccacacgatggagtgtgttttattcagtaattgatttaaaaatggaatcaacctaagtgtctaacaggagggagttttataaattgttcacagagcatctgttccaaggagaccttgatgttcatagatttgtaaagaatgctgcttactagcacactgactcctctgcaaatgtctgagggttcctccacttggggcaagttgggggtttgatcgcagagtaaataaatggtgcattttataatgtaatatattctagcaagatgcagcccacaaactgtatagatactcttatgtaccacgtaaagttcatctactactttaaccagaacttgatactgtatgtatgtttttttttagatttggataaaatgacaactcattgttatttccagttcacaaagtaattgtgaggctgaataaattttattattttatagaca

SEQ ID NO: 251323 - DNA, 383 bp, Homo sapiens
agctgggtgccagcgtcctactccgggccctagccaccaatcctaacctgaccgcgctggatatcagcggcaacgccatgggggacgcgggcgccaagttgctggccaaggcgctgcgggtcaactcgaggctccggtctgtggtctgggaccggaaccacacatctgctttgggtctgctggacgtggcgcaggcgctggagcagaaccacagcctgaaggccatgcctctgccactgaacgacgtggcccaggcgcagcgcagccgcccggaactgacagcacgtgcagtccatcagatccaagcctgtctcttgaggaacaaccgcgcagaccctgcctcttctgaccacacgacccgccttcagccacttggtctggtc

SEQ ID NO: 251324 - DNA, 491 bp, Homo sapiens
tagaacagtgctcagtaagctttgggtattattttctcaaaggataaatggactctcaaaaatatatagatcttcctcctgggccccaccacccttaagtcccagacccttaagacagggatggaaagcattcacttcacaataggttttactcttcccaggcgacacagtaggcaagaagattggggaacacatgtctggcattcctggactcttgacactggctcatcctttcactttgggaaggaccaggcctctccatcagggttcttcaagaaaccaacaaccaggaccagaacacaggttctttagaatatcttttctttctaatcagggcaacacaacaatttttgtgaggctgtaactctaagattatcttttaaagatgttccacctagggataaggaattagcctaccacggcctaacttttatataatttaaaggcactctttgacaataagcccacaacaaaataaatgtatcatgatt

SEQ ID NO: 251325 - DNA, 271 bp, Homo sapiens
agagtctatccccaggttatggttcacagaatactgtctcaaaacaactcaatttcagaaaaaccatccatatgtcaaaaatgacaataaagtatcattcaaagaaagaaatgatacactctgtggttctatttgcagcctttgtcaaaggcctatatatttacttaattttcttgacctgtcagaaacttttcttgccttcttcctttatcaaaaatattaccttttgtgccatttgagggaaaaggactatatgctttcaaaactttac

SEQ ID NO: 251326 - DNA, 406 bp, Homo sapiens
aggcacttttatctctgctttcatgagatgttgcttgtccttttgtcctagcacttattactccactgtgagatcctgcaggacgtggtggggaggtggggaggcagttacctattttagcagctgctaatgtttcccaagtgcttggttcctgccaggcaccatgctaagggctaaacattcattaaatcattggatcttcctaattacactacgacatagaaaccttcattttctccattttacagataaggagagggaagcccagacagtgttaagtaactttctcaatgtcacacattttgtaagtgacagagtttgggttcaaatccaggtctgcctaaccccagagcctgtgatcttaaccaccaagttatcaactgccttggaggttaatcaccagtca

SEQ ID NO: 251327 - DNA, 419 bp, Homo sapiens
aaataaatgaaattttaaaattagtagaatgagacagaaatactttttaaagtttttaatttctgatgaatatcagtatataaaactaacaattatatggccgttaattgactaaaaacagtactttagatttcagctagtgaaacagccatatatgatcttctaattccatttttatgtctcaagaatgacttgtttaaataattttttttgaattgttacattttcatcttgaaagagcttcacaaaacttacatgagaatctggattgtcataagaggtctgagtttttaatggtatgttcgtatttctgttatgtacatcgatgtcaaacattcatttcctgagctgttctccagaacacaatttgacttgtaatgaacactcaataaatggttgcttggataatcaaatcaaca

SEQ ID NO: 251328 - DNA, 183 bp, Homo sapiens
aaaaagaggatttgcttttgtaacttttgatgagcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcg

SEQ ID NO: 251329 - DNA, 391 bp, Homo sapiens
gcccatgggggcttccaccaccctctgcaggaagctgggaaggggctcattcatgtctagcccacccagaggctcaggtcttaacctctggggttataggttatagcctccccctggcccccagtgaccgctttgaacacttccccagacgctgcctgtaagcactacactcggcctacaatttccgtgggaggatcctcccggggcccccagcaaggagcccttgacctaggttcccctcccccaccacggatttgaaaccgaggccctagaaggaaaggaactggaagaaggtggcacagctgaattgtcactttgctttttagaataggaagtgttgcaccaaggccaaaaacgttcccttctcagtaaagacagaggaaaggcagca

SEQ ID NO: 251330 - DNA, 3180 bp, Homo sapiens
  misc_feature (835)..(835): n is a, c, g, or t
aaaaattacgcgaagatgctaagataccagcttgtgaagaaagcctaagccagaccccgccgagggtgacagggaccagtcctgctcaagaccaggatcatccatccgaggaacagggggggcagggttcctgtagagagccaggtgttaacccctgcctctcccgtctaggacgcctccagcagaagatgctgcttgcctgcagagcccccagcctgaggacacgggtgcagaaggaggggctgagtccaagacgagctcagaaaaccagaagcctgaaactttatctggaaacactgaaggtgccttcattagcagaactgcacagccgcctctgaaaaggtacgtccactcggcatggaggagtcggcgtcccttacccagttaataagatcaatgaatgcgcaggtctttcttcttctagcttccacccacaaataaaatggttccaaaaagaagatgtcgtcatcttaaagataagaataaggaatgtaaaggactacaagtgtcagtatttaagggatagagtcgttttcagtgcttgggtgggagacaaattttacctggctgatctggagctgcggggcaacataaggaaagatgactgccaatgtgtgattagaaacgatgaacctgtaatcactctggccaaagagagaagggaggcatggtgtcacctactcagacagaggaaccccaacgtggcttttgattttgatcactgggaagactgtgaagaggacagccacttccccaaggtagtgaattctaaaaacctgccgtacacagtgacagaggtggttgaagacagtagcagcacttcagaggatgacgncagtgagagtgaaagagaaggtgaatgacgtcctcaagagcggctggaagatgttgaacaaaaatggatattgccatgtgaccgacagttaagaaaacagtcagtcataaccaaatctttttcttttcttttctttttttttttttttttttttttttgagacagagtcttgctctgtcggccaggctggagtgcagtggcatgatcttggctcactgcaacctctgcctcacaggctcaagcaattctcctgcctcagcctcccgagtagctgggattacaggcatgtgccaccatgcctgaccaatttttgtatttttagtagagacagggtttcaccatgttggacaggctggtctcgaactcctgacctcaggtaatcctcccacctcagcctcccaaagtgctgggattacaggtgtgagccaccacacccggccaaccaaatctttctttacctcaaggataaatgattactgtcaccttgtggtgctggacttgataacggtgagaaattcttcattgacttaaaaataggctgatgataagaccatcaaaggagggtggacacagagaaacagcaggtgtggtctgattccgccggcttgtctgtcctgtctggcgcctctcgccactcaccctggcagagcagacatgcatctgggtgatgaaatgcactgtctggagtcagtccattcattttttttcacctagacctttgctacattgctacaaacctgatcttacacatataaattgaggtttctaatgtacacacttagactcagcaactgttgaaccagccctttcaaccatgagatagtgggatttaacataaccatctatgtgaattgatagtgttagcattcttggatagtgatagctcctcagagtaagttgacttctgatgaagagatagtccagggatagaaattggattgctcagtaagacccaggcctttccggggtgaagctgctggttctaaacaatcccttggacctgcagagtcctgagcaaatggcacaaaggttgctttttagtggaaattcacaagggcctgtggggtgcctggaggtgatctttgaatgcctacatgtcgtgagccctgcagacattcgccaccccatctgcattgtggctgcagcactggggggggtcaccaggtttaggggaggagtgtatgtagtcatggccacacccagaggctggcttttgtgctttgggtttctttgttgactgaaaaagcgagaaaggtgagctattgggaaattaaaagtcctgtgcactctgtgtcttgtttatcagctttgcctcggaatggaaaagaatttggatagaacatgagtgttgtgtgacggccccaagatctttattatttttttgtatcagaaagcgccaatgcccaggcttatgtatgtcccagcagaagccaccgcttgaactagaggtgaactttgtcatcaagctgtcctgtgagcaggtctggatcacactctggctcagttttctcatctgtaaaatgagacatcccctcattgtgtggcctggccttgtctcagggagcgcccgccgagtgctgctgggttgggcagtttttctgcccagtggctctgatgggggctcagagccctggcctcccctgggaggacacgctgtgcagccaggacagctgccgggagtgtgcccaggtcactgctatggccttcgcagggtgactggcaggtatcaaatcagcccatgaaggaagatggtgattttccttttttgtagctaaattgggcaggctcttgggaagtagaaagttctggtgtttttgctggtgaaggttttgactgtggagctcttctaacacccatatcagtgtctgtttctctgcatgtggctgctgccctgttggtggagctctgggggcagagaccaggccgccgtccagtggcgccccgtgcgcaccagctgcctgctgtttacacccaggtgcgccgagtctctttcatacagcacagcaaatgataatagctagtgacaatgtgtttcctgtgcactcgtgaaaatgcagggaggacaactgcatgcttagatctgtttcttttttcagacattcaaatgttctaatatctgaagctaacattttgtaggatataggatgctgattatgtgaacaattagtcattggttttctgtactgctatgaatatgtctgatttcaagttttggtcaaatatctaaaatgcaaggtgaaagtgcctttgtctctatgcttctaaaatcgctcatgcttagttgtggtatggatgtcttccgcagtgtatcatcaataaaatttcactgttttcacagaaatgtt

SEQ ID NO: 251331 - DNA, 340 bp, Homo sapiens
aaagagggaaataacctttattgaactaaagaaatgcctggataaattccacacaattaaagaagagaaaattagggaatgtgatatatttgttaacaggttaggccttctttatttataatgtagtgtcaaggtagttcctggtgttacaacattgggcagggtaatgacaaaacatcccagaagacatatctactatcctgaaacccttctagatgttgagttatacatttagtttctattaatcaaaaagaccttggcgacatttccttcaataggtggcaagaaagaaaagttggagaaaacgataaactgaacattaaaaatccatagagcagtt

SEQ ID NO: 251332 - DNA, 593 bp, Homo sapiens
gagatcaggagttcgagaccagcctggccaacatggtgacacccccgtctctacaaaaaatacagaaattagccaggtgtggtggcgggcgcctgtagtcccagctactcaggacgctgagccaggagaatcgcatgaacctggaaggcggaggttgccatgagccaagatcgtaccactgcactccagcctgggcagcagagtaagactctgtctcaaaaccacggcactccagtctcggcagcagagtaagactctgtctcaaaaaaaaaaaaagaaaagaaaagaaaaagaaacatgcaaaatgctcacaggatctgagtgaaagacttggtttgtaagaagaggctccatgtagctctgcccttcgtgagggccccacaccatttcaagcaccctgatgggaacgttcttcctcttggcttccatcatgagtgaacaggaagaactgtatatccggccaggcacagtggctcacgcctgtaaccccagcgctttgggatgccatggcaggatcatttgaggccaggtatttgagaccagcatgggcaacagagcaagaccctgtctctacaaaaatcttaaaaaattag

SEQ ID NO: 251333 - DNA, 494 bp, Homo sapiens
gatgtcctcactctctccccattttcagctcatttggtttggtggagcttcaccctgacctataacctgagcatcactctactctcgacacaagtattgctttaggttaaacatgacacccaatcagagccagtgagacaaaataaatcacttgctgaaaatactgggaaaaagtctcttactcaaaattaaacgtcttgtctgggagtggtgactcattcctgcaattcctagcacttgggcaggccaagacaggaggattgtttgaggccagaagttagaaaccagcctggtcaacatagcaagaccatgtctctacaaaaatacatataaatataaaaaaatttagcaggatgtggtggcacgtgcctgtagtcctggctactcaagaggctgaagagggaggatagcttatacccaggagctcaagaccacagtaagatataatcatgccaccacactccagcctgggtgacagagtgaggccctgtctc

SEQ ID NO: 251334 - DNA, 265 bp, Homo sapiens
ttcctgagaccctttctggggtctattaggtcaaaactaattttgtgataaaactgggatgttgtttgcctctttccctgcattgatatttgcagtggtgggtaaagctactggtgccttttcccaatttaaggctacaactgtagaaactatattcattattgctatgtatcagccattaaagaaaaaaatgccagttacacttgataatgcctttgacaaggaaatataaattaattttattaaatcttgactcttagtaaat

SEQ ID NO: 251335 - DNA, 773 bp, Homo sapiens
ggcaccaatgtattttcagttcatatctgatgtagttaaatccacctcctgctttgtagtttactggcaagctgtttttgatataagacatctagaacactgtaaatatataacatttttatttgtctattatacctcaattacgaaaaagacatctagaagcaacctcatcaagagagatactgaggccgggcatggtagctcacacttgcaatcccattactttgggaggctgaggcaggtagatcacttgaggtcaagagtttgaaaccagcctggccaacatgttgaaaccctgtctctattaaaaatacaaaaaagttagctgggcttggtggtgggcacctgtaatcccagctactccggaggctgaggcaggagaatcacttgaacctgggaggcagaggttgcagtgagctgagatcacaccactgcactccaacctgggcaccagagtgagattacatctaaaaaataaaataaagtaataaaaaagagagatattgatagctgttgttggaaatttcaacttccatctcacttctggtaactttttggaagtttgttgaacaaagtggaatacacgcacatacacacacacacatactctcttgtttgtttaaggtttaatgaaatagctgtcatataatcactgtttttgaaagaggagaattagttgctatctgtacattttgggtatgtgaactatttggatagaactctgagaaatgcattcagaacaacaaacaaaatcataggagaaatagctaagt

SEQ ID NO: 251336 - DNA, 594 bp, Homo sapiens
tcttctccctgacatacaaagtcagcagcatttgtaaattttgcctcaagcctggagtgacttatactattccctgaacttccttacatactaattttcagtgggttatacaactgagtccttcaaatgataaagagcaccatcggccaggcgtggtggctcaagcctgtaatcccagctactccggaggctgaggcaggagaatcacttgaacctgggaggcagaggttgcagtgagctgagatcacaccactgcactccaacctgggcaccagagtgagattacatctaaaaaataaaataaagtaataaaaaagagagatattgatagctgttgttggaaatttcaacttccatctcacttctggtaactttttggaagtttgttgaacaaagtggaatacacgcacatacacacacacacatactctcttgtttgtttaaggtttaatgaaatagctgtcatataatcactgtttttgaaagaggagaattagttgctatctgtacattttgggtatgtgaactatttggatagaactctgagaaatgcattcagaacaacaaacaaaatcataggagaaatagctaagt

SEQ ID NO: 251337 - DNA, 453 bp, Homo sapiens
gatggaggtgggcagactgcttgagcccaggagttgtagaccagcctgggcaacatggcaaaaccctgtctacacaaaatacaaaaattgaccaggcatagtggcacgtgcctatagtcccagctacttggtaggttgaggtgggagaatcacctgagcccaggaggtcgaggctacagtgagctgtgactgagccactgctctccagcctggcaacagaatgagaccttgtctcaaaaaacaaaaacaaaaaacaccagaaaagacaccattttatatagggcccttgagcatctgtggattttgatagtcaaagggatcctggaaccaactccctgcagatactgaggtacaactgtactggaaattaacttaatgaagatattaggacacagaaaatgaataaaccggactgggcgcggtggctcatgcctgtaatcctagcactttggg

SEQ ID NO: 251338 - DNA, 468 bp, Homo sapiens
gagccttaaaaagaaggaaatgtgccatctgcaacaacacagataaacctgggggacattataacagtgaaataagccaggcacagaaagacaaatattgcccggtctaacttacatgtggaatctgaaaatgtccaagtcacagaaacagagagtaggatgcaggttaccagaggctgtgggtgggtaggaattggggagacattggtcaaagggcacaaagtttcagctatgcaggatgaattaagttcagaagatctattgtacagcatgatgactagtcaataataatgtacccttgaaaatctctaagagtagattttaaatgtactaatcacaaaaaatgggatgtgaatgatgggacacattaattagcttaatcactctgtagtgtaaacatatatcaaagcatcagattgtacaatttttcatttgttaattaaaaatatataaatatactatgggatt

SEQ ID NO: 251339 - DNA, 845 bp, Homo sapiens
gcgagaacgcaggaccagcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgaggcaggctcgagtgcacggagcgtcccttccatcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcgaggaaggaaaggacccggtttcaggagctgctgtgcagtccggcctacagagccagcccctgtgtggccatcgggcagacgctggccggcagatgcagctggaaatggcggcaagctctgagcagggcagcggggcatgccacaactcctcaggacacatgtgggccaagtagagagcgccggcccctcaaggaccatggcctgagcctggtggacgcccttccctctggtcggttgtggggctcaataaatggctctgtgaacttcccctgcaaaaaaaa

SEQ ID NO: 251340 - DNA, 674 bp, Homo sapiens
gcgagaacgcaggaccagcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagaaagcaggggctgtgtgcagttgttcaaacctggggtccatcctttcatggcccagctgcccaggctcgagggtggcaggtcacgcgctgcaggcccaggcagctccaggctggcatcccgcggcggaggcaccagagcactgggtccagaatagga

SEQ ID NO: 251341 - DNA, 568 bp, Homo sapiens
gcgagaacgcaggaccagcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacaactcctcaggacacatgtgggccaagtagagagcgccggcccctcaaggaccatggcctgagcctggtggacgcccttccctctggtcggttgtggggctcaataaatggctctgtgaacttcccctgcaaaaaaaa

SEQ ID NO: 251342 - DNA, 916 bp, Homo sapiens
gcgagaacgcaggaccagcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgaggcaggctcgagtgcacggagcgtcccttccatcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccgggccctcagagctcagccgggatgagcgcagcccagagacagcagcttctcgaggaaggaaaggacccggtttcaggagctgctgtgcagtccggcctacagagccagcccctgtgtggccatcgggcagacgctggccggcagatgcagctggaaatggcggcaagctctgagcagggcagcggggcatgccacaactcctcaggacacatgtgggccaagtagagagcgccggcccctcaaggaccatggcctgagcctggtggacgcccttccctctggtcggttgtggggctcaataaatggctctgtgaacttcccctgcaaaaaaaa

SEQ ID NO: 251343 - DNA, 439 bp, Homo sapiens
actctttcaacgaactgccaattggaaaacctcctataacttggaactgtccccagcccgctttgggttgtcctgcctttccagatcaaaccaatgtacatcgtacatgtattgattgatgtcttctgtctccctaaaatgtataaaaccaagctgtagcctgaccacctcgggcacatgtcatcaggacttcctgaggctgtcacaggcatatccttaaccttggcaaaataaacttctaaactgattgagacctgtctcaggtactttcttggtttacaggaatttaagcaaattacaggactgcactacccatgagtttgtgaaaggaaaaataaatctcaggaccccaaaatcactaagccaaaaagaaaagtcaagctgggaattgcatcgagcaaacctgcctctcattttattcctgaataagatagctaca

SEQ ID NO: 251344 - DNA, 418 bp, Homo sapiens
agcccctgcccccgtgtgtggcccgccagccctggccaggtaaccaggtcctcaggtaccttctgtcattgcgttgcctctcagcggtgcaccgtgcacctgatggggtggctcatgtgaggaatgagagatctcacaataggcaggatttacgggagtgtgtcggggcaggaggtcatgtgtgccagcacaaactgctggaaaccgtcccttatcggaggcaaacggccaagcacgggggtctgaggatcatgtgctacctgccgattcacggtgcacctgccagcgttccggaatcaacaacgccagctcctctcagtgacattgtacatgtcattgtgttattttcgcttgaagtttatatccattttagacctcaggcttcttggggccaagaataaactttcttctgatcctt

SEQ ID NO: 251345 - DNA, 98 bp, Homo sapiens
ctctctctctctgtgctgagccacttggagctgcaggtgggctgacacaacatccctatggctaccatcacttagactgcactgggtcagacctaaag

SEQ ID NO: 251346 - DNA, 830 bp, Homo sapiens
accccagtccgtgagcggcttggatcctcgcccgttccctcctggtcgtttccgcagtaacctcttatcagagcgggcagctgtgagtggcgctcacatccgccgctgccctgtcgaatgggggaaagagttcttgtgttctgaggagggtttggctatggtccttgaccctattcttgtctcagacttgcctcccaggaatataggaggattgtatgccctggcctccctgtgatggggttgaactacatgacatgttctccgaattaagtgtgagcatagcatttaattgttgatgcaagaccttccagaactctttttctctttgccatggcaatcatcagtgttccagagagcatatgcacgatcagccttggtattggagggaagatgatgcggaacagagtcccagtcacatcatgaaggacatgtaaagtgagaagtaaaccttggttgttttaagccattgagatttgagttttgttaccagagcagatctttgtcatcctggataatgtgcctgagaagaagaggtttaaggaagaaaacttgtgaacaccaatgtgcttgttagactcctttgcttgctccctgttatacacttgccactacacttctgacttagatgtggtactttgttagtatctgtgaggactgaaaatgagatcgaagagaaaaatccaatcaagcattaagtaatcatatttaaatggaaaatgggaagatactattaacgaattcaatggtggcttggtcctgatgacactcttcttgaattatacgatgttcttatctcttgcggggctgttgaaataatcaaatctttgtac

SEQ ID NO: 251347 - DNA, 713 bp, Homo sapiens
catttttaagagttcgctttctcagagggcagcttctcaaactcattcgctggtttcttttcctctttccgcctgtttaaggaatataggaggattgtatgccctggcctccctgtgatggggttgaactacatgacatgttctccgaattaagtgtgagcatagcatttaattgttgatgcaagaccttccagaactctttttctctttgccatggcaatcatcagtgttccagagagcatatgcacgatcagccttggtattggagggaagatgatgcggaacagagtcccagtcacatcatgaaggacatgtaaagtgagaagtaaaccttggttgttttaagccattgagatttgagttttgttaccagagcagatctttgtcatcctggataatgtgcctgagaagaagaggtttaaggaagaaaacttgtgaacaccaatgtgcttgttagactcctttgcttgctccctgttatacacttgccactacacttctgacttagatgtggtactttgttagtatctgtgaggactgaaaatgagatcgaagagaaaaatccaatcaagcattaagtaatcatatttaaatggaaaatgggaagatactattaacgaattcaatggtggcttggtcctgatgacactcttcttgaattatacgatgttcttatctcttgcggggctgttgaaataatcaaatctttgtac

SEQ ID NO: 251348 - DNA, 399 bp, Homo sapiens
gtagtcatttctgaccaacgttgtagagcactttttttttaatgccctttgcatgcacctgatacataaactgaaaacctggtttttctctagggtgtcagtataccagcactaacttcattaacacactctccgctgcgcctgaatttggagcctcacatttttggacgtatgatgcctgaacctagtaaataaagcaattttgacttcagaaagttttataataatttatattttttttctgttatcaaccagcgtaaataaattacatttgtaaattatttttaacagttgttaccaggaaataaaacttcttaaatatttaaaatgtttaaaaactttttcttctgaaactgttaccttgagaataatttattaaacttttcttcatagaaaaaa

SEQ ID NO: 251349 - DNA, 378 bp, Homo sapiens
ttaaaaataattagggaataatacagtttgcagattttctcccgatgtcatcatggcactcagtaacaaggaatattgtagatgaattttgaaaatgtttttcctggaagagaatcccaaacgtgtggccgaaagggacccaggacctgccagccatgctcctcctgtctttttcccttccagtttgaaccccacagcgctgggcggttgacgaggtgtggccagcttgcatctgctgaaagaaccggggtggcccccctgcatcttgatcagacactgccatgaggtccctcccctctttgatggcaaagggaaacagtgggctctacacatggagctttgaagtcaagagtcattttcatccttagctcagcatga

SEQ ID NO: 251350 - DNA, 523 bp, Homo sapiens
ggggaaaaattgaaggtctttcctctaaggtctggaacaagacaaaaatgcctactttcaccgcttttatttcatccaccctcctctccctaggaggcctgcccccgctaaccggctttttgcccaaatgggccattatcgaagaattcacaaaaaacaatagcctcatcatccccaccatcatagccaccatcaccctccttaacctctacttctatctacgcctaatctactccacctcattcacacaaaaagaaaaccaactgagacgctgtcactagggtttttcaaataggtagagaatcttaaatatccagtaatgatgacaacctcacttactgggagcttactcgtggggctaaggaggatgcatgatgatcccatttttattgtcacagctaccgaaggaagataccctcttcaacccaattttacaaatggagaaatagaagctcagggaagaatctgaagtagtctcaaaggaagtgacaggaaggatgtggagaaagctgagtgtcaaagt

SEQ ID NO: 251351 - DNA, 320 bp, Homo sapiens
ggccctctattctcttccagtggcctatatgtctatctttatcccagtagcacacagttttgattactctatctttataatacattttgaaattagaaaatgtgatgcccctagctttgtttttcttgctcattgttttgactattctgggtcctttgtggttttatatgaattttaaaattgttttttctatttctgtcaagagtgccattaggattttgatagggattgtatataatctataaattgctttgaatagtatggatattttaatattattatgtcttccaattcatgaacataggatatctttctactga

SEQ ID NO: 251352 - DNA, 745 bp, Homo sapiens
agggttcattttgatagcatggaagaaatcaatctcacctggcttatttcttgagaaagagagatcagtagaggcttcctagaagagatggagcctgggttgaatcaaaatatcagtaaaaaagagtttgggtggaattccaggcagcaaaaattgttatgcatagaaatttaaaccagtttagaattgtgatgcaagcagaatgtacacaagaggcaagggtgagaggtgagcttagaaaaattggtcagattatggaaagcattggcctttaccttaaggagtttggcttatatcctattgaggttgaggagtaagtaaagggttataagcagggaacgagatacgcaaattgcaatgtaaatagatgtctccacggtacatggaggataagttggaagggtgaatagagaggagtaggggtgaagaaagtttcatacccagaaaaccatttggattctggtccagtatcctgtctggagggaaagattagttaggaactagagttgtaacagattcaagacatatttggcagataaaatcagcaggatttggtgattgattggatatcaaatgtaagagaaaggaaggatcccaggactaccaggtggatgttagcagtgaattgaaaaccacaggaggaggagctgactcggcaggtaatgattttgagatgcctgtgaattgtttaaatacagatatcctatagattcttacacaatgtgcctctaacccttaacatgta

SEQ ID NO: 251353 - DNA, 478 bp, Homo sapiens
ttgtatccaaatatacatatgtatgttaaaagaagtttctcataaaagtgagattttacaaacttttttaaagtcattaatatatcttagataactttaaaaaaaatgttagtactggccaagcacagtggctcatgcctgtaatcccagcacatttggaggctgaggcgggaggatcacttgaggccaggagtttgagatcaacctatgtaacgtagtgagaccccatctttccaaaaaaacagtcggtacttatggttccatatcatacatttgtagtgtaaaatgacataaaattcagttgatcacctggtaaaatactgttattcaattgtgttcttttaagtggaaatattagtcaaaaatatgatttaacttgcaatacctataaccctagactcatttttgtctcccatgccccagtacacattttatgtgtggtgtagattttgcatgaacactaaagcacatatacaac

SEQ ID NO: 251354 - DNA, 746 bp, Homo sapiens
gtatttttagtagagatggggtttctccatgttggtgaggctggtcttgaactcctgacctcaggtgatccgccctccttggcctcccaaagtgctgggattacaggcgtgagccaccacgcccggctaattttgtatttttagtagagatggggtttcatcgtgttggtcaggctggtcttgaactcctgacctcagatgatctacccacctcagcctcccgaagtgctgggattacaggcatgagccaccacacccggccacacgtgttattttcttagagaggccttccctgatcacttattctaaagtgggaactagtgatcaagtgatcaagtttaatgttttacagtgatccaggtgacatttgtgaggtctcaactgaagaagtagcaatgggggtggaaaagaaagggacagatacaagaaataatttaaaaaaaaagaattgtgagtgtggtggctcacatctgtcatcccaacactttgggaggctgaggcgggaggattgcttgaggccaggagttcaggatcagcctgggcagcatggtgaaaccccatttcttaaaaataaataaatacataaattggccacgcatggtggctcatgcctgtggtcccagctacttgggaggctgaggcaggagtatcgtttgagcccaggaatttgaagcttcagtgagctatgattgagccactccattccggcccgggtaacagagtgagaccttgtctcaaaaaaaaaa

SEQ ID NO: 251355 - DNA, 669 bp, Homo sapiens
ctgtccaaagtcagttcttgactgactgacttatttttgagacaggatctcgctctgtcacccatgctggagtgcaatggcatgatcatgggtcactatagcctcaaccttccaggctcagatgatctacccacctcagcctcccgaagtgctgggattacaggcatgagccaccacacccggccacacgtgttattttcttagagaggccttccctgatcacttattctaaagtgggaactagtgatcaagtgatcaagtttaatgttttacagtgatccaggtgacatttgtgaggtctcaactgaagaagtagcaatgggggtggaaaagaaagggacagatacaagaaataatttaaaaaaaaagaattgtgagtgtggtggctcacatctgtcatcccaacactttgggaggctgaggcgggaggattgcttgaggccaggagttcaggatcagcctgggcagcatggtgaaaccccatttcttaaaaataaataaatacataaattggccacgcatggtggctcatgcctgtggtcccagctacttgggaggctgaggcaggagtatcgtttgagcccaggaatttgaagcttcagtgagctatgattgagccactccattccggcccgggtaacagagtgagaccttgtctcaaaaaaaaaa

SEQ ID NO: 251356 - DNA, 1031 bp, Homo sapiens
ccctccctcatcacccccaccgcctccagctccacatccagattccaaaagccatgagcacccccatctgaccatgaacgcccatctgaccatgaacgcccatctgcggatcgccagcagcaaggttgacacggaactccttccgccttgggaggaggcttccctggggtagtaccctctgggggccgtctgggcaactcttgcagggcttcgtggatgtttggggaaagcactggacagcgcctcgcccaggtgccttcctgggaatcaccaactggggtttactgccccaattttggagcttgcacagagcatcctcccttggtaggagagacgtcgccattgggccacaggacttgtagaggacgccacgagaaaggggttgattggggaatggttgtcctggttacgccaccctgcagtgtcccttgccctcctccaaggcttccagccccatcgcaacctgtcagttttccaggcgctcaggaaagcatgtcaagcactcaagcactctgtgacaattccacccccggcccagtctttccctcttcacccactctctgtgatgtcgaatcccatttcacagatggagaaactgaggaatcgagcaagtgaatgccgcttaaacatcttttccaagccagccagggaccagcccctccagttctcagaatctctctccctctgtaacatattttgacttgaagaacatgtgcgattcgtgactacaaaaccgcaaccccacataaagagttaatatttttaacgaaccccaagcccctcaccctcagccttcgcgggacgcctgcgtctcgcaacttcagtttgtatctccaaactgctgagcattcaaagggttaaatgggaccgggagggggccagccgcggagccctgaaagggttaaaaatccaaacgcgtcgactccccccgactatttggttccaaatggacagccacgcgaccgggagagccagggagcccccctcacaatgactttattaaaatttgagaacttttacttctgacccca

SEQ ID NO: 251357 - DNA, 1835 bp, Homo sapiens
ggcgtggcacgccgcccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggatgcgtccagtc

SEQ ID NO: 251358 - DNA, 1721 bp, Homo sapiens
ggcgtggcacgccgcccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccaggtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggatgcgtccagtc

SEQ ID NO: 251359 - DNA, 1753 bp, Homo sapiens
ggcgtggcacgccgcccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgtcaacaccagtctttcagcacctgaaatccaagggaaagggagttcctgatctaaacacaagacttttagtcaagaaactgtgggatacatttcatgttcctgttttcactcttgtagatgctgatccacatgattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggatgcgtccagtc

SEQ ID NO: 251360 - DNA, 1666 bp, Homo sapiens
ggcgtggcacgccgcccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatagctgttgctgtgccatcgaatattcaaggaattcggagtatcctttaagtgggaaaactatttaaacttttggaatgttcattcattcattaattcctttgggaaagggagttcctgatctaaacacaagacttttagtcaagaaactgtgggatacatttcatgttcctgttttcactcttgtagatgctgatccacatggcatagaaataatgtgcatctataagtatggatctatgattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggatgcgtccagtc

SEQ ID NO: 251361 - DNA, 397 bp, Homo sapiens
ataaattgtgcatgaaatagtccactctggtaatctacagagttatggtaaggaaaatggctttgtgaggaaatacagcaaaactgaaattaactgaaatccagttaaacagaatctctaaagaagctgaattatatgtttgtttatttgctattgtttgtttctatttatattcatctttgggggaaaatagtagtgttgtctggggcttaatcaaaaaattcattttcaggacatttaatgtaattagagatttattcccagctctggtaccttctatgtcctcagtccttacctatgagatttcccatttataatgatgacccagaggccaagcagcacccagaattcacaaataaaaataaaaataagcttatgaatttccatttcctaaaat

SEQ ID NO: 251362 - DNA, 303 bp, Homo sapiens
cccaggctggagtgcagtggcatgatctcagctcactgcaacctctacctcctgggttcaagcgattctccaggcttagtctcccgagtagctgggattacagaatcgcggcatgtcttccaaggaaaaaactgtaactaaatctatggcaagtttttggattagaaaaatctaggcttcatgaagataagagcagagctgtggaaaagtaagacaaagaaatcatccaacaatacaagcaacatacaagaggtttgcagtctatcaatgaaaactgattaaatttacataagtgctaatctc

SEQ ID NO: 251363 - DNA, 440 bp, Homo sapiens
ctgaaaacaaaaagaagaggctatttaataaaatctgtagtaccacctgtaatttgagaaaccactagcttggatgttatatgggcccataaggtgaaatgaaaactgcttaatagagcataaacaatgacataccaggtaatggaaggtttccagcccatgccactgaattggtactagcccttaacatctctgttaattatcaaggagacaagataactgcacatttatttaatgcctgggtggcacagcatctgagagcgacgcaaaagctgtagagagagaaataattcaaagagatctgagtagattaagagattagagagaaagcagtcagtaatttacagaaaggcacctgaatttgctcaatttcctaatcatgcagtttgttttgcatcataacagttgcattcagggagctgttgtacatatttctgaaa

SEQ ID NO: 251364 - DNA, 697 bp, Homo sapiens
agttcaggtgagttttcacaatataaagtaagtggaaaagaatccccagataattgtgacatgctaaagctagatactgagaaccaaaaagatgtgacctcagtatgggacttttaattcaaggatattagctaccaaatgacagtttttcagaccgtaagcattgctttttaaaaatcaagataaaatacatttataacatatcttacttttagtatagcttctgaatttagttctcaatagataagacaaaagagatgaacatctgcttcctttcccctcaagcgatgtattcttactaataggtaatatgtttttttttggtacttaaaggcagtgtttttcaatcttttccatgttagtagctcagatctttaaggacagaggatacaaattagggggcagcttgcgttcttaatcctaagtggctctctgatgtcttagattcttcctttcctttttgtgagtaaaacttctgctctagtaggatgagcctgttcaccttgtgactgcctaactgatcattgctttatgttccagtttttagaagcaggcagattatattacctgacttaaaatgcttttgagactaaaggtagtatcttaaattttaacttacgagtttcctttaagtacaactttgatgaaattatggggattgagtttccatggctttcaccatagtgaaaatggaaag

SEQ ID NO: 251365 - DNA, 796 bp, Homo sapiens
gagaaatagaactgacatcagagaatacattcaaatcaactgaatttaaagggaaaaaatgcaatttctcctaaattccattcaaagccaaaacattcagattttctgacaccaacttagcaaatgtttaaaatacaagggtatacttcttattgataagttaccatgggttccactagtagagctggagagataagcaaacatgctgggtgaaccctagagtaagcctgagactatggctgcacagacagaagagaacacagaacaaaacagaaactcaaaggtttcctcatccagggcagtcttcatgaagacagttcaaattccaaactgttagatcattaaaggaataggcatgtgactagccctatgaattattcaaattcttataaataagaagacaataatggcttagcagttgaggtaattacatagtaaaattctatttttcttcacattacggagactgagtctaaataaatatgagggtgggggacccattactttaaattttcagtgaaaaagttacaagtcatatataatggcttaatactggctagtcactccattctgatgagctcctgcccatcagaatatttgctatttaaagaatctttgttggcatgttaagtgaaaaatgtgttcctcctaagtttcttctgaagtctacacttagagtcttgtatatagtggtccttgtaaaagaagcactagtggttgtgatgatgaacaagtttgagaacgtttagctataaaagaccctctctgtaagagacatcaacaaggtctcttatga

SEQ ID NO: 251366 - DNA, 284 bp, Homo sapiens
gtttgaccgtggctcagtgatcctctggaggcaggagaatcgcttgaaactgggaggcggaggatgcagtgagccgagatcacgccattgcactctagcctgggcgacgagtgaaactccgtctcaaaaaaaaaaaaaaaaaaatgaagtgtagaggtagaggtcagtggtttttagtatttagtattcattgagctgtgcagccatcaccacaatcaattgtaaaacatttcatcacaacaattatcaatataaaacccccggccataacccaataccaaacg

SEQ ID NO: 251367 - DNA, 671 bp, Homo sapiens
cccactcaccatgacttctaccgatcacacttgtctgtgctgccttaaaaatgttcttacaaatttattgctactgacattttggggggcatacctcagaagagatagtccatgcttttaggaagtataataaaaatcctttagggacagctagtgatcatttctattaagtatctaggatccagaacatgtccatatatccatggttctttttaccagcttaataatgaaatacaaacatgttctgataaccaatataactcctatttttgcaattactttaaaagaaaaggcactctgtacccttctgtgataccttatttccatctgagtccttccctccatggagacaatatcacaggctaaaagcaatatttatatgttgagatcttttatgaaatgtgtgaaatagtggaagaagatataggataaactatagaatatacagaaatttgggtaaccttttcataatcatgtgactgctttctgacaaatattaccagaatgtaagctgtaggacaaggactatgtgtgtcttattcttgaatatgtctcaagtgttagaaatgtgcatagaacaaacagaatatttttttactgaatgaattaaaatcagaatctcctagtagataaaggtatgtcaattattaccaaaaccagtttgctcactt

SEQ ID NO: 251368 - DNA, 648 bp, Homo sapiens
cattttatgtcagttagacttctttggttgccagtaagagaagctgactctaatctaaaccaaaaggaattcattggacggatgtgggttggctcacaaaatcaaagggacaactgcggagccgatcttggaatgctctgacaccagaacagctctgtgaattcagataggggtagtgaattgaccatttcatcaaatgctgcagcaagctaggtggtttccccaaaggaaattgaggagtgttacaagaagaccattaggggaacggttatctggtggctgataataacaaatttccatggcagtctctttgctctctgttggaagaggtactccaccatgggccttgagcatctctacacatccttgctaagcgtgtcaaatttcaagtcctaactgtcctctgtctctggaggaggagacaggtttggttactgtttgttgtaaaaattactgagcccttcaccatgggtgcctcagctgtatgcaaagccccttgtattgctgggggacagagcaactggtactgccatgctggtgctctggctgtttgctgttggcaataaactattctgttttggttcattgaatctctgtctactttgggcacctatgtgatcatggtaaatcaacctgcttgcttgccta

SEQ ID NO: 251369 - DNA, 374 bp, Homo sapiens
gatactctgtagccattatatgattatgtgactttttacttaccaaaagggaaagtgttcacaatctgtcaagttaaaagtaaagactaaacagcaatcatagcacaaggcccctccttttgtgtctctctctctctctctctcacacacacacacacacacacacacacggagcatggagggaagggaaggtggttaatcaagaacaatgtatgacagttaataccagttatctctctgggtatgatggatgctttttcttttccttttttctttttttgagacgaagtctcactcttgtcccgcaggctagagtgcagtggagtgatctcggctcactgcaactgcagcctcccaggttcaagtgattctcc

SEQ ID NO: 251370 - DNA, 938 bp, Homo sapiens
tgccgaaaattaagcctggagagatttgtccattgctctagggtgtaaggacttgtattgctcatccacagcagtgctcctagggaaaactgtaggagttgtttgcatgaattgacaaaagtatatgactcttaatgttcaaatctaattcgtttctaaaaaataaaatcacaaggcagctgagtgtatggtttattatgtgtttagattatgtgctcctcagtaaaaaatacttttttttggattaggaataaaaacaaactttagatttaactctgtattcttttagttcatctctaaaagatagagactatatgtgcatgtatgccatcattacattcttatcttatttcaaagagaatgcaaaaaaagtattcaaataattataaatacaatttatttttttaaaaccccctttctgggctagtagtagttactgttatttatttttgtccattttagcttcaactacttgccagtcctagaaattaatgggtttaatttcccctcgaatttaggacttttctagtaacaacttacactcaaatgtagtctttcttataaagattctccccctctctattttatttgctttccattcataacacagacattaccatgaaagttttcattggttatcgatggagttattgaatgtggtaatcaaacaacagattaaaactgagtctccatgaggtgaccagtgcatgaaggtttctttttttctgaagaaatctcacaggaagaattaaatgctacctcttacaaatcagtcctactgatctagtgtgtgtctggacacaccagagtctttgagacacatcctcaccaatagtactttaccttctgggtatgaattgtgggtcatggtgcctgtgcatagcctgtggtctgtagagaagccatattgattaatacttttcatgcaaattattcag

SEQ ID NO: 251371 - DNA, 3407 bp, Homo sapiens
  misc_feature (530)..(530): n is a, c, g, or t
  misc_feature (550)..(550): n is a, c, g, or t
  misc_feature (568)..(568): n is a, c, g, or t
  misc_feature (762)..(762): n is a, c, g, or t
  misc_feature (768)..(768): n is a, c, g, or t
  misc_feature (1308)..(1308): n is a, c, g, or t
  misc_feature (1517)..(1517): n is a, c, g, or t
  misc_feature (1852)..(1852): n is a, c, g, or t
  misc_feature (2343)..(2344): n is a, c, g, or t
  misc_feature (2359)..(2359): n is a, c, g, or t
  misc_feature (2403)..(2403): n is a, c, g, or t
  misc_feature (2451)..(2451): n is a, c, g, or t
  misc_feature (2486)..(2486): n is a, c, g, or t
  misc_feature (2488)..(2488): n is a, c, g, or t
  misc_feature (2500)..(2500): n is a, c, g, or t
  misc_feature (2524)..(2524): n is a, c, g, or t
  misc_feature (2540)..(2540): n is a, c, g, or t
  misc_feature (2564)..(2564): n is a, c, g, or t
  misc_feature (2569)..(2569): n is a, c, g, or t
  misc_feature (2580)..(2580): n is a, c, g, or t
  misc_feature (2599)..(2599): n is a, c, g, or t
  misc_feature (2636)..(2636): n is a, c, g, or t
  misc_feature (3071)..(3071): n is a, c, g, or t
  misc_feature (3171)..(3171): n is a, c, g, or t
  misc_feature (3306)..(3306): n is a, c, g, or t
gaccaagtccctctccttccaccaaggagcgcccagaggccggcgggagctccaggttcacctcctcctcctccaggaaatcccacttccagctagatgtctgcatgaactactgaaagctgctgagtgtcttgcagcaggtgagctgtggccagagctcaaggatgaaggggactccctcactctgtgactgtgaagaggaagcctgaggtgtagcaggcccaggccccagaagtatggaaaaaatgaggtttgacagaattcatgttgctgccatagaggggctcttttcaaactgatgtcttaaatcttgttcaggccattttcaatccagaggaagaccttctaaaagaggtgatggatgggagagtgctgacatactatgtgaagctactatttggagttggacacgagtgcatgtgaccttgtgccacagcgggaatcttgactaccacacaaatgaatccattcaaatgttggcaagtggagcagagtcccaggacaggtgctggagcagcccccctggaagngatgcagcatccaggaaganggaggaaggggcggaganggacctctgctttccaggctgccttttatactgcctctggtcacctgacgtggaacgtaccctaacctaatcagttacatgaggcgcttggaaaccaccgtcaattggaccgcactgggaaacacagatgaacaaagtcaacaccgctttgtccttcagtgcctggctcctttttcagctcgtcttgcgactcnaggtantggagtccagggaggggtacgtcgcctttaccctgtgcttgccacgatcttgtctccttaatcctcactgcagttctctgccatagagtcttatactgctttacatgtgggaaactgaggctcagagagtttcacagcagggcagggagcccagatgtgaatctgtagataccaaactttctaatttttcagtagtttccaagcatcttttatttttcttgtttcttcgttggtgtctttttttttttttttttttttttgagacaaaatctctgtgcccaggctgaggtgcagtggtgtgatctcagctcactgcaacctcgacgtctcacattcaacaattctcatgcctcaacctcccgagtggctgggactacaggtgcccaccacacccaacttatttttgtatttttagtagaaacacggttttgccatgttggccaggctggtcttgaactcctgacctcaggtgatccacccgccttggcctcccaatatgctggaattattgatatgagccattgggcccggtcatgtcantggtgccttaaccaagcctcttttaatttttcaaacggaagagcccctgtccctcagttacggctgctgagccctttcaaggtgagtcagtgaggagggagaaaagcggaagtggtgtgggaagaggcggggtctgggccagctgctggtcctgctctcctccctcctttggcctctaggctcccaggagtggtttcgaacctgcgccntgtgctctggaggctgtggcaaggcaggcgcggcttggaacccgcaccatgtgctctgggggctgtggcaaggcaggggcagcttggaacctgcgccatgtgctctgggggctgtgccagggcagggggagtcctcgtgtcccctgcgcacaacacagacagaaggctgggtccacccagtgggcggtcgggtgccaggccagtgcttaccccgccatgtttgcagcccgaggccagctggctgcaggtgcaggactaggcgtcaggggtcagggtgcacacatccctgcaggtctcggggctcctgggttgcttctggaagggcacagatgggncctgactggagctgccgaggggtggagcttctggggaaaggatccctcctagggggagtgtcttgggcctggggccacgtggcagggacagagacgggtccatggcagtgtctgctcttctctgtgaaggcaaaaggcctctgagggagtattacagccgcctcatccaccagaagcatttccagcagatccaggtctgcaccccctgactgcagggccaaggactacccccgcttctaggtgagaggccagcaggaggctcagggaggaggcggggccttaagcagggggagcaggggtgggcatgatgtactttttctgaaaaggtggctctggaggccacttggggacaggacctgggctctggctgaactcccgggaggaggctacttcctggtgtgccagcccctccctgccaggtcgccccagaggccctttaccaaggggtttgaggaggccacgtcctttcagtctgccacgccctccattcnntcctcttccttcctncaggagggctgggcctgggtttggggccactgttgcccaggtgngggagggcagtggctttgggaggaacagggacgatgtgtcaaacagcntcgcctctcccagtgagatggttctcctttgcctncntctctttccccnttgatttctccaagtggggagtcntggcttggtcctgatncgtctctagagctgcatcttccancttcnagtgagcagancagttggagtctgagggcnttttcctggcaggattctccagctagtctttgttttngacagtcttgctccgttgcccaggctggagtgcacgatctcagttcatgcaacctccgcctcctgggttcaagcgattcacccacctcagcctcccaagtagattacaggattacaggagtccaccacaacagctggcttatttttgtatttttagtagagacagggtttcaccatgttgtccaggctggtcttgaactcctgacctcaagtgatcctctcgccttggcctccctaagtgctgggattccaggcgtgacccatcatgcctggccccaggtagtctttagaaatgttaagctatttggctttattttcacactgacagctggtttgtggtgggtgtgttatggtttattattattattattattatcattattattattttgagacggagtttcgctcttgtagaccaggctggagtgcaatggcncgatcttcgctcaccgcaacctctgccttcccaggttcaagcgattctcctgcctcagccgcctgagtagctgggattacaggcacatgccacggattancatcgctaattttgtatttatttttagtagagatggggattcaccatgttggccaggctggtcttgaactcctgacctcaggtgatccacccgccttggcctcccaaaatgctgggattacaggcgggaggtgancctgggaggtggaggttgcagggagctgagattgtgccactgcactccagcctgggtgacagagtgagactctgtctcaaaacaaaacaaacaacaacaac

SEQ ID NO: 251372 - DNA, 892 bp, Homo sapiens
gaccaagtccctctccttccaccaaggagcgcccagaggccggcgggagctccaggttcacctcctcctcctccaggaaatcccacttccagctagatgtctgcatgaactactgaaagctgctgagtgtcttgcagcaggtgagctgtggccagagctcaaggatgaaggggactccctcactctgtgactgtgaagaggaagcctgaggtgtagcaggcccaggccccagaagtatggaaaaaatgaggtttgacagaattcatgttgctgccatagaggggctcttttcaaactgatgtcttaaatcttgttcaggccattttcaatccagaggaagaccttctaaaagaggtgatggatgggagagtgctgacatactatgtgaagctactatttggagttggacacgagtgcatgtgaccttgtgccacagcgggaatcttgactaccacacaaatgaatccattcaaatgttggcaagtggagcagagtcccaggacaggtacagaaacacccccagttcaagaatcttcacatctgaatttagtcctacacctgcaactaccccagtttcatttcaacttaggtttaaggggttcttgataatctgacatgataagtggtgttggaattggcattaaaatccaccatgctctacagcacttcatccttcttcggcaggcaccaatttgatcttctactactttgcagacatctcttctgcaaacaccagacaaattgagacaatgaccttccgcaggacccaaaccacctcttactgcaggaaagaagatccagtgagatagttagtccacaaatggaatgtaaatccataaacactcttaagtaacagaataaatttagtatgagcatttttatgtgggagctc

SEQ ID NO: 251373 - DNA, 404 bp, Homo sapiens
agcttctgctttgcgtgtgcttctctctgtgtccttttctcattgggtctccggaagaaagatctgtcaataatgcaatgaaaatattgctgtgagatgcagacccgtaagtagactcctccatgccgagcactcttgctcagctgcccttcttttatctgaggcagagatccctgggcttgcaattatggtctttgactttggtaacaattctgtttgaaatgtttccaattacacacaatattggcggcatgtagcagctgcatgccaaaaagcatttcgaagtgtgttccaagaatcaggctgtgattgcttttaatttaaataaaggctatttggtttcctgtgatgttttttataaccacctttccccccatttttgttgcctttaaaaaaaaaagaag

SEQ ID NO: 251374 - DNA, 322 bp, Homo sapiens
tctattcttcctcccagaataaaatcttccatcttctctgagttaggccttcctcatcagaaccatttcttttctcattcagctctctgaggttttctacttatcatccaactgtagtatccactgataaattacacggattcacaatccagccacttactttgtttcctcctaacatttggaataagctacttcctgcaccagagcctctgtctgtcatgcctttaccggatcttattttggggggctgaccagttgcctaaacccacatgcaccctctcacctgggttctcaagaacttctattttggacatccaccaaa

SEQ ID NO: 251375 - DNA, 1008 bp, Homo sapiens
tgtgtcctttacagttactgggatcttaatatgtgccaggaattgcttcaaagcttccatgtactaactcctttcgtctttacaatgatgaggcaaaaacatattaagtagcctgaccaaggttaaatagcgagtaataggcagaatgaagactaggactgcagagcccactctcctctactcctagtgtgttttcatccaatcatgaaaactacaaactgctcactgagggcagacagcagcttggattagattagctacattgaatttcatgggatactcttttaaaatagttttatatcatttactttgtattttgtttatcaaaccaaattggaaaacaattgtattacccagtgaacctgcaaagtttaattctgctagagaatagaattggccacttgtgagctatgccaacccattgataatgacgaaagtgcatttttgagccttcttggcctcttttacatctcttaccatctaaatggcaattgggtgtcttgctgaatcttacccagctggcaatctaaagtcttggttataattcagaatttttgtctgcctgagtgtaattcaaatgcagggccagatattctcttcaaagccaagttatgattaatgctggaagtatcttctatggaaacatgactgggctgggaagcctgaggtttgaattctaaggctggatccactcccaattcgttctgcggtactgggttaacacttttcatttactgagtctcaactcccacatatgtggaaagacagtttgaagtaaatgatctataagatttccttgagctccaagactctatgatcctcatagagttcttaatgaaagaaagaaagaacctattatgtacatggtgaaaagacaatggtatcattttctaagacttatttttagatgactaggaacaagagggataacctaatttctaatatttcaaaaaaattattaggacttccacaatgttaagttccatctttcattatatgttttagctt

SEQ ID NO: 251376 - DNA, 333 bp, Homo sapiens
tgtgggtttgatgtaacaggacttgattactctttgaggcccaagatttttgtcaattcatattagagatgatcaaaatgtccatgtaacagaaagatgaaaactaatgcatttgcttggtaaagactttatcgatttctaattttggctctaatcaatttatcttgcccaagagaaatataatcagtccctaagtagagctgtaacatacaaatatgaatggaagatgagcagttattaagaggaactgtaatttttgtaggaggcttcgacactgcctgccacccaagtattgttcagatggcttgaacacaggtggtgttgctggctaga

SEQ ID NO: 251377 - DNA, 997 bp, Homo sapiens
atttcacagtcagtctcacacagcttctaagttaaatcaaagtgtttatgatagttataaggtcagaattgtacctaagttgggccaagaggacatttcttaagcttgctctcccaaaccattgatttattggtctatttatttaacatcctctgaatgcccatggggttctgcagccctgtgccagatgctgagatacagaaagaatattagtccttaactccacctccaaataaatacaaagatcaagaaataggtaccatccccaaatacaaagatgaaaagctatttttattataagcatcaacctattctactcacgtttatctcaagcataaagaatatcccccactatcacagggcttcttgggcagtaaaaataagtttgtatttctaaaactgtgaaaaatcatctcaggttgtactgttcatttaaaccttgactttggcagtgttaggctgcttggaatcaatcaatgccaagatgcaccatgttaattgcaaccgagaaaggaagtggcaggtgtttccaaccctgatgagctgcaatgaaattgatgttttctgcattctggaggcaaatgacaattcagcagtgtctctcttcccaggaagcagatttacaggcttttccttccaaactgaaaatggcagcatgccccacccaggtggctgatcagagaactacctcagcagggcagaggtggcagggggcagccggggccgccacatgaacagagaggggcagtcattggatgtggtgagctcaaatgtaggagtttattgtaataagaaagttcacatacaggggaaagtgtacgatttcatctactgtttatcttctaacctcactgctcagtagcttgtaaaagattaatttgctccaacaattgggaactattcatgtggatggaaatgtgttatttgtgcactgctatagatactgaaatgaaccaaaaataaatggttttgtgtctcaggaatcaaaacattttca

SEQ ID NO: 251378 - DNA, 810 bp, Homo sapiens
atttcacagtcagtctcacacagcttctaagttaaatcaaagtgtttatgatagttataaggtcagaattgtacctaagttgggccaagaggacatttcttaagcttgctctcccaaaccattgatttattggtctatttatttaacatcctctgaatgcccatggggttctgcagccctgtgccagatgctgagatacagaaagaatattagtccttaactccacctccaaataaatacaaagatcaagaaataggtaccatccccaaatacaaagatgaaaagctatttttattataagcatcaacctattctactcacgtttatctcaagcataaagaatatcccccactatcacagggcttcttgggcagtaaaaataagtttgtatttctaaaactgtgaaaaatcatctcaggttgtactgttcatttaaaccttgactttggcagtgttaggctgcttggaatcaatcaatgccaagatgcaccatgttaattgcaaccgagaaaggaagtggcagggggcagccggggccgccacatgaacagagaggggcagtcattggatgtggtgagctcaaatgtaggagtttattgtaataagaaagttcacatacaggggaaagtgtacgatttcatctactgtttatcttctaacctcactgctcagtagcttgtaaaagattaatttgctccaacaattgggaactattcatgtggatggaaatgtgttatttgtgcactgctatagatactgaaatgaaccaaaaataaatggttttgtgtctcaggaatcaaaacattttca

SEQ ID NO: 251379 - DNA, 652 bp, Homo sapiens
atccctgcaagggtaaatacccttgtccccccccccccccaaagaaaaaaaaaaaaaagagaaggaaccaggataagtagtacagcggacttcttgtcagaaactaacaagcaagaaaacagtggggtgacatctttaacatgctgaaagaggaaaaaaaaaaaaaactctcaacccagaattctatgcacagcaaaaatatgcttcagacgttaaggagaaatactttctcaaacaaaaactgagggaattaattgctagtggacatactctacaagtaatgttggaggcaattttttaggcagaaggaatatgatatagtcagaaagtcagatctacacaaagaaaataagagcatcagaaattgaataagtaaaagtaaaacagcagcagcagcatggagtaagtgccaaaggcaggagccgggacttgtgctgaattcttctatttgctcattaaaatgaatcattacatattgtttaatgagtatggagtttcagtttgggaagatggagaagttctacagatggatggtggtgctggtcgtacaacagtgtgaacatacttaaactgaactgtacacctagaaatggttacagtggtaaaattttgttatattttgctataataaaaaatgcaactgatacatcca

SEQ ID NO: 251380 - DNA, 1300 bp, Homo sapiens
acctccacactgaagaactaacagaggaggaaggcatcctcatctccaagcatgcaatgtgcttacctggaatccactgtcctagatgacatgtttggctttcaacaaaaaattacaagacttacaaaacagcaagaaataacagtctgaagggataaagcagtcatcagaagtagaattagatttgacacagatgttagaactctcagacaaagaatttaaatggctacaatcaatatgttaatggctcttatggagaaggtaaacagcatgcaagattatataggccatgtcgccaaagagatggaaactacaagagagagccaaataaaaaatttttaaaatggaaaacagagataaagaatgcatttaatgagttcatcaatagactggacatcattgaacaatcagtgagcatgaagataagtcaaccaaagttacccaaactgaaatgcaatgagatttaaaaaaaaaaaaaaagaacagatcatccaagacctattggataatatcaaatggtaacattcatgtaactggaatcacagaggggaaaataaagacagcagggcagaagaaataagggccaagaattttccaaaattagtgacagacaccaaaccacataccccagaagctcaaactcaagaggataccttgcaaggtaaatatccatgtacacacacacacacagagagagagagagagagagaaggaaccaggataagtagtacagcggacttcttgtcagaaactaacaagcaagaaaacagtggggtgacatctttaacatgctgaaagaggaaaaaaaaaaaaaactctcaacccagaattctatgcacagcaaaaatatgcttcagacgttaaggagaaatactttctcaaacaaaaactgagggaattaattgctagtggacatactctacaagtaatgttggaggcaattttttaggcagaaggaatatgatatagtcagaaagtcagatctacacaaagaaaataagagcatcagaaattgaataagtaaaagtaaaacagcagcagcagcatggagtaagtgccaaaggcaggagccgggacttgtgctgaattcttctatttgctcattaaaatgaatcattacatattgtttaatgagtatggagtttcagtttgggaagatggagaagttctacagatggatggtggtgctggtcgtacaacagtgtgaacatacttaaactgaactgtacacctagaaatggttacagtggtaaaattttgttatattttgctataataaaaaatgcaactgatacatcca

SEQ ID NO: 251381 - DNA, 616 bp, Homo sapiens
agaagacatggtgacagaagcaagaggctggagtcactcatggaaggggccacgagccgagaagtacaggcagcctccagaaactggaaaggcatgcagccggatgtcccccctgcaatcccgaagcctccagaaggaatgcagctttattggcacctcaattttagctccataaaatccagtttttggacttgtgcactctacaacattcaccaaaatggtacccacagttgaaaacactcataagaataatgaagtcacattgcgatggactttgctctcccagctcaaattatgtgccaactaatacagcatatcgtatgatatatttatcaagtgatttgccacccacgtctgtcccactcagaaaagcctattgcaatgcaagagaatgagcgtgataccattaaagggttgatcttggatctagtctaatttgtgaagaacattttataagtcactcaaccatcatgagtaacaaatcgctggggaagtggcttaggcctcccagccacatgccaggaagcctgtgtttggcaatgactgttgctctgtacagaatggctcaagtgttctattggaagcagttggaccttgtggctttcatgctgtcacc

SEQ ID NO: 251382 - DNA, 281 bp, Homo sapiens
agaagacatggtgacagaagcaagaggctggagtcactcatggaaggggccacgagccgagaagtacaggcagcctccagaaactggaaaggcatgcagccggatgtcccccctgcaatcccgaagcctccagaaggaatgcagctttattggcacctcaattttagctccataaaatccagtttttggacttgtgcactctacaacagtaagagactagatttctattattttaagccactgcttgtagtcattggttagagcagcaaaaggaaactgat

SEQ ID NO: 251383 - DNA, 957 bp, Homo sapiens
ggcactgtttctccacacgcaaactgatctttgtcataaatcacttttataatgagagagcagcctggacacattgccacaccttccccattctccagctcttccttggtgatggagaagttatctccgcatgggcagggacagaaatatgtctccgagtcctcgtcatattggaagtcctcgatttccacctcgtcatgaaatactgccatggtcagcgggggttgctgaaggggtgacgccccagcagtccgagaccagctccgagggtctaacttctccggagccggcccaggctctgactttcatttaattgtcctgaaaggtgaattctatcttgccaaataggcaagtgttttttatatgtaggctttaggtgtcagaatataggaaattatcaaaatgtggggtcattttaaattgcatcctaaaaccttttaaaatttgggaagaagctgggcgtcgtagctcacgcctgtaatcccagcactttgggaagctgaggtgggcagattacctgaggtcaggagttcgagaccagcctggccaatacggtgtgacccccgtctctactaaaaatacaaaaattagccgggcgtggtggtacatgcctgtaatcccagctactcaggaggctgaggtgggagaatcagttgaacccaggaggcaaaggttgcagtgagctgagatcgtgccattgcaccccagtctgggcgacaagagtgaaactccatatccaaaaaaaaaaaaaattgggaagaaaatgagtatatttatatgcaggtgtagattctgagtgcacacagtagttggaaatggcagcttgcttggttggaaagttgcttaaaagtggatgggtggaatgttccagtcactccaggtggttcagaagttaaatccatggcagcatggcgcttgtgtcctcctggacttgaattaagtagaaagttactacaa

SEQ ID NO: 251384 - DNA, 262 bp, Homo sapiens
actaaaccctcagctctcctgtgtctccaacctgcccgctctgcctagtgatcttgggacttcccagactttataatcatgtgcatctcctgctgttcccaatctactcatcctaggaaccaactcaggtcaggagaagcaaggaaagccttacaacctgttactgaccggaggggatgaaggagacagggaaactacaacacatggaatgtggtatcctgaatgggaccctggaaccaaagaatgacactggggaagaact

SEQ ID NO: 251385 - DNA, 1139 bp, Homo sapiens
gtggttcgttatgcagcaaaagataactgattcaggtataaagcacatggtcacaaaggacctaaggggatggggtacatattgggttttgcagtagccttggcatttagctctagagcttatttgtagctcagagctgtgaacatgatgggctcagcatggggagatgataaagtacaggcgagaaagccccttgcaaagtggtcaggcacccgggccaggacaggtctaaccatcctcaggatgtggcacgacctcctatttgtaggttaggtgcaaacaaatgctcttcttcgatgcttacaccaaccccaggacccacagaaggcattctgtctccatcaatccagggctggcataggattttaagagacagggcattttcaaggtaaaagagcatttctgaatcacattcatctaataaatagctacccaatgtcgactatgggctctccactgttccaggcctggaaatgtagcagtgtgcctcatggaaatgtagcagtgtgcctcatggaaatgtagcagtgtgcctcatggaaatgtagcagtgtgcctcatggagctgaccttcccatgtaacctagcaagcccttgaaaaggagagaaaaaagtaatggggaaaggtagcctccctgtggtagttttaaaatgtctgcaaattcttctctccaagaggtggaactgaatttacctccccttgagtacgggctgtacttagtgactcacttctaacaaagtcggaagtgatggcgtgtggcttccaagggtaggtcttaaaagacactgcaagctctgacctgggctccctcttcgatcactagctctggggaagccagctgccatgctaaaaaagacactcaagcagccccacggagaggtccacaacgcaaggagctgagtcctcccaccaacagccagtgaggagccgaggcctcccacctacaaccagtgaggagctgaggcctcctgccacagtcacgggagtgagccttggaagcagatcctccagtgtcagtcaggccttcagaaactgcagcccctgctgacatcttgactgaaacttcaaaatcatccagctaagctgcttccaaattcccagctgggagatgataaatgtttcaagctgctaaaaaaaa

SEQ ID NO: 251386 - DNA, 893 bp, Homo sapiens
cgatcctcagagagtttacaatgtgctttttccgccaatcagaactgtggacaaaacttcctatttcctacaccgcagctgtctgttcaccttcagctcagagagcactcctgacctttcgtaatgaaatggaagcctccccttgtctggcaaataataaactcagtgtctacttttgccggctttgggaccttcgtgtttttccggggctcaggtctcactccagccatcgctgtggccagtggagagccactcccctctgggggcagtcgccgagagcctccttcccctccgtccagccagcaaggctttcccaagcgtcctgggcaggagggttgggccctgctttccaccaagtcactcagaaggtcccaatcacacatgattggcctcattgggtcagcacctgtgaaaggaagattaaaaactcgacaccccaattcactcaaccaagaagaaaaaagctgaaagctgagtcctgcaggaagctgcctttccctttgccctaagcagacagctgcagatgagagggtcagcatctccactagtggctgctctgtgtgccccttatctcatggaaagtgccaatttactgagcacgagataaacaggtaactgactgttcccacctgctccttttctcctgcagcatggagcaatcagtcatgtgaccacaccctcctccctctgccccctccagccggcttttccccttgactgaagccttcaacatcatcttgggagagaggcacagacctgtctcctgggtgcatccttagccttggcaaaataaacttctccattgatcgaggcctgggtcgggtacttttttggtttgcagactcacccacatgcttttccagttgggccttgctcttctcttgtttgagtaa

SEQ ID NO: 251387 - DNA, 445 bp, Homo sapiens
tcagccatcactattatgacaacaagctacctaaacatggtttccatcagatgcccaaagaatacagccagatcctccaacttcacatgaaaggaatcctcaaactgcaatttagcaaatgtgaagtcgcctaaacaaagtatcttaaaatgggaataattttaatataatgcagtaggtgattaacaatgtctccaaacaccaaaggaggtggctaaagagtattttgagatgagccccaaaatttggtttgaccaaagcttccccactcattttgcaatgatggcaagtcattcaatccttctcatcttcattttttctccttataacatggacaccatatctgactcatacaaatttttataatttatgaaaattattggcatggcctttggtgtgaggtagggactcaaagaatatttctttcttactatttataccagcc

SEQ ID NO: 251388 - DNA, 461 bp, Homo sapiens
ctttctgagggtcacagacccacaaaaccaggactggagtataagtctctggactttcaccttgggacattctcagtttccaccccactgtttctgagggtcgaaaggtttgggtgtatatgtagggaaagataattggtaggctctgaagcacacagttcatttgtttttcaataaggaagagtcatgttagaaattttgtcctttcttccagaaggtacactatatagcctggagccacactgtccaaaatggtagtcactggccacatgtcattataagaacttaaactaattaaaattaaatgaaatttaagattctcagtcataaagctgtattttggctaagcattgtgacttatgcccataatcccagtattttgagaggctgaggcaggattgcttgaggccatgagttggagaacagcctggaaaacatagtgagaccccatctctaccaaa

SEQ ID NO: 251389 - DNA, 421 bp, Homo sapiens
ggctctggcaaattaaatattcaaagtgaagaactcagaatttattgaaagcctgtcaccatttaaaatgcataattttagcataaatactctagaaatattccttttgtttgctatgtgttattgttaataaaggagatcctacatctagatttgtcatacgtcattaatgaatcaaccataggatgtaaattataattattttgaattatctatttactgtttaattacatttaattttagattctcctaaaatggcctaataaaaattttgggtgctaaatgactgcctcatctgcttactctgtgctacttgctaaaattagttatattaattgtttggggattctttttcttaaaaaaaaaaactaaccctgggggcatggtcctaaataaaatatcctaaaaatttaatgctttt

SEQ ID NO: 251390 - DNA, 381 bp, Homo sapiens
tttcctgaaagatccagaataagatttttctctttttaaaatttttgtagcaacacttttgcatggtagattttaacacgtctctgagacttttttatttttgaaggtaatagagaaaatgtaagcagaattgtaactccaaggaggttgtaaagtatatgtagtttcaggagttctttcctcctcacattgtataataggcacaaactctcttttaagaccctttcttttttcctcccatgcaatttacttccacatacacatcatcattaatcactcctctgctgtttcattaacctgatttcctgggaagctaaagtaagtgtgtttgacttgtattttgtcaataaaaccatattatattctcccttatctttcact

SEQ ID NO: 251391 - DNA, 200 bp, Homo sapiens
taggtcatacatgggaatttgtgggtaatgaagattcctgggacccacccctagagagtttgactcagtaatattgttttttaaataagacttcagatttaggggtggaggaggaacaccggatcgcactgtgggagaaacgctggcctgatgatttattataaataaataatgtgccctactgctttcacagtttaata

SEQ ID NO: 251392 - DNA, 535 bp, Homo sapiens
ctcctgtgttctgagctgacgggctctttccatgtggtgacgaacatcctgagctccctcccacacatctggccacagttggtgcccacagccttctccaagcctggacttggctcaccgcgtttacatgtctctctccaaacagaggagaggatgtaagcagagcgtaccatgccagggctcggcacacagtaggacttcgatatgtatctcttcccttgaatgttctcaaccctggttaggtaagaccagatagaaatgtggtgatggaggaaggaaggagaaagggaagagaaagagaggaggtgcgggaaggcggaggggagcatctgtcaaatcataaaaccatccaggagctcctgaaggttctagatcctgaaggttctagagaccagctccatttggcatcccctgggatttcattagaaccacagaattcctccattgcagacttcctgaatcagaatctgcatttttacaagatctgcaggtgatcatgtatacattaaagctcgagaagccccatgctagaaga

SEQ ID NO: 251393 - DNA, 527 bp, Homo sapiens
ccagcttctccaatctgtgcttttttctggaagcttcaggattttgagctttgtccaggaggcctttcaagtggcactggacttgtttctaaaaaggttcacttcaaaagtacaaatgtagagggatacccaggacagggaagggtgcaggtactaaccactcagcagcaggagcagtttctacctcgtgacacctatggagccctcttatctctggaaacagtaagtagagtcatcttgtggcaggagttggtggggttgtggttttaggagagtgttgaaggtctgggatgagctctgtgggctgatggaaggagtggggagacagcagtgaacaggctacggggcagcactgtggcctgttgtggttgagggagcagagaaggcacatctacagattcaccacagctgggctttggacaggggagaattgaaagaaaaaaaacatgagagaactgaaggcaccagcatggtatagtgtctttggcatcagacaaacctgtgttctgtacctggctccaccacca

SEQ ID NO: 251394 - DNA, 334 bp, Homo sapiens
agtcagtcccgacaggctggcacccttcagtgtcttgtcttaggcagcacagtggtgtatctaccacctcaactggatagaggaaggctgaccgattcccacagggaacccacccaccaatagtgtaaaagtcttaggcttgttgctgctgactgaggaggtccattcagtagtgggaacaagagagaagtatttcttagcaaaatggaactaactttatttatttatttatttagagacggagtcttgctctgttgcctaggctggaatgcagtgagcctagattgtaccactacactccagcctgggtgatggagtgagatgttgtctcaag

SEQ ID NO: 251395 - DNA, 584 bp, Homo sapiens
cttcttccttccaaggtgtctgtgtcatgggtttagtgctctacagttcacagagtgcttttccagacattaagtactctgattttcactacaagcttgagagtggattttactagtgcactcgttgtacacaggaggaaactgagggttacagggattagagagtgtactagttttttagggctgcagtaacaaagtgttataaacagagtagcttaaaacaaaagaaatttattgtctgtcagttccagaagtcctaaatcaaagtatcaatagaataggttccttttaaggtccctgagggcaaatctgttccaggcccctctccttctggtggtggctggccatccttggcattccctggtttgtagctgcgtcaccccaatcttgcctctgtctttatttggtgttcttccttcctgtgtctctgtccagatttccctcatcttataaggatactagtcatattgtattaagggcccgccttagcctagtaagacttcgtaacttaactaactacatttacaaagatctcatttccaaataatgttttcacattctgaagaactatgagtgagaacttt

SEQ ID NO: 251396 - DNA, 629 bp, Homo sapiens
gcacaaggttattgagaaaataatcattaattttccccctttttaccttttctgtgtaaccctgttttcttctacctccctgtctttcttttttccctgttctctctttctacttcttaaaacatgcccattttcatcacaggaatgcttgagtttagaggactaaggtgatcttctaagctctgggattccaaattcctcaaaattgaagtccttttttataagacaataagtggtgtctatgctgaacatttgaaacaactatcacatatgattcatttgtccttcagctaaaattcatcttatatgtgtctaaaacaacgtatcctaaaatggaatgttgcaaagaagacaatccgtttcctgaattatttcagtcttcaaatgtctaattcaactaaagatgttcaatgacattgattagaaacatacggaagactttagataacattataaatctagataaatataaataaatggcacaaaatacttttgatttctaacatagatgttttgatttattgcatttcatcatagaattttgacttaaaccttagaatctgtgggatctttgcaaaagtacttcatttctgagctacacacttgaaatctaatgttccttactacca

SEQ ID NO: 251397 - DNA, 633 bp, Homo sapiens
agtgacagctgacaggttgctatgaatccaagaggtagaaaaagagtcagtcccggaaccatttcaccacatgatacaaaaatggaggtttacaacaatgactttgaaccaaatcaggttaaatcacattcagaatcttgtatccaaatagcaaggaagtatataacacatttttaaaaatttaagctaggtgtagtggcacatgcctgtagtcccagctacttgtgaggctgaagcgggagaatctcttgagcccaggaattcaaggccagtctaggcaacatagtgagaccctgtctaaaaaaaagaaccacagaaaaacaaacaaaaaaacaaaaaaaaaacccaaaccaaactttatcttataaaaaacgagaacataaagattaaaattttaaaaaaaccttggccaggcacagtggctcacgcatataatcctagccttttaggaggctgaggccgaaggaacacttgaggccaggaatttgaaaccctgtctctacaaaaaataccaaaaatacccccaaaatgagctgggtggagtggtgcgcacctgtattgttagatactctaggagctgaagtgagaggattgattgagcccaggagctggaggcttcagtgagctacaatc

SEQ ID NO: 251398 - DNA, 268 bp, Homo sapiens
tccccaaaggaaactacagccatcagcagggtactgtgctttgggaaaatgtcaacatttagattttttcagggattactagacagtggctctcaatagaaattatacaaactgaaaaaagaatgaacagagcctgaatgacctgtactaagtactgagaagtctagcatgagtgtaattgtagtcccagaagaagaggagaaacagaatgggacagaaaaaaaaatttgaagaaatactggacaaaagtcttccaaatttgataaaa

SEQ ID NO: 251399 - DNA, 616 bp, Homo sapiens
gattttgtggtaaggggtgatattgtggggttgttagaagaaacatttgttgtgtagaattattggtgatggcctggatatggttttgtatgaattgaaaaactaaatggaataagagaaggagaaaaacaggtataaaaggtctaagaattgggacgactcaggacatctgattagagagtgcctaaggagattcagcatagccctgccagcaaagattatttacttcaagagttaagaatggcagtttggggatagcacgaggcaagcgtgatcagggtgaggaacagcaaagaaggaaatatggggaaatggggtgaatatcaggtggatcagagagatacagtcatgggggtcaggtgtggtgtgaagtaggccttatttctcttgtcctttcgtacagggaggaatttgaagtagatagaaaccgacctggattactccggtctgaactcagatcacgtaggactttaatcgttgaacaaacgaacctttaatagcggctgcccattgggatgcctgatccacatcgaggtcgtaacctatggtgattggctctgatagggttggctgtatcctagggtacttgtcacatatcctatcgatctgcgccggg

SEQ ID NO: 251400 - DNA, 558 bp, Homo sapiens
gattttgtggtaaggggtgatattgtggggttgttagaagaaacatttgttgtgtagaattattggtgatggcctggatatggttttgtatgaattgaaaaactaaatggaataagagaaggagaaaaacaggtataaaaggtctaagaattgggacgactcaggacatctgattagagagtgcctaaggagattcagcatagccctgccagcaaagattatttacttcaagagttaagaatggcagtttggggatagcacgaggcaagcgtgatcagggtgaggaacagcaaagaaggaaatatggggaaatggggtgaatatcaggtggatcagagagatacagtcatgggggtcaggtgtggtatcaggaataatgtgggaggccagattgaagtccgggccaggaacaatggtaattgtgggacttaaagagtgagtacagctgaaggagccggggagcagaaagtatatgtgtcaggtatgaggaagaaaatagattttggaagttatgagaaatgtagagagtgagttgagcatagtttgtgatttttaggg

SEQ ID NO: 251401 - DNA, 437 bp, Homo sapiens
agtgaaagaggagggaggagtggctgtcagtgtgggcactgggctattatcagtgagtgtattcatttgcttgggctactgtaacacagcacctcagactgtaacacagcacccatgggtttgccgacagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatcagggacaaaaat

SEQ ID NO: 251402 - DNA, 365 bp, Homo sapiens
cttctgcccccttcctcgaggacaggggtgtccagaatctgcgtctgagatctctctgggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatcagggacaaaaat

SEQ ID NO: 251403 - DNA, 230 bp, Homo sapiens
cttctgcccccttcctcgaggacaggggtgtccagaatctgcgtctgagatctctctgtctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatcagggacaaaaat

SEQ ID NO: 251404 - DNA, 994 bp, Homo sapiens
ctatgaagaaatttggcagagaaactgctatttaaataattcttcatgaatcacaaatatttttcctcaatttatctgctattttatgtcattacctgtgactgttagtattttaggacaatttcatttgactcctgttggaaataagtgttgcccttttaactatgacttcagtaaaactctcagtgagctgataggaaaggattctgattactcagctgtctaggctggtatacacagagcagtgagtctgtattgttgggaaatgaagttggaataaaataaagttgaagacgagagactggaatttgcctcactgaaactagaaagagtttgcagctttactgaatatgcagggagagaagaggaagccagaactggcctggggtgtacagctaatggccaaagaatgttctcctgaagaccatgtgcacttaggtctacgggacccctcagagccaatcttcagagcagagacataggtagccttcctccttggatgactcccagctttcacttgagaacccagaatcactcaggtgcctttgccaggcaccagcacagtggcagttaactcccaagagaggggaggacattctgaatgaccactttgcccccctgtcatccattttcaggagttaatctctgccgtagttcattgttttcagagttggaacttgtccatttctctaaaagtactaaaagatgaccattttaaggtagagcagattggaaagctgtttcagagtatttggacaacgattttccccaagatacctgggaatgtgaagttggaagccagtctgaatggggctctcggatatttctgagacatcatcaggacaaaggaacatctggtagagaaataattctttttttttcttccagcattgtgggactgtcagcttctgtgtccctctgggtctagcttgccctgtggtccgctgtccatgttaagggtgctaggaaccggggtggcgatattggtttaccc

SEQ ID NO: 251405 - DNA, 886 bp, Homo sapiens
ctatgaagaaatttggcagagaaactgctatttaaataattcttcatgaatcacaaatatttttcctcaatttatctgctattttatgtcattacctgtgactgttagtattttaggacaatttcatttgactcctgttggaaataagtgttgcccttttaactatgacttcagtaaaactctcagtgagctgataggaaaggattctgattactcagctgtctaggctggtatacacagagcagtgagtctgtattgttgggaaatgaagttggaataaaataaagttgaagacgagagactggaatttgcctcactgaaactagaaagagtttgcagctttactgaatatgcagggagagaagaggaagccagaactggcctggggtgtacagctaatggccaaagaatgttctcctgaagaccatgtgcacttaggtctacgggacccctcagagccaatcttcagagcagagacataggtagccttcctccttggatgactcccagctttcacttgagaacccagaatcactcaggtgcctttgccaggcaccagcacagtggcagttaactcccaagagaggggaggacattctgaatgaccactttgcccccctgtcatccattttcaggagttaatctctgccgtagttcattgttttcagagttggaacttgtccatttctctaaaagtactaaaagatgaccattttaaggtagagcagattggaaagctgtttcagagtatttggacaacgattttccccaagatacctgggaatgtgaagttggaagccagtctgagggggccccggtactggaacctctccggcacacggcccctggttgctcttctttctccgcatgtggcgcgctcgtgtcc

SEQ ID NO: 251406 - DNA, 940 bp, Homo sapiens
ctatgaagaaatttggcagagaaactgctatttaaataattcttcatgaatcacaaatatttttcctcaatttatctgctattttatgtcattacctgtgactgttagtattttaggacaatttcatttgactcctgttggaaataagtgttgcccttttaactatgacttcagtaaaactctcagtgagctgataggaaaggattctgattactcagctgtctaggctggtatacacagagcagtgagtctgtattgttgggaaatgaagttggaattttgcagctttactgaatatgcagggagagaagaggaagccagaactggcctggggtgtacagctaatggccaaagaatgttctcctgaagaccatgtgcacttaggtctacgggacccctcagagccaatcttcagagcagagacataggtagccttcctccttggatgactcccagctttcacttgagaacccagaatcactcaggtgcctttgccaggcaccagcacagtggcagttaactcccaagagaggggaggacattctgaatgaccactttgcccccctgtcatccattttcaggagttaatctctgccgtagttcattgttttcagagttggaacttgtccatttctctaaaagtactaaaagatgaccattttaaggtagagcagattggaaagctgtttcagagtatttggacaacgattttccccaagatacctgggaatgtgaagttggaagccagtctgaatggggctctcggatatttctgagacatcatcaggacaaaggaacatctggtagagaaataattctttttttttcttccagcattgtgggactgtcagcttctgtgtccctctgggtctagcttgccctgtggtccgctgtccatgttaagggtgctaggaaccggggtggcgatattggtttaccc

SEQ ID NO: 251407 - DNA, 454 bp, Homo sapiens
acagagtgagactctgtctcaaaaaaaaaaaaaaattattttaaatgtaaggatgcaagaatagtacaaaaaattcttgtatatccttcactaagtttcctgattattacattttttaccatatttgcctgattatattctctctctttataagcatgcacatatatgtattattttgctaaactagtcttgagtaaattgcaggcatgatatcccattattcttaaaaacttaagtctgcacttgccaacattaataccgtttattttatagtccccattcaaatttttccaattgtcctaataatatccttttttaattatttttaattaatagagatgggatctcgctttgttggccaggttggtcttgaactgctggcctcaagcaatcctcttgcctcagcctcccaaagggctaggattataggcacaggccactgcacccagcccta

SEQ ID NO: 251408 - DNA, 399 bp, Homo sapiens
tatagttatcaactcctattgatatgtgagtgtgtatactcccgcaggagagaataaactttgaatgcaaccataacttattacccctttgttccagtgtcacttctgatagcaaacaatgccaaaacagtaacaaattgccattgtattttccattagtcatcagagtataaaagatttgataaatagcgagaaaacacattggctctttcgggtgggaaatccgtgttattgacagtagcaaattacatgtctttgaaaaagatggtgtcacggttcttagagattatttgcattgctactgagacataagaaaacctcaaggagcttttaaaggccgtgtctgtgagatgaatggtctggtgtcctcacccagccccccttgttccagcattcgtg

SEQ ID NO: 251409 - DNA, 245 bp, Homo sapiens
agagatatgattattatagtatactatgtagcattgagaaatgtaaatagatgccaatacctggaatgtatttgcacagcagtgatagttttgttatattcatggtgttcacataattcttgattactctttgttcagccaacagtcagaagaatgaaaaagaagtcccagtttctgaaatatagaatataatgtgcatctggtgcttcacaactttgaataaaatctcagtattgataaatatt

SEQ ID NO: 251410 - DNA, 424 bp, Homo sapiens
aactgctgataggaaagagttataggtctcactgttcaagaggcttgggttttaaagtcatatagcctcaagagataaggtcttggggtccttaagagtccagtggttagaaatgagatgcctgcagttagacctcttaacatcatcacggatatatttgtgtttaatcccagcactttgggaggccgaggcgggtggatcacctgaggtcaggagttcaagaccagcctggccaacgtggtgaaaccccatctctactaaaaatacaaaattagctgtttgtggtggcgtgcacctgtaatcccagcaacttgggaggcagaggcatgagaaactgcttgaacccgggaggtggaggttgtagtgagccaagatcgtgccactgcattccagtctgggcgacagagcaagactccctctcaaa

SEQ ID NO: 251411 - DNA, 697 bp, Homo sapiens
ctcggtcctgcaagacgttagcatgcaggatgcgacggccagatgtccatgctccagttcatcagcagcgggctgtccaaggtggctggcgctctgactgaggctgaagtgggaggattgcttgatgagccctggaggtcaaggctgcagtgaactaagatcaagccactgcattccagcctgggcagcagagtgagatgttgtctgaaaacaaacaaaaccccttttttgagaggcttccttttaggtcagccatacctgtctgccatgggaaatttctccctgccccctctttggcagaggagggtcttagagataagttaaacacactaagcctttctgtgtgtaaattatattagagccatcccacaaatcactgagaagagcatcgtaggttgcacatatttgaatatgacatttcttaaggctgttagagaggatccagttagtttaggtttggtttggggtttttttgctgccttagtaaatgttaaaatgaaacatccaccaacagctctgtggatgtgtcctttaaacaaaggtttattgattctaattattcaagcctaagttaagaatgttagcgaagaatgttaggtggttttcttgggcttaatgtttaacaactggattaaggggcaaacacacttaaaggatggatacctctgagtagttggccttccacctgattcattgc

SEQ ID NO: 251412 - DNA, 513 bp, Homo sapiens
acagcaggaatgagaaactttgggtgtatgtagaaatctgatttccagagttgacacatatatgtacagtttttaataaaaattatgaaagatgaaaagaaataaagtatgacccaaacacaagaaaaaggtttcaatagaaagtgtctttgaaatggactccaccaagttgaaagcatcctcaataatcatcttttggctctgtggaagtctggccattttgtgctcagttgaatgggtggaagagggaaagggggagtggaagtggcggggaggatgtctacagaagtaggggtggacaaaagataggaaatcagagactgcccccccaactgacctaaaactgtgcagttgcagttgttgtaagcccagatgttggatttactagatacaaacttttgtaaatttatagctattgtaaatatatttaaagaactaaaacaaaagtctaaagaactatagaaaagtattaagaatgttgtcttaccaaatagaggatatcaatgaatattt

SEQ ID NO: 251413 - DNA, 652 bp, Homo sapiens
attgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccagctcctggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagcagc

SEQ ID NO: 251414 - DNA, 610 bp, Homo sapiens
attgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctcctggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagcagc

SEQ ID NO: 251415 - DNA, 844 bp, Homo sapiens
aacatgatgacactaaaggcagaagtcgatctccatgtataaacattttaacacatatgttttttgttatcgtggtttctgacctgtctctttgccctgactttctgatactgcactagggttcctgttgctggactccattccatatgacttgctctcgtctaggctgctctttggctcatctttataaatcatgatccaaaatgaagcacatatttattttttaaataaatatgaaatgaagtatagacatcaaactgaagatgagtagatcatactgagtttcactgtctgtgcttggatcaacatcaggccttatacaaatattcaagtccagaggcaaaaggtaataaggaaaatttgtagcacaagccacaaggagataacatgtcaagtctatgcgattggaaataaactaaagatgaactgctggggatgctcactcatcacagagctcagtctaaagcaccagatttcacaagcattttttgggggaaattctgttaaaatgaaatatgagtcacatggtggtgtttcactcatcatatgtgttcaatattaattcattttaaggtttagttgcacaaaaggtaaatgagaattagaagactccatgggtaagaggagccacagaagtaaagcattgtcaagggttctatgtctatatatttagatattaggcttctgagaaaaaaacacaataggaaggaagatgaacacaacagagggcagaaggtctatacgtcctgaggccttttatgcaacgtttgtttgtggaatgttttttaagaatgtgtgagagtcattttaatgtgaaataaagacctacgtctacagacttgcc

SEQ ID NO: 251416 - DNA, 459 bp, Homo sapiens
aattctgtggctactggaggtcactgtgtcagctgtcccgcttcactccacctaaagatacaactaagaaaaccataaagggatagagtgatagaatgaggatcccaccatctgcctaagggcttacatgtgacttcggaaactggcataaagaggaaggcgagggccagacgtggtgactcatgcctgtaatcccagcactttgggaggccgagatgggaggatcatttgaggtcaagagttcaagaccagcctggctaacatggcgaaaccctgtctccacccaaaacacaaaaattagccaggtatggtggtgcacacctgtaatccaaggtactcaagaggctgagacaggagaatcagttcactgattctccaggaaacggaggttgcagttagctgagatcgtgccactgcattccagcccgagcgaccaagtgagactccatctcaaaaaaa

SEQ ID NO: 251417 - DNA, 382 bp, Homo sapiens
ggcaccactaggccctgcctccttttgtagagcctccagccttatttggtgagtttgctactggccagcctccctggagcctccccatgatgtcaccagaagggaatgtaaataagtgagctctgtgtcaggctagggagagtgctgcaggctcttttgggatcctgaggtccctccttcaggaatttcctcgttagtggcagagaaagcatgctccctcctcccccttctcatgcttcagtgttgacccctcctgctaggggtcgtttggcaaaagtcagcaaaattcagccacatttcttttaactcgccgatttcacctctaggaattaattcattggaaaactgtagcctgggcaacagagtgaaaccccatttattt

SEQ ID NO: 251418 - DNA, 399 bp, Homo sapiens
actaagctgaaatccaaaatattccagtgagcatttcttttgagcatcatgtcagcacttaaaacattttgggttatggagggtttcagattctggattttccacagtaggggtgctcaacctgtaccgtgtaaactttggatcagttaaattctccttagaatgcctaggcacatcttagtttttgacttgaaaagcaattctggcactgatgtatacatttcaaaaatggcaatttttaagtagaaaactttcatggggtcagtaaaaattttttttattcccatttttttgcacattataataattacatgaaagactttttgacttgaaattcattcaggatatctggagtttgagaccagtctggacaacatagtgagacctcgtctctacaaa

SEQ ID NO: 251419 - DNA, 731 bp, Homo sapiens
gtccaccttgtggcatcacataaaggggagggaaaacgagctaaaagatcaggaagagtaaatattttgaaaaccatgtctatattattctgaaaagatagaaaaagagatctcttcgggttagtgcaaggttgctgtgatgttaacctgagcagcttcagtgaaataaggtacttatacctagaactcaaagatatttccctgtggattaattttttagattttacgtttatattcataatccattttgagttaattttttctataaatcgtaaggcatacagcaatattgttttgtttttacattttgtgtctaagctccaggaccatttgtttctaactcaaaggtatcagtagagtgaatttgtgttggttgatttttgtgttttctagactgtttcatttttatatctgttcatctttgtgccagtgcttcactatcttcattactgtggttatataataggtcttaatattggacaaagcaattctttattctttttaaatattgttttacctattgtagagtctttgcctttctatataaattttagaataagcttgtctagggctacagaaaaccttattatgattttgatatgttgtgctaactatataaacaacagtgttctaatatctagaatacatatctacataaatatgcttgcaatgtaagtaacaggttaataaaattaagaaaattggcatctttaatatgttgagtatcccag

SEQ ID NO: 251420 - DNA, 612 bp, Homo sapiens
gaaaacccatctctactaaaaatacaaaaaaaaattagccgggcatggtggtgcgtgcctgtagccccagcttttcgggaggctgaggcaggagaatcgcttgaacctgggaggcggaggttgcagtgagccgagattgtgccacagcactccagcctgggtgacagagcgaaactccttctcaaaataataataataataaatattcaccaaggtcctactctgtactaggcactgggaatacagtaataagcaaacagccaaggtctgctggcctcacagaatttatagtctagctggagtgatagataagtaaataatcataagactctataattatgaaggataataagagctttgaggaagtacagggaccttggcctcctccagttcgttagtgcctggtctggtttcttcaagatgcctaagcgttaaccaggtgaaacaggggtgggagagagaaagaagagtccctccaaaaagaacagcatgccgggcacagtggttcacatctgtagtcccagcactttgggaggctgaagcaggaggattgcttgagcccaggagctcaagattagcctaggcaacatagtgaaaccccatctctaccaa

SEQ ID NO: 251421 - DNA, 381 bp, Homo sapiens
gctgtgataactgtattctctggactgtaccctaggcccactataggagaaaaaggtcccatccataaaccagcaacccaaatacccaccctgaaaataatgccacacagtatgtctctgggggaaattctgcccaggagagccagcaacaggggctgtgaatccaggaagcctgtaacacacattgagtttccaggccatggttgccgttctttacctttggatggttacagaagagcttggaactaatgaagactcctgcagaggctagggccagatggctgctttcctgaaacttaggaaattcagatgctagtgatacagcaaatgaatccccccactcccaactcacctcccaacaaatagttatgacttctaagc

SEQ ID NO: 251422 - DNA, 477 bp, Homo sapiens
aaacttctatacaacaaaggaaacaatcaacaaaatgaaaaggcaacctatggactaggataatatacttgcaagccacatatctgataagggattaatatctaaaatgtataaagaacccttacaactcaatagcagaacttttttaaatgagcaaaggatctgaataaacatttctccaaagaagacataaaaatggccaacaggtatatgaaaaggtgcttatcatcattaattgacaacacataggtcctttatccatgtgcacattgcactaacgtgcaaggtgaagactatagttactaaaactgtactgtattaggaatttttgttaagtaaattttagctgctcttgtcatgaaaaagtaacaatgtgagatgtcagataagttaatttgtgtcactatagtaactattatctgtatgtatcccacaacatcatgttataaacctcaaatatactcaaaaaaatttact

SEQ ID NO: 251423 - DNA, 352 bp, Homo sapiens
cagtacatacatgttggtgggtgaatttcttgtcatgagaactattaaggaagctttacaatacagaaccctgcctggtgccattccttgctgagtgggattctgcacagtcttgcttagcaagtcccagcttctgatgcaaagtttagtgtgcacagcacacatgactcacatggtcaggaaggatactcacttcctgaagctggaggtgagtatctggcttttcaacacctacagtgagagcaagtcttgactttccacctacatgtataaagtagaaaattacttaagcataggaatggagatttagatgctggtgggcaatctctagaaatagtggtaagtgctacaa

SEQ ID NO: 251424 - DNA, 355 bp, Homo sapiens
aaagacctcgtttcagttcccactccatctgccgataaacaaccatatcaccttgggcaagtggctcggcctctccaagctttagtgttctcatctgtaaaatggagcaactaatactgtccctgtagaactttacagggtggcgtaagaattgcttgaggaggcagaggttgtagtgagccaagattgcaagactgcactccagcctgcgcaacagagaaaactctgcctgaaaaaaaaaaaaaaaaaaaaagtgatctcttcatatcacgtaaccaaaaaattcatacctgaccttgagttttcccaggacgggattctgtgacataaacccttccatgcttctaccttaaaa

SEQ ID NO: 251425 - DNA, 456 bp, Homo sapiens
gttagaacccactctggcatcgacctttcccggtaggagtgccagggagattgtacacccttctgctctagaatcatagagtcactggcagaaagcacctcaggatatggaattcctgggcctccccaggtttctaacatgcaaattatttcataagatgaaaataagcaggccaggcactgtagcccatgcctgtaatcccagccctttgggagtccaaggtgggcagatcacccgaggtcaggaattcaagaccagcctggccaacatggtgaaaccccatctctactaaaaatacaaaaattggctgggcatggtggcagggacctgtaattccagctactcgggaggctaaggcaggagaattgcttgaaccctggaggtggaggttacagtgagccaagattgcgccattgcgctccagtctgggtgacaagagcaaaactccatctcaaa

SEQ ID NO: 251426 - DNA, 371 bp, Homo sapiens
atttatttggttaattctgctttggtcctggattagggttgccggaatttcacaaatacaggacatccagttacatttgcatttcagataagcaacaaataatttttttagtagagttcttggaagggagaaaaatgaatcagccttgcagatgtagaaagagctttcttttcaactctagaacatttgctgcaaaaattaagggaagtttactgtaacagttgcagggtcttttggagatagtagatacattctaaaactggtttgtggtgctgatcgcacaattctataagtttacttaaaatcgttgaactttacacttaccatggatgaccttgatggtatgtaaattttgcctcggaaaaactggt

SEQ ID NO: 251427 - DNA, 381 bp, Homo sapiens
ctgggttcaagcgattcttgtgcctcagcctcctgagtagctggaattacaggcgcctaccaccatgtcccactaatttttgtatttttagtagagatggggtttcaccatgttggccaggctggtctcaaactcctgaactcaggatatctacctgcctcagccttgggattacaggcgtaagctaccgtgcccagcagcagagcagtcgtatccactcccatggctttaaccacctccatgaatatctctgccccagatttcctaagctctacaactgcatatccaaatgctatctgtacatttatacttcgcctatatgagaccaagtgtctagttgcaagcaacagaaagcaaccttcgtgaatttacacagaaaaa

SEQ ID NO: 251428 - DNA, 399 bp, Homo sapiens
cctccttctgggacctgggccacaccagggcaggcaacaagtgacttgtagcggaaaggcttcagccgtatcctttaagtgacatggccatgcctaacttccagggggtggggagcaccatttcgccttgtccctgggagaaagagaaccaggcactcgtgcctacgatgggagtttcccagcttgcttcactgggttgttaggatggagagggaattgtgtatgatgtgccttgtgagatatcaagccctctgcagatgtaaattacacacacgaaacacaaatgtaaattacaaacataaaccatgaatgtctcatcattgttgttgtcactcccatcttcaacaccattccaagaatcagccgtggccgtcggacgcatccccttcctgtcaggac

SEQ ID NO: 251429 - DNA, 365 bp, Homo sapiens
ttaggaatagaacagtgaaagaaggtcccagtagtcccaaggactcgggaggctgagacacgaagactgcccaggtgagactacagagactgaagttgcagtgaatcatcacatcctgctactggacttgaacagtactgctgctgatgagagccatctgggcgaccttcgacatggcaaggtgcgagccatctgatcagccttagacatggcaaggcaagagccatctggtcaaccttagaagtgacaagggacagccacctggtcgacctttgacatggcaggatgacagccatctggtcgaccttagagatgggaatgcaagaggcttcaggtccaccttcaacatggtaaggctaaagcca

SEQ ID NO: 251430 - DNA, 248 bp, Homo sapiens
agggaggttgaagcctgttctcaagaccagtctgggcaacatggcgagactctgtctctacaaaaaataaattagccaggcgtggtgtcgtgtgcctgtagtcctagttactaaggagcctaaggcagcaagattgcctgacccaggaatttgaggttattgtgagccatgatcaatgccactgcactccaccctgggtggagtgagaccctgtctcaaaaaagagacagaatcagaccctgtctcta

SEQ ID NO: 251431 - DNA, 293 bp, Homo sapiens
acttttccttaaaacacatggatcaaatcagaaatgaaagaggggacattattaccaacctgtggaatacaaaatattatagaggaatattatgagaagttatatgccaggaaattagataaactagatgaaatgaacaaatttcaagaaagaaacaagctacccaaactgattcaggaagcaatagaaaatctgaataccctataacaagtaaagcaattcaattagtagtaataattttttttaatgttccacaaagaggagcccaggttcagatagcttaatctgtgact

SEQ ID NO: 251432 - DNA, 474 bp, Homo sapiens
aattattttgctgtgtttcagcgttatctgtggtcctatggtgagtggcgtctgttctatttgtgtggtagaaacactggacaatggcgtgtccccgcacatccctttccaacgcccatcagtgacacgacgtgggtagcttgaactcagccagggcggagtgtttacaccacagaaatgggcaaacacggccgggcacggtggctcacccctgtaatcccagcactttgggaggccgaggcaggaggatcacctgagatcaggtgtttgagaccagcctggccaacatggcaaaaccttgtctctactaaacattcaaaaattagccgggcgtggtggcagatgcctataatcccagctacttgggaggccgaggcaagagaatcgcttgaacccgggaggcagagattgcagtgagctgagacggtgccactgcactccagcctgggcgacagagcgaaactccatctcaga

SEQ ID NO: 251433 - DNA, 485 bp, Homo sapiens
atagcagtttcggaagtgagtggaggctgaatagctcattgcgtagagatactgtagctgtaggtcagatgggagcagggcagggggtgggggatgggatggtggcgtgaattaagatcacatcctgtcacttatacattcaaaagacatttgagcacccagctttatgctgcagaaggagattactaatatgacccagtccctttcctcaagttgcttataaactactaatagaaacagacatgttctactagtagttgcaaaccactataagccaagcacaagattctgtgactgcataaaggagaaagtaggcaggaatcaggagattgctgaggaaaagtgggtgagacagttcatggttacttgtgtcccatgaagacagagctggtgttttattcaactcattcaacaaatacttatgaaggatctactgtatatggctgccactactctaggagttttggttacattggtaaattaaa

SEQ ID NO: 251434 - DNA, 355 bp, Homo sapiens
tccagagtggcaaaaattaaagctgatattatcaggtgttggtgaggctgtggggcatcatgagtgctcatagcctgctgagcagactacatagcactatagtcactttggaaacagtttggcctgcttagtcaaattgagggtacatcttgcctgtgtgtgctagaacatgtatgcagaaatattcactgaagcagtgtttgtaattgtcccaaactggaaacaactcatatggctatcagtagactgcattaaaaattgtatagttagagagcagcaattaagtaaaatcagctcataatcacatggatgagcctcacaaacatgttgacagccccccacccaaatacatgca

SEQ ID NO: 251435 - DNA, 333 bp, Homo sapiens
aggtgggttccatcaattctgtgtccccaggtcccccagcaaggtggggatttgccttcagctccatggagcagggctctagggcctcagtagtgcccaacagcacagccaagtcaccaaggggaccaagcccatgggcacctcccctctggtgggcatttcagataattttcttcaggagccttgaacaaaagggaaatcacaactgaataaatgaaggtaccaaaatttacatcaatcagtgttatatgatgtatgttggacagtaatatatatgtttcaaagtaataattttgtatatattttaaataaagtattattgctctttcggtg

SEQ ID NO: 251436 - DNA, 449 bp, Homo sapiens
ccttgaaatgtgaaggagaatgaaatgtttgagcaactggaaggattttagtttggtaggattatttaaattttttccattactaaagaagtataccttcactggtaaataatctgtcaaaagtaggaagtaaaaaaaatcagcattgttccccacccctccaagtttccaatataaaccactattaacagtttaatgagttttatttcatatcctttactattcttatgaaaatacacacacgtgtgtgtgtatgtgtgtgtgtgtagttttctttagtaactggtttttataaatatattattttacaaaaacattctactatggtctgaatgtttatttcctccccaaatttacactcccaaagtgatggcattaggaggtggcaccttgggaggtgatttggtcataagtgtggtgcccttatgaataggatcagtacccttatt

SEQ ID NO: 251437 - DNA, 409 bp, Homo sapiens
gttgtcaatcgtttttgctgctgtggatccactttggctctgtgaaggcctggcccacgtgaggagatgtgtcggtctcggagcaattgaagtctcatccccatcctgagcggcctcttttctagcatcaaaacgaacacactgcagatgaggagaagaatcccacaggagctctttgtcctacaggagagcagcagacccatgtcagagaagatgcttgagtcttttcacggctcttctctgagaaatgaagccacaccacgatacagtcagcaagaggaagccgggaatgagagatggcaacaatccctgtccctggctccaaactcccgaaaggaactattttacaggtgccaaaaaggggacagtgttgataataataataaaatgaaacaatctgaaaaaaaaa

SEQ ID NO: 251438 - DNA, 616 bp, Homo sapiens
gggattttgttttttctaacatcccagcttattcccaaaagggtttgagccggacaggggctaaacaggccccttcgacttggcgggccggccagacgtgacagcaatgccaaggaggccaagtttctttgtccatttctcacctcccccttttccatccctggacctcctggcgcccccagtacacagaggcccttgagcagcccggctgcaggttccctatctactcagagttctccccctcacgtgcctatccccaaccctgcagtgtctgcggaccaaaggggaagggagcctcaggccaacccccaaggtacagccagaccagctcatccagcctggaagccaagcattctttactaaattcattgtttggatcttggaatgtgtctcccttagaaacaatgttataaatggtgatctgcttcccaggccagccacaaaagtctgttgaacccaaaatgcagctgtagggtggtgctgagaactgtgtcagctaccctgaaaaaggaggccactgatcagctttatttgtagaaaaaatatgtatatatcttctggttctttcttcttgggctataaacactataaattaaataagttaaagttctcccat

SEQ ID NO: 251439 - DNA, 478 bp, Homo sapiens
cccctttcaaaagtaatcttagaaaacagaagcttctgtttcataaaagtcctaggaaataccatttcacatctcatcagctctgatctgttatgcctatctttagatgtgagagtaaggtcaataatattaaatagagaaaaataagtaagaatagaaaaagtcttggcagtgttcagtggtggcttgcatctgtaatctcagcactttgggaggtcaaggtaggaggatttgaggccaggagttcaagaccagcctgggcaacacctgggtgacagagcaagaccccatctcaaaaaaaaaataaaactaggtcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaaa

SEQ ID NO: 251440 - DNA, 363 bp, Homo sapiens
tcaggctgttataacaatgtaccatagactgggtggcttagaaataacgtaaatttatttatcattgttctggagctggaagtccaagatcaggacaccagcatggtcagattctcgtgggggtcctttgaagtcctttcattattacctccctgcatggtagaaagaaggctggagagttccctgtggtctctataggaacattatctcccttgatgaggactccaccctcatgacttaattatcccccaaggccccagctcctaatgccatcacactgaagattaggattgcatatgaattttgggggcatacagtcaatctaacacactaaataaacatgatttcttaaaacaaaaaaaa

SEQ ID NO: 251441 - DNA, 204 bp, Homo sapiens
gcaataaggatttttctgatttcctccatattgtgcaaccaaaaatagtaaagaaataaattggaagcagaggttgatataaatcaccaactatgctgttcatcaaaacagcctcctactgttcacagagttcctactgattaccttgttaataagtacattttataaacggaaataataaatataacatttaaaaacatcatt

SEQ ID NO: 251442 - DNA, 431 bp, Homo sapiens
cagatgaatggataaataaaatatggtatatccatataatggaattttttcagttttaaaattgtatgaaattcttgtacatgctacaccatgggtgaaccttgaaaaaaatatagtaattgaactaaaccaggcagaaaaagacaaatatttcatttatatgatttcacttatgtgtggtgacccatagaataggtcaattcatagagacagtatgtgaacaggttactgggcctggggttagggtaatcgatgttattgtttaaaaggtacagagtttctgtttgagatgatgaaaaagttctggaaatggatagtagtgttggtcgcacaccaatgtgaatgcactgaattatatacttaaaaatcactaaaatggtacattttatattgtgtgtattgtattttaattaaaatttttttgattgttt

SEQ ID NO: 251443 - DNA, 542 bp, Homo sapiens
tttgatacaccataattatcaaagttgattaatagacaaatattgaattttgttccctagcaacaaagaatatgcctttctgatgtattatttgaaaaccagagcaaaacaaatactataaaggccacaaagagaacttttgtccaaaatgcaacaaaactagacaaaaattaccaaagtaaataaaattttaaaaactcacccttccaccacttagaaactaaaaaaatatgtattatgactgcattaaaaagaaaatgaaaactataatcaccagctatttagaaagtaataaaaatcagaaagttatatataagcattcatagaatgtgactagatcagtacaaaagaggtacgttgaggcccccacatgctatcattattaagccagagagtaaacatatgactaaagcatatggctaaaaaatgagaaatagaagaataaaatccaactaagcagaaataaaaggaaaagaaagataatatggcaatttataatcagaaaataaagtataattgataaatccaagtgtttttaattt

SEQ ID NO: 251444 - DNA, 347 bp, Homo sapiens
ttcctaacactgactttgccttcactcagtctccttccagctcttagatgtcagtcatagaacccttggcaaacctggctcaattttggcccactgtggtagaactgtccttgatccagaaggcattagggatggtagcaattaagtatgtggccagggtagcctcccaacactcatatctgctttgagacagctgcttgttagccctcgttccctcactttcaatatctgtattcctgtctggcaggccccaaaaaagttcagagcaagcctaggctcacacatgggcttgttctctggggcaacattgcctgagatcatggggaccttcctagtacacctatacc

SEQ ID NO: 251445 - DNA, 410 bp, Homo sapiens
agctccctgggaagctgaggcaggagaatcacttgaacccgggaagcagaggttgcagtgagctgagattgtgccattgcatgccagcctgggcaaaaagagtgaaactccatctcaaaaaaaaaaaaaaaaaaaagaggtggtacctttaagaggtgatgacctcatgaatgcattaatgccattactgtgggaccaggttagttatcttgggattaggctcctgataaaaggatgagttctgcctgatttcttctttctgtctcatgtatttgcttacccttctgccttctgccttctgccatggcatgatgcagtatgaaggcccttgccagatgccagtgccatcctcttggacttccaaacatccagaaccatgagccaaataaacttctattattaatatatta

SEQ ID NO: 251446 - DNA, 416 bp, Homo sapiens
cgcttgtaatcccagttctttgtcgtgtcaaagcaggcagattgcttgagcccaggagttcaagaccagcctgggcaacatggtgaaaccctgtctcttcaaacaaatacaaaaataagccaggtgcctgcctgtggtcccagctactcaggaggctgaggtgggaggatcacctgagccctgggaggtcgaggctgcggtaagctatgatcgcgccactgcgctccagcctgggtgacagagtgagtgaggccctgtctcaaaaaaaaaaaaaaagaaaaaatttcttccgaatattcttccctgagtcttggcaaaactaatttctgtataaatagaaggggcagtatgttccttataatttaggtatgtggaagaatgaccagggacaacttaaaaacatttttttctaaaaa

SEQ ID NO: 251447 - DNA, 482 bp, Homo sapiens
agaggccattgtagggttaataattggcctaatttcaatgtaaatgtgtctcagggaatatggaggccaacagagagggagagagatgggagaagggcggagcagtcagaacacacaacatttttccattaagttgaccttcttttctgggtgtggtttgtggtaccccaaaacaattataataaaaacacaaaagatcacagatcaccgtaacagacgtaataataatggaaaagtctgaaatattccaagaattaccaaaatgtgacccagagacaaactgagcacatgccattggaaaaatggctccaattagcacagggttgccatgaaccttcaatttgtaaaagacgcaatatctgcaaagagtaataaaataaagtgtgcctgtaacttttcttttagtttatatattattttaaatatcacagtacatcaaatccaaacataatagctgatccttgattgaactctggacttta

SEQ ID NO: 251448 - DNA, 454 bp, Homo sapiens
attaatttatttttttagagaagtggggttttaccacgttggccagggttgtcttgaactcctgaccccaagtgatcctcctggctcccaaagggttgggattataggcatgagccaccatggccagccatgtggtgtttctttaacccctatattttcttaagaataggaagatctggccgggcgctgtggctcacacatgtaatcctagcactttgggaggccgaggcgggtggatcacctgagatcaggagctctagaccagcctggccaacatggcgaaaccccatctctactaaaaatacaaaaattagccagacatagtggcaggcacctgtaatcccagctacttgggaggctgaggcaggagagtcacttgaacctggggggcggaggttgcagtgagccgagatcgtgccacttcactccaacctgggcaaaagactgagactct

SEQ ID NO: 251449 - DNA, 453 bp, Homo sapiens
ttttgtcttctccgtgaaaatctaagctcctagaaactttgtgagggaggcaatgggtctgttttgtttacctctgcatctgcagggccgagtacaatgcccagctcatttgtaaatgagtgaaggagtcccctactagcaggctgcctactcatcaatcaagtagttgttgggtttctcatttttacctttggagatgttgtcttcgacctacgggaaggaattggatctatttgagggtaaagaaattcatcctccctgggtttatgtattttccaacccatgcacccggcccctccttgctgtcttaatagaaagtggaaaatagaaatcttctgcacaaggcctttggtttgaatgcaacatgcctagagatagggaactggaatccaacaccgttgcctacagatctttggagactaaaagagaaaaaatccaggaaagaaaaaaaaa

SEQ ID NO: 251450 - DNA, 450 bp, Homo sapiens
agaatatcagtgattcaaaacccatgatacaaaataactgctgtttttgacatcacaacacgcttgggttcctgctctgcactcctcactgagtagtcctaactggcactggtggtttagattggcagggaaaactgaaaactgttcaactcccttgactttagctggcatttcccctcatttgtaataaacaattctttaaaatgttatccaggcagcattgtgatataagtgtagtgaaagtgccctgttaaaagtaaaatttagtgggtttttttttgatatctacaactttcttttttctttttttgaagtatatacttatgaggataatgttatttttttatgccctctgttctaggcctacatttgtatttcctccacaaaatgatcctgagtctaatttttttctatttgttgactttattattagagataaattcctttaaa

SEQ ID NO: 251451 - DNA, 1099 bp, Homo sapiens
atggttcaaatatactaagcattttattagaagttgttcaattatattaagcatactctaggcaactagaaatgatcatgtgattttacttctctggcctattatcacaataaattatgttagtagtttctcaatactggattatttctgcatgagatgtatcctgttaaataatggtggtttttccctttttttcttgtaacaatgttgaactcaatttcttacattttatttggattattgcatttatatttatgaataagattgggttgtagttttacatttttgaattctacctttatcagcttaaaaacctagattggtacatagcatatgaattgcctattctttggggtctggagaaactcacccataacattgtttaggcctcaatctctttaagggaggatgagtagaagacaattctctgaaaacttaaaaaacctttttctatggttttactgtcacttcttgagtatcaatttaaaaaatcatatttttaaagaaaaacatgcattttcagagaattttaaaattctgtgtctatatataattataattaaaaatatttttctctgtatctctggttatggcttctttctcatttctggtctttttagttacttttttcctttcttttattagacttgccagtctttttaaggaaccagcacttgagtatttcatcagttctattttttctatttgttataatattaatataacttttcatctttaattccttccttatttttaatgtttattttgttgctttatgaatgttttgtactaattgatggcttagttcatttattttcattttttaatttaataataggacacgtaagactataactttgcctttgggcacagctttgactgcatctcaaaagttttggtatgtagtctcttaattgttgctatttaaaaataatggattatattactgtttttattttatttttgatgtattatttaggatagtattgtgaggtttttgttatttgttaatcctactttctttttaataaagaataaacttattaatatttatgttgctactttaataaagagctgattttgtttggaaaaagtgaaa

SEQ ID NO: 251452 - DNA, 618 bp, Homo sapiens
atacccttccccacagtgagatgtgtcagttccccagaaactgagtcaaaatactaagtaggaagcttgacaatcaccttgcctaattcttttccttttagaaatgaagacatggaagacccagaaaggtagtgactttcccaaggtcacaaagttaaaagcaatgagacctggggacactcttgttgcatcacaccattctgtcaaaaaaactggtgtttactctgtaaacaatgtaataaaaatgaaaaatatgccttttccaatccttttctgaaagaattggcacctggttatggaaacagcacagctctcattcatttactattagtaactcagaaacttgctatcaggtatttagagattatgcctaaagcttttatagtaactgagagaacaacccttccattactgttggtgaacaaccattctgtccaggaactttgtatacaggaaagtgtttttctactgtaaacctataattggtaaagttattttggcttatagagaagacgagagaaatgtcaatctaagtcttaagagaaagcctgggaagtagagaaccaaagccagaaagggcggaattactcactgggctgaggaaatgacaatcatagt

SEQ ID NO: 251453 - DNA, 886 bp, Homo sapiens
acatcagtaaaagataccatctgcaaggctactttattccccaaccttccaaagaatgagaacagtctgagtaaactagggcatgatcaaagatacatgtcttcaatgtaaaccaaacaaaacgtaggtgattccctgtaagaagacatggcatcagggaaatttcagatggcatacaagaccttagtgaggatatcctgagaaatgtgaagaaaggggttgctgattcacaaagcgtacagtacagatgggcagagaatactaggtacagcctctgataaaaaccagcaagacaaccaaattttcaaccatttgagcagccatctgggctggcaagagggtgtacaggtccatggaaaacatcctgagaaatgaagacatggaagacccagaaaggtagtgactttcccaaggtcacaaagttaaaagcaatgagacctggggacactcttgttgcatcacaccattctgtcaaaaaaactggtgtttactctgtaaacaatgtaataaaaatgaaaaatatgccttttccaatccttttctgaaagaattggcacctggttatggaaacagcacagctctcattcatttactattagtaactcagaaacttgctatcaggtatttagagattatgcctaaagcttttatagtaactgagagaacaacccttccattactgttggtgaacaaccattctgtccaggaactttgtatacaggaaagtgtttttctactgtaaacctataattggtaaagttattttggcttatagagaagacgagagaaatgtcaatctaagtcttaagagaaagcctgggaagtagagaaccaaagccagaaagggcggaattactcactgggctgaggaaatgacaatcatagt

SEQ ID NO: 251454 - DNA, 2147 bp, Homo sapiens
tgcacggccgcagctgaacagcatcaccgctgtcccaaggacaaccccaaagaggggcctcgactgcacctcctcgaagttgctgtctggctttggccaagtgcaggaatggtttttgtgagggcatggatggagaagtgccaagggccccttttggtcacttccgaagagcaaaaacgtgttgagaggagaccggtttaagatttcaaacagaacctccccagcgcgcatgaaaggacttgattagcatatgtcaagaggacccgcttatatactcggtgtgtatgtacacaggactctgatctgatcagtttgcggaattggagccccagccaacagccctagtcctagtattggcagcggcagctatagatatttctgcagagccagcagccggctcccacctacccaaggagagaagatcgctccaagacagtgagagcttccctgccatttcagtgcaaagtccctccggagcgacctcagaggagtaaccgggccttaactttttgcgctcgttttgctataatttttctctatccacctccatcccacccccacaacactctttactgggggggtcttttgtgttccggatctccccctccatggctcccttagccgaagtcgggggctttctgggcggcctggagggcttgggccagcaggtgggttcgcatttcctgttgcctcctgccggggagcggccgccgctgctgggcgagcgcaggagcgcggcggagcggagcgcccgcggcgggccgggggctgcgcagctggcgcacctgcacggcatcctgcgccgccggcagctctattgccgcaccggcttccacctgcagatcctgcccgacggcagcgtgcagggcacccggcaggaccacagcctcttcggtatcttggaattcatcagtgtggcagtgggactggtcagtattagaggtgtggacagtggtctctatcttggaatgaatgacaaaggagaactctatggatcagagaaacttacttccgaatgcatctttagggagcagtttgaagagaactggtataacacctattcatctaacatatataaacatggagacactggccgcaggtattttgtggcacttaacaaagacggaactccaagagatggcgccaggtccaagaggcatcagaaatttacacatttcttacctagaccagtggatccagaaagagttccagaattgtacaaggacctactgatgtacacttgaagtgcgatagtgacattatggaagagtcaaaccacaaccattctttcttgtcatagttcccatcataaaataatgacccaagcagacgttcaaaatattaaagtctattttctactgagagactggatttggaaagaatattgagaaaaaaaaccaaaaaaaatcttgactagaaatagatcatgatcactctttatatgtggattaagttcccttagatacattggattagtccttaccagtagactgaagccaaaaatctgttaaactgtggataatgggaaccctcacatggttgctgctggtgcctcacctctctggattatgtttactttaaaatttatgttaaaaatagagacttcatgttgaagaaatggattgacttagccaagagcattgctacataaattctgaggaccttgtagaattcacaggttatggcattataagttttaagaaaaaaaaaaactaaacaacacctgggtgaaacatgaactatgaaacatgccacaccaagacagaacactttttaaaagaatggacctatttatacactttcaatttgaaaatatttattatatatatttatttattaaagagtttattttttactgggatatgaagataatacaaagagtaaaaaacaacaaaacttccgttattgtgccattactttattgtggtgtcttgctctgtaaagaggacattattataccaccttaaccatagaatcagattttgaatttctttttaaaatatagtatagattatattttttatgcagtcaattgccttctaaatgtaacgctggtttcttttggcctagaaaaatgcctcattgatttgtattaaattcaacacacattcaaaagggaattaaacattttcatgtagtgttttggc

SEQ ID NO: 251455 - DNA, 340 bp, Homo sapiens
tgagtttcataatctcatcaatattttaagataggcgagcacacactaataatatctatgcctaccttcttgggtggactcaactgtaaccacagtttattagttgcttagaagtggatttttaaaaaacagttaaatgtgtgtgcataacacacaagtaatgacacactactattattattacctaagtagtgctcatcctctctttctgtgttttcttaggatgtgcactttaatttaggattgtaacgcctaataatatttctgtgagcctttaatgtgatttataagatggccgaattactgaaatcaccattatacctcttccataaaacgactc

SEQ ID NO: 251456 - DNA, 814 bp, Homo sapiens
tgtattttactgcatgcagaggcagcaaggcgacgaggtggcagataatgatcacatcactgtgtggcaactagaaaggcacttttaagaaaaagcagagggaaatcagcttaagagaaaactaaaacatttttcctttgcttttttccacttaaaaaaattaaatagaattaaactgtgtgcagtaggcacttttcatgaactctgatacaatgtcattgattttacccatttgatagattttcatattgcagcaaagcccattaccccacagacaaatggccaattttctccatgtcccacgtgcacaagaggcccttgtgaagttgtgtgtccgtgcacggcaatgcctgccggaacgttcgctgcgcctgttctttcactggctccacaccttggtgcctatggtatgtctgagatgagaaaggggtggagtggaaagccaggagggtattagcaaagattactaaataaacacacaaagtttatctcaactacaccttctccaaagcattaatacatcttgataaaatgagcgcgagtcagtaactatgatcggaccccgcagccaggcgagacaggcatttgattaacacttaaatcagcgatgcaggattcaaatgaacgacaggggggcttaatcaatcaccaccctcctccctccaacctcaaactgcccttaaaaatgtgcactctagctggctgtggtgatacatgcttgtaaatcccagcaactcaggaagctgacatgggaggatctcttgagaccagggatttgagactagcccggacaacacagtgagatcatatccca

SEQ ID NO: 251457 - DNA, 729 bp, Homo sapiens
cccactcaggccatttcgtccctgtgttctaggcttctcttcttcctcatggccttttctctctgagttcctgttgatagatgcagttgcctattgagcgactccagcttcctgtctgcttatgatctgccttaaccatttacacagagacagctctgagctattcgtgatgctggccactcttctcatttaccttcccacctctgccttggagtgggtggtatttcagtttgtaatgaagacagcaaggcgtagaaaggctaagggacttgttctaggctatgcagctaacaggtagtagactgagatggataagcctgggtgctgccctgcctccctgttttggttacctgcctgggcctgacacccccattaggctgtgaactccttgaagtcaggaactgtgtgttactcatcgttcagtcacctcacagggtctggctttattatttttggttgaataaatgactacaatcttattagaacataacgtattcattttcttgcagatatactggaagcaggtcatgtcttccaaaacatagtgcatactgaataaaacctatggtgatattacataatgtcacctgtacacagaggtattgttctgttcctgaatgacaggcctaaagtaggggagaagggtggggagccaagtgaatgcagaggggcagaattgtactgcttacatttttgcttgttttattaagtattagacataaaaaatga

SEQ ID NO: 251458 - DNA, 761 bp, Homo sapiens
  misc_feature (578)..(578): n is a, c, g, or t
  misc_feature (678)..(678): n is a, c, g, or t
  misc_feature (733)..(734): n is a, c, g, or t
  misc_feature (758)..(758): n is a, c, g, or t
  misc_feature (761)..(761): n is a, c, g, or t
agggagagagagagaaagcgagcttcaacctaaaaaaaaaaaagtctcagccaaaggaagatacagagaagtcagttagggactatctaaaagcctccttcctaatagtgtcatctacttttgtgtgacacacatactttacataattgaccttaatcttcagcttttactttacagatgaagaaacgaggcggaaggcactaactaacttgatcaaggccacagctggttaagttgacagagacaggcctagaatgtcagatttgtctggcaccagtcctctttcctatccaccttcagattctttggaatttaaagcctactgcaaccacacataatcctatttcatttcccttccctcgacctttagactgtggtggactgaagggtttgaagtacactaggagtcaagagcagatccagaggaaattttcccgttgaggtggaagctacaagaaaactaactcagtgatgtttttcaacctttgggtcatggacccctttgagaaacatatagaaatggatcctagctcgtgccgaattcggcacgagattttcttaacaggtctttaaatggngcagttctgaaattctgtttggtcagttctagatggtacgtcatgtgaatgcaaccaagcactgtagttgaaattggtgtatgccagtactcatatgttngctaagtactacgcataatggtaatagctgagatgttaaagactttgaagtctannatattaattccttacacatgcgantcn

SEQ ID NO: 251459 - DNA, 618 bp, Homo sapiens
agggagagagagagaaagcgagcttcaacctaaaaaaaaaaaagtctcagccaaaggaagatacagagaagtcagttagggactatctaaaagcctccttcctaatagtgtcatctacttttgtgtgacacacatactttacataattgaccttaatcttcagcttttactttacagatgaagaaacgaggcggaaggcactaactaacttgatcaaggccacagctggttaagttgacagagacaggcctagaatgtcagatttgtctggcaccagtcctctttcctatccaccttcagattctttggaatttaaagcctactgcaaccacacataatcctatttcatttcccttccctcgacctttagactgtggtggactgaagggtttgaagtacactaggagtcaagagcagatccagaggaaattttcccgttgaggtggaagctacaagaaaactaactcagtgatgtttttcaacctttgggtcatggacccctttgagaaacatatagaaatggatcctagaaatatgcacatacggccgggcgcagtggctcacgcccgtaatcccagcactttgggaggccaaggtgggtggatcacgaggtcagga

SEQ ID NO: 251460 - DNA, 460 bp, Homo sapiens
agttcaagtatcattttctctaggaagactttcaagacccctcatcttcctgtggtgggaaggcttatcttattcattattttcttagtgtctagtgagtgcttggcacatagaacataccgaacatatgttgaagaattatttacttctatctgtagacttagaatacaaattgtattacgaacatatgagggtcttaagttaaaatttttgttgccaaaatattgatagattaatcttagcaagggaagatttttgctaggtaacactttggtctggattattttacttttgaaaatagcaactgggtgctgtggctcacacctgtaatcccagagctttgggagactgagatgggggcattatttgagtccaggaagttgaggctgcagtgagctatgatcgtgccattgtgtcccagcctgggcgacagagtgagaccctgtctcaaataaaaaaa

SEQ ID NO: 251461 - DNA, 422 bp, Homo sapiens
gactcacctcagtctcaaagataaaataaaataaaaataaataaataaaaattggaggtcttggtcctctgtgtagggactcagtctctgtattttcattcattcattcaacaaacaaatattgcccatcttctgtgtgccaaggactagactggcactggggacacagcaataaaggagagataatttcctctgagtctggtgaggcagatagacacataactaaataaatagagtatagcatattgggtgataactatagacatgttcacagaggagttcatgtttgaaccaaagccagaaggataggtaggagttcttagcagagggctcagtctatgtgaaagcacagaagcgtgaggtgtatggctagtttcagtaaaggcaaataatatgaggtggctgaagcataaggttcttag

SEQ ID NO: 251462 - DNA, 476 bp, Homo sapiens
gactcacctcagtctcaaagataaaataaaataaaaataaataaataaaaattggaggtcttggtcctctgtgtagggactcagtctctgtattttcattcattcattcaacaaacaaatattgcccatcttctgtgtgccaaggactagactggcactggggacacagcaataaaggagagataatttcctctgagtctggtgaggcagatagacacataactaaataaatagagtatagcatattgggtgataactatagacatgaaaatattgagaagatggggaaaggaatgaataacaccactcagaggaagaatcttcacagaggagttcatgtttgaaccaaagccagaaggataggtaggagttcttagcagagggctcagtctatgtgaaagcacagaagcgtgaggtgtatggctagtttcagtaaaggcaaataatatgaggtggctgaagcataaggttcttag

SEQ ID NO: 251463 - DNA, 310 bp, Homo sapiens
agaaggtccttggttccttggtagatgagtatgtgttctctttttctgtgtagcattgattaccaccttgtagaaacacaaatgctaattctggaagtgaattatagaatcatatagtccgcttatttatggagaaattaagaaagattaagtcactttctcaaggttaatccatcagctagatagtggtgaaagaaagaacagatcctggatcttgtgatacagaagtctcattgccacagaaatggagccatgtttttgaaaacagaacacatgaaatacgtgatttagaaagtctggtatgacttac

SEQ ID NO: 251464 - DNA, 1575 bp, Homo sapiens
aggaggctgaggcaggagaatcgcttgaacccgggaggcagagtttgcggtgagccgagatcccgccattcattgcactccagcctcggaaactagcaaaactccatcttaaaaaaaaagaggaggccgggtgcagtggctctgcacaacactttgggaggccgaggcaggtggatcacctgaggtcagaaatccgagaccagcctggccaacatggtggaaccccatctctactaaaaatgcaaaaagtagccgggcgtggtagcgggccccagtaatcccagctgaggtgggagaattgcttgaacccgggaggccaaggctgcagtgagccaagatcgcaccactgcactctagcgtgggtgacagatcaagaccttgtctcaaaaaacaagaagaagaaaaactactttttttttttcagatggggtctcactctcacccagtctggagtgcagtggcgccatctcagctcattgcagcctctgcctcctgggcttgagtgatcttcccacctcgacctcctgagtagctgaaccacaagtgcatgcctggccaatttttgtatttttggtagagatggagtttcaccatgttgcccaggctggtctcaaaactggcctcccaaagtgctgggattacagacacaactggcctacctgcaggattttcagtttatggacatgactgactggagacatggagaagctgttgttattggagatttttattactcgcatttcctgagcgatggggacactcactgtggggaaaagcaagagagatcagattgttactgtgtctgtgtagaaagaagtagacataggagactccattttgttctgtactaagaaaaattcttctgccttgggatcctgttgatctgtgaccttacccccaaccccgtgctctctgaaacatgtgctacgtccactcagggttaaatggattaagggcggtgcaagatgtgctttgttaaacagatgcttgaaggcagcacgctccttaagagtcatcaccactccctaatctcaagtacccagggacacagaaactgcggaaggccgcagggtcctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggaatgcctcttgcagttgagacaagaggaaggcatctgtctcctgcctgtccctgggcaatggaatgtctcagtataaaacccgattgtatgttccatctactgagatggggaaaaaccgccttagggctggaggtgggacccgcgggcagcaatactgctttgtaaagcattgagatgtttatgtgtatgcatatctaaagcacagcacttaatcctttacattgtctatgatgcaaagacctttgttcacgtgtttgtctgctgaccctctccccacaattgtcttgtgaccgtgacacatccccctctttgagaaacacccacaaatgatcaataaatactaagggaacgc

SEQ ID NO: 251465 - DNA, 1151 bp, Homo sapiens
aggaggctgaggcaggagaatcgcttgaacccgggaggcagagtttgcggtgagccgagatcccgccattcattgcactccagcctcggaaactagcaaaactccatcttaaaaaaaaagaggaggccgggtgcagtggctctgcacaacactttgggaggccgaggcaggtggatcacgctggtctcaaaactggcctcccaaagtgctgggattacagacacaactggcctacctgcaggattttcagtttatggacatgactgactggagacatggagaagctgttgttattggagatttttattactcgcatttcctgagcgatggggacactcactgtggggaaaagcaagagagatcagattgttactgtgtctgtgtagaaagaagtagacataggagactccattttgttctgtactaagaaaaattcttctgccttgggatcctgttgatctgtgaccttacccccaaccccgtgctctctgaaacatgtgctacgtccactcagggttaaatggattaagggcggtgcaagatgtgctttgttaaacagatgcttgaaggcagcacgctccttaagagtcatcaccactccctaatctcaagtacccagggacacagaaactgcggaaggccgcagggtcctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggaatgcctcttgcagttgagacaagaggaaggcatctgtctcctgcctgtccctgggcaatggaatgtctcagtataaaacccgattgtatgttccatctactgagatggggaaaaaccgccttagggctggaggtgggacccgcgggcagcaatactgctttgtaaagcattgagatgtttatgtgtatgcatatctaaagcacagcacttaatcctttacattgtctatgatgcaaagacctttgttcacgtgtttgtctgctgaccctctccccacaattgtcttgtgaccgtgacacatccccctctttgagaaacacccacaaatgatcaataaatactaagggaacgc

SEQ ID NO: 251466 - DNA, 1167 bp, Homo sapiens
tcaaaaagaaattagccgggagcggtggtggcgcgcgcctgaggtcccagctactcaggaggctgagacgggaggctctgcctcctgggcttgagtgatcttcccacctcgacctcctgagtagctgaaccacaagtgcatgcctggccaatttttgtatttttggtagagatggagtttcaccatgttgcccaggctggtctcaaaactggcctcccaaagtgctgggattacagacacaactggcctacctgcaggattttcagtttatggacatgactgactggagacatggagaagctgttgttattggagatttttattactcgcatttcctgagcgatggggacactcactgtggggaaaagcaagagagatcagattgttactgtgtctgtgtagaaagaagtagacataggagactccattttgttctgtactaagaaaaattcttctgccttgggatcctgttgatctgtgaccttacccccaaccccgtgctctctgaaacatgtgctacgtccactcagggttaaatggattaagggcggtgcaagatgtgctttgttaaacagatgcttgaaggcagcacgctccttaagagtcatcaccactccctaatctcaagtacccagggacacagaaactgcggaaggccgcagggtcctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggaatgcctcttgcagttgagacaagaggaaggcatctgtctcctgcctgtccctgggcaatggaatgtctcagtataaaacccgattgtatgttccatctactgagatggggaaaaaccgccttagggctggaggtgggacccgcgggcagcaatactgctttgtaaagcattgagatgtttatgtgtatgcatatctaaagcacagcacttaatcctttacattgtctatgatgcaaagacctttgttcacgtgtttgtctgctgaccctctccccacaattgtcttgtgaccgtgacacatccccctctttgagaaacacccacaaatgatcaataaatactaagggaacgc

SEQ ID NO: 251467 - DNA, 187 bp, Homo sapiens
tcaaaaagaaattagccgggagcggtggtggcgcgcgcctgaggtcccagctactcaggaggctgagacgggaggctcgcctgagctctggaggtggaggctgcagtgagctcagattgcaccaccgcacaacagcctgggcagcggagccagagtctgtcccaaaaaaataagaagttttatatta

SEQ ID NO: 251468 - DNA, 465 bp, Homo sapiens
ctctcacaacttgagctcaattttattccggagccatgacctgcagcacattggtgaccagaagacgcccaaagctttgaaaatggacttatcgacctcaaaccaatgggacatattcctacatggccttctcccctgttagggttcccagggtatgtctttaatgtctggtttaatagaagaagacttggttctcctttctgcttctatgtttaatttcttgtgacatcccacgtcaggtagctgggaaactccaattatacttgtgagagaatgaaagtggaaaagatgtgcctgagacaggtttgaccaggcaactgaaaagatatccctaagagaagacaaagcaaaggtatgaaaggaacacacgtccctgactgactaggaggaacagagctgcctgctgtctggaaccgcttcctcccagactaagagagaaataaacttctgttttctatatgctac

SEQ ID NO: 251469 - DNA, 513 bp, Homo sapiens
ccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggatccaactggaatattctcactagataaaaccattggcatggtacttatggcagaatctatttgggacttcatgagaagactggtgcatttacagctgttaaagtgatgaacgctcgtaagacccctttacctgaaataggaaggcgagtgagagtgaataaatatcaaaaatct

SEQ ID NO: 251470 - DNA, 279 bp, Homo sapiens
gctatcaaatgcatttcatattttctgtttgaaaaatatgatgtaaaataaattaataccaaggaaatattggtagttcacaaagtcatttgcaatagtctcccaagactgaatactttggggcaccaaattatggaaggctagataagtgcttctgcattttaataagtgaagctgatactacaactttttaaagtaatgatgtattttcatggctcctgtctctgtaaaagccaagtgttcaaagaaatgcattaaaaaattaatggatatacgaat

SEQ ID NO: 251471 - DNA, 441 bp, Homo sapiens
gcctctcccagccgcacatgggccagagcccctgctggcagaagacagggcctggggaaggtgaggctccctgacccgtccttgtccgaggccagaggcagccctgctcccacctgggcccagcctcacctcattcaagcctagggtggatggcacccaggtcaggacacctgggagggctgcccaagcccaggggctgctgagggccctggctccccagagcgagggccactccttcttcatctccctccacccagcccttctaccctggggctgagcccaagaaacacacttcatcttttattttttcttacaaaaggccttcatatcatcgtttgtcttacaaaaaccaaagtccttgtctctgagtttgaaaaacatcttcccagaataaatgggaaaggatctcttataaatatatatatattttaaaaaagcaaa

SEQ ID NO: 251472 - DNA, 579 bp, Homo sapiens
agaccctcaagtctgcagatatcttgatgcatgtaacatttctaagacactgagctacatgctgaagaatgtacaggatgtccccatcaggcttttcagcggagttgtgagaggtgaagtatgagtacatggaaaggtggacagtaactgcagtcgatggcacggcatggtgtgctgccagatgaatggttcagaccctaagtgctggccggtggaagagaagagacttcgacttttggaagattgaataaaaactacttgaagacaacaagaaagcattctagacaaggagaatggagggaatagagtttagaaagcacaagtcatatgtagcgtgtctggatttttctgtttatgtcatttctactagtataaacaaatattgccttttttgttgttgttgttttgactgttactttgttcaggttgtttctgctcagaactctttttttatttgggttcttaagattttccacttaatccaaattctactttcagatctattaaacccttaagattttgtctgtgacctagtggagtattggtgtgtcttgcattataataaacatagttgtagaa

SEQ ID NO: 251473 - DNA, 453 bp, Homo sapiens
gcgcgaattcatcatcctgcttcagccatgtaaggcgtgtcacctccctcttcacctcctgccatgattgtaaatttcttgaggcttcctcagccatgcttcttgttcagcctgcagaatcgtgatccaattaaaccacttttctttataaaattacccagtctcaggtagttcttcatagcagtgcaagaacagactaatacagaaaattggtactgggaagtagagcattgctatgaagatacctgaaaatgtggaagcagctttggaagtgggtaatgggcagaggttggaacagtttggagagcttagaagaagacaggaaggcctgggcccagtggctcatgcctgtaatcccagcactttgggagtctgaggtgggcagatctcaaggtcaggagattgagaccatgctggctaacacggtgaaaccccatctctactaaaaataca

SEQ ID NO: 251474 - DNA, 220 bp, Homo sapiens
gttatacaattcagtgggtcaaattttacttactcatataagattttgcattcataatacttagagtcttgtcttttctgcaatgacaaaaaatatgtgggtaacctgttaataccagttctttggttgcatgtcaggatcatcttgtatagcttttagaaatgcaggctgggggtggtggctcacgcctgtaatgcccgcacagagtgggactctgtca

SEQ ID NO: 251475 - DNA, 667 bp, Homo sapiens
ggggcacttgtgaatttcaaagaataatgacaataaccaaaagaagctacatttgtggcattggctaaatgttttataaattttatctcttaaaattcaaaccaaaaaaccccctgtattcacacctgtaatcccagcactttgggaggtcaaggcgggaggattgcttgagcccaggagttagtgaccagcctgggcaacatagtgagaaccccatctctacaaaaaaatttaaaaattagtcgggtgcggtggtgcatgcctgtagtcccagctgcctgggaggctgagtgggaggatcgcttaggcctgggagtttgaggctacagtgagctgtgattgcgccactgcactctagcgtgggtgacagagaaagaccctatcttaagaaaaaaaaaagaaaagaaaaagaaaaaacaaacaaaaaaaacacccaaccctatataggtattattattacttctataggacacatagaggtttggaaagattaaatcacttgaccaaggtcacaaaataagttctgaggctgggatctgggattcagtcttattatatgcccttcctctaccactccctaaaacttctcattccctcaatccccatatatcatcttaaaatctgcaataaatagccccatacattcgttggcacttaggaaactgtt

SEQ ID NO: 251476 - DNA, 286 bp, Homo sapiens
tttatacacactttccctttggccgtccatgtgctctggaggaagaagggagttgctgcaatacaggtccacacccttacgtcagtttataggagcggccctcacatatgtgaataataacaatagtggcaccattgattgatgacctgtgctggactgattacataggttaagtcacatcttcacacaacccttcagggtcgcttcctttttatagatggggatgagggttgcaaagattatttaggtatcacatccacatcacagagccaataagtggtgaagc

SEQ ID NO: 251477 - DNA, 741 bp, Homo sapiens
gtcaaaacctgtgaaaagctaattagcagtattaagcaacacaaacattagtgccaaatgcatgataaaggctaaagaaggccagagcatatattactgtagagtagaatagtaagggaagactttgtcctttagtaaagagataggaggtggcctggcccttgaaatagtagtgtttaggtagatgcttgtgtaggattcctgataagagcaactgaaaagaaggagaggggaagtagtaaagggacaagaaacaattttttttttgaggaaccataagcaaattatagtttgacaagacaagattgggggacatatatggttaccagggaattacctcttatgtgttatatctttatattatttatctctggaaaagagtaccctgcaaaattccctacagctgcaagcagatgtcacttgatggacagagggggaattctgcccctccggtatcgggaaatacatactaaagacattgcgaaacgctgaacctcttcccataaataaaaggtttgtttgtaaaatgggaaatccacccataataaatgaacaataggcactgccagtttaggcctgttcatgaatggatctgcaagacagcatcttcgtttaacaacattatctgtgatttgatacatttatccttattacaatattgtttagttggtagaaattctatgttttctacaaggaaattgatgtttattaaataaaactgaaaataattaaaaaaaaaaa

SEQ ID NO: 251478 - DNA, 688 bp, Homo sapiens
gtcaaaacctgtgaaaagctaattagcagtattaagcaacacaaacattagtgccaaatgcatgataaaggctaaagaaggccagagcatatattactgtagagtagaatagtaagggaagactttgtcctttagtaaagagataggaggtggcctggcccttgaaatagtagtgtttaggtagatgcttgtgtaggattcctgataagagcaactgaaaagaaggagaggggaagtagtaaagggacaagaaacaattttttttttgaggaaccataagcaaattatagtttgacaagacaagattgggggacatatatggttaccagggaattacctcttatgtgttatatctttatattatttatctctggaaaagagtaccctgcaaaattccctacagctgcaagcagatgtcacttgatggacagagggggaattctgcccctccggtatcgggaaatacatactaaagacattgcgaaacgctgaacctcttcccataaataaaaggtttgtttgcctgttcatgaatggatctgcaagacagcatcttcgtttaacaacattatctgtgatttgatacatttatccttattacaatattgtttagttggtagaaattctatgttttctacaaggaaattgatgtttattaaataaaactgaaaataattaaaaaaaaaaa

SEQ ID NO: 251479 - DNA, 387 bp, Homo sapiens
ttcttaattccaaaatttttggaaaaattgaagaacctttaaagccacagtaacattgattccaggagctgcttggtttttccaacagataatttgaccttaataactgttaattttggtatactgatttttcaaaagcacttaactgctaagagaagaagaaaaagttgctttgcctgtacatgacacttatatttttaacttgcctagaggtaataaggatgattgaaaatctatttagattctttattgctatacaaaaattttaagtattttctaatatttctctttggtacagaatcagagtagcaactaaatttaatgtctaatgttagttataatgtaacattggaagcaaagtagcctatttggtcagtttagtttctt

SEQ ID NO: 251480 - DNA, 455 bp, Homo sapiens
cagctgcgcagtctgccacaaggcccctggggctgccaaggtcgcacatgtcctcccaggacttgaagggggaccaggggagggtgagctgttgctgtggactgtggactttgacatcactcatagacaccccctctctcacccttgcatcccagacagtgtcccccagggccatgcaggcagggacacacagcccccttgtgccctgccccaagtccctgtgtgtaagtgagcatgctctcatcagacttggtccccactgccatggcactcttatctgtgtgcctgaatatgcatgcttattcatctcgaaaactgggccgtagggccaggtgtggtggctcatacctgtaattctagcactttgggaggccgatgtgggaggatcatttgagcccaggagttcgagcctgggccacgtagcaagacccccatctctataaaataaaatttaa

SEQ ID NO: 251481 - DNA, 864 bp, Homo sapiens
gacctcctgggagctgtttcccagcagtcagggagagctggcctcagagggagaaggatggggcctcgtgacaccgttaagtctgtttctgtagatgtgtggttggggtcaatatatccctgtagcctcccttaagccagtttcagttgggtttgtttcttaccacctggaatccaagctgaaaataaattttcactcctgttaccaggagtggggtgctgtgagagatgctaacgtgtagacttggctggaggtgagggcaggactgaagccccccatgcctcagtaagaagctgcatcagcctggccaacatggtgaagccctgtctctaataaaaatacaaaaagattagctgggcatggtggtgcatgcctgtaatcccagctactcaggaggctgaggtgggaggatcacttgaacccgggaggtggtggctggagccaagatggtgccactgcactccagcctgggcgacagagcaagactccgactgattaaaaaaaaaagccgcagcctctgttacgtggtacaagctgtggccaaactgttggtcactgtatcttcacgtggagctgctatgagaacttgcacctgtgtaaagccacgggaccgttgtcacgaacaaaaaaggagcacggctgacctgtgcgcctttcccagcaatgagtcagggagcaggtttcccttctccactcccttcccccatctgcccacttgatccgggatccttgaggccctggggagcaacagagccctaagagcttcaaaggggcctgggtccaggaataacttggtgaagagctgcctgccactctgaacatccacatgtgacaataaacatctcctgtgttaggacattgaga

SEQ ID NO: 251482 - DNA, 316 bp, Homo sapiens
ttcctccatcccctcacccacgtaccagtgaacaaaggcacgcttggcatacatcaggtcaaacttgtggtccaggcgagcccaggcctcagcaatggctgtggtgttgctcagcatgcacacagctctctgtacctcggcaaggttttcccaagtaagaactgtgggaaggtggtactggatgccaactgaaaagccactggggcactaatgcacatactgattgcagcgattggtgtgtgtaactgggtgtcaacaggcgagcattaatcatcgtttagggaacaacgtccccaccggtgcatgcaaggcggga

SEQ ID NO: 251483 - DNA, 455 bp, Homo sapiens
tacaacaacaaaagcaaaaataatagtgggattaataaaaaagaaagaaaattacctcaaaatggattaaagacctaaatgtaagaacttaaactataaaactcttagaagaaaacataggggaaaagcttcatgacattggatttgacaatgatttcttggatataacaacaaaggcacgcttggcatacatcaggtcaaacttgtggtccaggcgagcccaggcctcagcaatggctgtggtgttgctcagcatgcacacagctctctgtacctcggcaaggttttcccaagtaagaactgtgggaaggtggtactggatgccaactgaaaagccactggggcactaatgcacatactgattgcagcgattggtgtgtgtaactgggtgtcaacaggcgagcattaatcatcgtttagggaacaacgtccccaccggtgcatgcaaggcggga

SEQ ID NO: 251484 - DNA, 262 bp, Homo sapiens
caacacccacatatctttaatggtcttccagacattgctttcttaagatgtttacattctttatcagattatcttttactcctggcgccaaccactttagcatgttttcagttattagagtcttaggatagtattttctttgagattcaaacaaaaaagtattctacatagtacttgtaatctctttcacaattgtaattgcctttcacaaagccgacattgtctgattttttgattctgctgtttatatcttggtagtgtt

SEQ ID NO: 251485 - DNA, 352 bp, Homo sapiens
cacaaatttagttccattaaacaaaatgcagcaactcttctcctatagcgcaaactcctttaggtcctattttgaaactgagaagctaattccagtgttctcttgttagctctcggtccatgtcaaccaccccacaaggttgtttacttgaatagtttgcagccttgctttaaaagttctagtaggcaaataggtttgttgatgatgaagtggtttgtgttttataagagtccttatggtctagatggcatttgaacttgtggttccagtgattaccaggaccctgaattgaagaatacatgctgtggccttttcagctcaggaaactttttactttctattgccaaaaaaa

SEQ ID NO: 251486 - DNA, 482 bp, Homo sapiens
gcatcaggaagaataactaatggatgctgggcttaatatctaggtgatgggatgatctgtgcagcaaaccaccacagcacacatttacctatgtaacaaacctgcacatcctgcacgtgtaccccagaacttaaaagttgaagaacaaaagatttttgtaaaaaaagcaacttcattttgttgatcctttgtatttttttaagtctattttgtttaattctgctttgatctttataatgtctttccttctacttattttgtgtttgttttgttcttgcattttttagttccttaaggttcattgttaggttgtttatttgaagtctttctctttttttttttttttttttttgatgtaggcatttactgctatatatttccctgttagcactgcttttgctgtgttccataggttgtggtacattgtgttttcatttctgtgtgttgcaataaatttcttaatttccttcttaatttctgca

SEQ ID NO: 251487 - DNA, 576 bp, Homo sapiens
acccgaaccccacattctgttagcaccagggccctgtggatctgtccggggcactgtactgacctgtcccccaggcctaggggtcttcctgacacctgaggctccgtttggatttctcctgccgggcccttgacatctcagatggtagagagccctggcggagctcggggagcaggactagctcacactggaggactgagtgtgctctggtgatggaactctgcagctggtcagggtgggggccgcctgcccagccagcgctgacccctcaacacacctgctcctccacgttccagcctgcaggcttttgcgcacgcagctcactctgctgtgggtgtagtggactcttgaatttcactcccaaccacccgcttccatgcttccctcgggaagtgacccctcttccaccctttgcccaggtaaaagccacgtatcggcctagattccgacctctccctcctccctacagcatgtcttgccagctcaccccgcagagctcagcccttcctctccacggacaccacctaagacaccatcatctgctttagccactccctaaccacactgaaccccaac

SEQ ID NO: 251488 - DNA, 1170 bp, Homo sapiens
attgggctgcacatagagacttaattttagatttagacaaaatggaaattatttcatcaaaactattcattttattgactttagccacttcaagcttgttaacatcaaacattttttgtgcagatgaattagtgatgtccaatcttcacagcaaagaaaattatgacaaatattctgagcctagaggatacccaaaaggggaaagaagcctcaattttgaggaattaaaagattggggaccaaaaaatgttattaagatgagtacacctgcagtcaataaaatgccacactccttcgccaacttgccattgagatttgggaggaacgttcaagaagaaagaagtgctggagcaacagccaacctgcctctgagatctggaagaaatatggaggtgagcctcgtgagacgtgttcctaacctgccccaaaggtttgggagaacaacaacagccaaaagtgtctgcaggatgctgagtgatttgtgtcaaggatccatgcattcaccatgtgccaatgacttattttactccatgacctgccagcaccaagaaatccagaatcccgatcaaaaacagtcaaggagactgctattcaagaaaatagatgatgcagaattgaaacaagaaaaataagaaacctggagcctgtccctaaagctgtggcctgtaatctacaaatggctctatagcgaagaccacacggaagagtagctacatacacttcatcagctatggatcatcaacggcaatttttccttgtcagtacagctataatagtatcttgaaagttgtaaaaaaattaaagcatatttgttacgtaaagttaaaatgatttttgtctgaataaaaaaaaagcattgcaaatgctttagaaatctctgataatggagagagagacagaggaccctcctcactaccctatataaaaatcattggcacagttacacttaataaaaaaaattaaacagaagagcaccctgaaaaacattatgatggaaattaaatagtatgccagaataacatggttgacaaataagtgaacaaggattaaaaatcacttacaaacgtgtttctgtacaccctttctatcgtgtcaaatgttaatgaatctgtgatcaattgaaatgtaaatgtctgtgtaaaactacaaaataaaaactcttagacttta

SEQ ID NO: 251489 - DNA, 483 bp, Homo sapiens
gaagtaattatatcttgtagtagcaatttcatatctctacttatacctgggtcatttgacttttgaggacctcaggaaaatgagggagcttaaaaaattctatggttcctaatgaaatacttagggatgaaattacagttctgggatttgcttgaagacacaatcagccatggtttgtcactgttgatgctgagtaatggatatttggtgttctattgtgagtctttggtacatgtttggaattttccatgaaaaaaccttctgcttctaaaatgcacaccttgattcttcccatcgccctcctactggctggtcctgtgcagctcactcatttctcaggaacagcagcagactcactactctgaaggaaagaaagccctttgctttggtctgttcctaatgtacatattattagagacttttccgacaccctccccattttttatttcttaacagctaatacgatagctgtgctttcataat

SEQ ID NO: 251490 - DNA, 671 bp, Homo sapiens
ccagccccaggcgcactgggcacggattccctcaagaacctgaccttgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgaggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagaggcgctgtgtcgacgagacgcgccaggccgcagagctgtgcgtggagcgatccgcctcgtcctcactcctccgccggagccgggccgagcggggagacgggggctgcgggggtagacgggggctgcggggggcgacactaaaagcctgttgttcccatctgcg

SEQ ID NO: 251491 - DNA, 418 bp, Homo sapiens
cagtatggaaaaaaaggctaacaaaagttgtaataatataaaaaatggatttgacattttttgatgaaaatgatcttcctagtggatattcattgacacaaaaaatgaaaataccttttatggtagtaatgtcaacaaactatatgaaacacccttgccccaagtctctccctactcattctttgagacccagctcaaacataaacattccgagttgaggctgttggatatttcctgttctgaacattcacagcacatggctcatattcaattatagtacttaaaacattgtattgtaacttacttgcttacagtttgattttcctacactactaagagttctgtaacagtagctgtgcctgacacacagtagacaataaatgactgttgaatgaataaaaggcttttttaaagaaac

SEQ ID NO: 251492 - DNA, 1004 bp, Homo sapiens
  misc_feature (221)..(221): n is a, c, g, or t
  misc_feature (436)..(436): n is a, c, g, or t
tgacaccatgacccactgttgctccccttgctgtcagcctacctgctgcaggaccacctgctgcaggaccacctgctggaagcccaccactgtgaccacctgcagcagcacaccctgctgccagcccgcctgctgtgtgtccagctgctgccagccttgctgccgcccaacttgctgtcaaaacacctgctgtaggaccacctgctgccagcccacctgtntgaccagctgctgccagccttcctgctgcagcacaccctgctgccagcccacctgctgtgggtccagctgctgtggccaaaccagctgtgggtccagctgtggccagagcagctcctgtgcacctgtgtactgcagaagaacctgctactaccccacgactgtctgcctgcctggttgcctaaaccagagctgtggctccaactgctgccagccntgctgccgcccagcctgctgtgagaccacctgctgcaggaccacttgcttccagcccacctgtgtgtccagctgctgccagccttcttgctgctgatcacgttccaagagaaccaccatcctcacacaacaaatttctgctcaactgactcatcttttgggggactaatttaatttgctgctgacagccaccatgctctcacccaaatttttatgaattctctacatgtttaaaatcttggaaatctgcttgagggagggcagaatacttcatcctgattctctttttccttacaccttgtggatcatgtgccagcttcatctgttctcaagtttgagtcatggtctcagctttgactctaaagtcaagagcttcattccctgcttctaaggaatttaggtttctgcaactgatcgatgatctttgcaatcttttttttgttttcaatatcctcctcatcgttcttgtatccttctttcttcttttcatgataaatttgtgttgtgtccctggtagcagaaatccttacctatatgtttctgaataaattctgaaccatcctcatctc

SEQ ID NO: 251493 - DNA, 940 bp, Homo sapiens
  misc_feature (221)..(221): n is a, c, g, or t
tgacaccatgacccactgttgctccccttgctgtcagcctacctgctgcaggaccacctgctgcaggaccacctgctggaagcccaccactgtgaccacctgcagcagcacaccctgctgccagcccgcctgctgtgtgtccagctgctgccagccttgctgccgcccaacttgctgtcaaaacacctgctgtaggaccacctgctgccagcccacctgtntgaccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatctgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacctatatatttcttaataaataaatttggaactattattcat

SEQ ID NO: 251494 - DNA, 500 bp, Homo sapiens
cgatttcactgaatctttgccaacactgagtattagccttaaaaaaataaatccttgccaatgggatagatggggaaaaaaaaatctcattgttattatatatcttagctgtagctcatttggtcacttctccaatgcctgttgattatgtgtttctttgagtaactgttaatatcttttatctcttttttttttgccatatttctgtcttggtgttatcatttattgtttgtttgcttttaatatactttttcatacatagattcaaactatcttgagacccaggtgtcaggaaaaaatggttttattctcagtaaattcaaatttgggtcttaaagcttctttatagtttttataatttaaaaaaatttactttggaaaattgcatacatttacaaaattggaagtaatagtgtaatgacccccccccccctttattgacaattattaatttgtagtcagtcctttcatctgtaagctcccttacctcctcctcaggc

SEQ ID NO: 251495 - DNA, 358 bp, Homo sapiens
tgggtcccctgggggccacccatcaagggcacatgctacaggcaccccaaggcagagtggcctggcctgcccggggctgacccttagggtgaggagaggacactaactgggcaagagagactagtctatcagtgcaaaaaactcccaatagggataggaactaggaaggaaataccaagaaaagtgatgatggaagatgggggtaaccatactgcagatggggtactcagggagggcattttaacatgcttcccaatggacagaaatcattttttaaaaatcctgcacatagctcaggctcaccagacagactaactcctagtacttggaaatgaattaaaatctggcagtgagttaa

SEQ ID NO: 251496 - DNA, 303 bp, Homo sapiens
tccatctcaaaaaaaaaaaaatcacatgtatcaagatcaaatttcgcaactagcttagtacaaggaggtatgcccttatttcaaggagtgagttaattaggaagtaaaataagaaaaactattttcctgaggcaggggaaggggaggactctctattcaggtgccagtcttttcccattcacccgtgaataaaggtcatgttcgtgtaatggaacccacactattttttcctgaacctttagatttctttgggaagaaataaaatactgcctattttatagaaataaaattcttcattctaaa

SEQ ID NO: 251497 - DNA, 423 bp, Homo sapiens
ggaagtcttgaatatagttactgaaataatcatgaatgtcttcttggggcccaaatgccaggatggggctgaactctcaatgattgccttgacttcagcagtgggctgcagcccaacagaggagagtgtctagcaagtattactctctgaccctttaaaatttttcctgaatctatatgggctattggcactagtaactatacatttgcttctggtaaacatggtccaaacacctccaacagaagtctgtcttctcttactgtttttcaaagtctgcaagcgatagcttgccatcattgtcataatcttaggaagatgtttcttggtaaatactagttttaaattttgcatggcaaatagctctctagactaaaaaaattttaccaaataaaagttcacacttctgtagacaccctacataca

SEQ ID NO: 251498 - DNA, 372 bp, Homo sapiens
gttgaaatgtcttttgttatttttaatgactttttgatcacatctcagtttataccaatgagatggcttagggtggagaccctagacagcctcaagatgaagctggtcaccagaaagattagagagttggaactttcagtcctacccaccaacctctgtgaagtggaaagggtgggatggcttgacatgaagctctataaaaactcttggacaacaagattttagctttccagattgctgaacacattcagtgttcctggagagggcatggaagctccacacctcttctcacataccttgccctgtgtatcttttctgactgtttgtttgtatcctttgtgatatcttttattataaaacagtaaacataag

SEQ ID NO: 251499 - DNA, 368 bp, Homo sapiens
attaattaagaaactggctctcagcagacactgagtgtgcctgtgccttgatcatgaacttcctagcctccaggactgtgagaaataaatgtttgttgtttataagccacccagtttatggaatttttaaatagcaacccagaaggactgagactgtaactagactgaaactgaatgcagaggagagtaaggttctctgcccccaaggtatgtgccattttgtgagggcacagacacttataagacattgagggagcctaagagaaagagtagctccagctcggcctaaggaggaagaggcaggacggctctgccaggtgatggtatctgtactgctcttgaagatgggagggtttggacagatgaat

SEQ ID NO: 251500 - DNA, 570 bp, Homo sapiens
ggatgatcttgttttaaagcaattttaaatatttaaattgcattgtattttaatttttctgctgtatgcaaaattgtcatatgaataaaaaacttttaaacccttaaaaaaaaaaaaaaaaaaaaaaaaaaaaaaaaaaaaaaaaaaaaaaaaaaaaaaaaaaaaaaataaataaccaggcacaatgtttaacttaaccaaactttgaaaaaccctcctatctccagccttggtcacctgtaagagaccccccctttaaacctttatactctatcacttaagccttgtgccgaatggcatatcttaaccctgcttatccggaataacaaatgcttaaatcttagactaaactttgaactgaaaatagccctgaggcattagtgaaaataccctatttaaaatcaattttcaggactcacgaggtcccctttttgaatccatgtatttcccgattcaaatttcacatttcctaaatttggatctagaggccagtataaaggaacgcgacctcaaacaccaatgtgtcacaatcggacttaaagtccattgtactttggtgccatatccttt

SEQ ID NO: 251501 - DNA, 439 bp, Homo sapiens
gtcagtatgtcctacaggcatatgggaaaggtggctttttagttttttagttagtactacattttatagtacaaaatttattcaagttactgagccaaatcacaatctaacaaataaatgccaaaaatgtatcagttcaccaaaaatcctggtcaccactcaatttcatcacataggaggatcaaatagaattaggtgctttctactcacttttgataaacttcagcaaacgtgacaggctagtagaagactgccctttactgctgtattgctgagataaatattctcagaaaagtcttgttagccaatctgatcttaattttctgtttccaaaatggggattatgtttatcagggccaaagtgtggaataggctacatttatctcaagatcacataaacaccatgcacccatatgcaacatgtacacacatacacaca

SEQ ID NO: 251502 - DNA, 394 bp, Homo sapiens
tccaggctctgggaggacagaatcctgacctcaacagtggccggcacggacacagcgggtcccatcccggggacgctgaccagcgctgggcaacttttcccttccccgacgactgagccccgagcacccaccctgctccccctaccacctccctttacaaggctgtggcctctgcacagatgaaggtgagtccaggtcatgccggactctttcttctgttgcaatagttatttctgttgagaatccgtccttgctacatgacctagtgcccagggggatgctgagacaggatgaatgtattctgcatgtgagaagaacatgaattttgggggccagagtctggactgtgatgggttaaatcgtggcccctacaaattcatatattcaagtctta

SEQ ID NO: 251503 - DNA, 310 bp, Homo sapiens
cgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcaggccgtaaaggagaaagaccatgcctttcattttcttccgggtaccg

SEQ ID NO: 251504 - DNA, 1427 bp, Homo sapiens
  misc_feature (156)..(156): n is a, c, g, or t
  misc_feature (176)..(177): n is a, c, g, or t
  misc_feature (255)..(255): n is a, c, g, or t
ggtcttattacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggncagggtagatcacaggctgnnggacagagcaaagacccctgaggccggacacctggggtcctgccgggcccctccccacgagagttccctgtgtctgtnccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgtagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggcttgcctgcagggcagctcagcatggccccagcacaactccgtagggagcctggagtattcttccatttctcagccaaa

SEQ ID NO: 251505 - DNA, 475 bp, Homo sapiens
ctcggggttgcttgtgttccacagaatggtggcttatggacgcttttaagacactaaagaaccccacatgttagcatgctggttgcggctggctcacgcctgtcttcccttgtctcccacaagctgaggcgggcggatcacaaagtcaggagttcgagaccagcctggccaacatggccaaaccccgtctctactaaaaatacaaaaattagccaggcatggtggcatgcacctgtaatcccagctactcgggaggctcaggcaggagaaccacttgaacttgggagacagaggtgcagtgagccaagatcgcaccattgtactccagcctgggcaatggagtgagactccgctcccacaaaaaaccacaaaaaagaaagaaagagaaggaaggaaggaaggaaggaaggaaggaaggaaagaaggaaggaaggaaggaaggaaggaaggaaggaaggaaggaaggaaggaagga

SEQ ID NO: 251506 - DNA, 293 bp, Homo sapiens
cgtgcagagaggagctgcgccttcctcacaattaattgaaacatgaccaaaaaacgggggataggcaaaaaagtgacatttaaatagcgtatgagggcactgggaggggcctgcctgccatccagctctcgagaccacggcgagattcagaagggaattgggccattccttctccaaagcagaacgtactgcagctgtgagagttctaggagaaaattgcagatgaactttcaaatcagcttctcaagtgtcaacatcctgttgcgattttcattgatattgaactgaattta

SEQ ID NO: 251507 - DNA, 358 bp, Homo sapiens
gtcaggaaacttgacttctactcttgcctctcttttgcagttagctgtgtaactttggataaggcattttatctcgtggtgcctccatttttctcattctctagggaacaagagaattagtttaggtagcgtctaaaattccgcccagctctcatttggttctcatttgaccattttataatcattattttggtctcatttttattcttcttattcatcccatgaactagatcaacttgtattattttactagatcaacctgtattattaacgtcatttacatgtaaattgatgggattcagatattttatcaactgtttttccattagtgattttaagtaattttaaagaaggaaaa

SEQ ID NO: 251508 - DNA, 479 bp, Homo sapiens
tcttcttggctaatattaaaacccaaattcttcagcttctccgctttagtgtatgtactgaaaataaagatcaaatgcttgccatttcttacaggtgtggtatgactttcaagcaaccctcagggcatgtatagttgcactgagatgtggccaggtgccctatatgaagcatccagtctaaagagtcagcctggccaagtgcagtggctcatgcctgtaatccaagcactttgggaggccaaggcaggtagatcacttgagccaggagttcaagaccagcctgggcaagatggtgaaaccctgtctctacataaaatacaaaaaattagttgggcatggtggcacgtgcctatagtcccagctactttggaggctgaggtgggagaatcacctgagcccgggaagtcaaggcagcagagagccaagattgcttccgcatttgcactccagcctgagtgatagagtgagaccctgtctta

SEQ ID NO: 251509 - DNA, 443 bp, Homo sapiens
agatggggtctcactatgttgcccagcctggtcttgaactctgggctcaagtgatcctcccacctcagccttccgagtagccaggattacaggcacacaccaccatgcccagctccatttccattgttcttcatgcttccttattgagttccttccctgtcccgattattcgtctttgattgggctttgactacctgggcatttagtagggtccataactgaatgcagcattccagccggggtctaagcaacagaatagagcaggaccatcatctccgcaatttccaatatcatactttcatcaatgtcttccgaaacaacattcacttttttatgttcatgttaaactaaaagacagggctgaaggcagcatcctggaacagtggaaacattcctataagttgacttgaatcctttaaataaagtccatgtaccaaccagag

SEQ ID NO: 251510 - DNA, 550 bp, Homo sapiens
gtagggaagtaagactggatggtgggttagcaggggactcgagaaaaggcagtcagtgctacaggcgcagggatattaacctcaggagtgaccagtgggatgcaaccagccgttggggcttaaaactcaagcacatttctcggatgataatttcaaagaagtagctagttttggttgaggctgcctctggactatccccagcttctcagtggaactcggtgtttctgaatgaatcacaataaagaagcattacttgtgggatgtggccaacctttctgttcagcttttattgcagagctgatggcagcagctggactttacaaaggtgatggtggctcaaagcctttctgttccactgtgtctcataaagcttttatgaagcctcagtcatctcttcagcagatcctgtgtcatgaagaaggatgcagagaacacaaggagcaccccatccatggtgcatcccaggtttctaaaccttccagggaggggaaatcagcatttttggctctggccaagaagccaaattgctgaagctatgggacttgttcca

SEQ ID NO: 251511 - DNA, 464 bp, Homo sapiens
gcacctagatcactttgaggcactaattcctttccacgtctattcctttgctctctactataagtcccttaaggacaagctttatgtctctcattttttgttttgtccatggctggcggtatctgacatggagtaagaatttaataaatgtatgttcaataaatatatttgtctcatcccacaactaggcaaaagggcagatattgtatcacatgtatttttgtgtccccctgagtggttggcatcaagagggacagagttagtagtggataaagatttcaagttcttaaacagatgaaagcaccccgaagttttggctcaagctatacttggtctttgaacctttgttgaaaagatacaacggaaagatggggaacagccaaggttagagagagatttacacaataaagagagtcagatttttcagggtgttttttgggatttttcagtagatcaaagttgga

SEQ ID NO: 251512 - DNA, 502 bp, Homo sapiens
cggaccccagccagtgcagcatgggctagctttgacttttctttcagacatgagcacctttggaaaagcctggacacctgaggttccaggcagagggctccccattaggctatctggcttcctttagttatttagaggaagtgctgacttcagggaccctggaagtgccacactcctcagctaggacaggacaggaacaattctgcatctctctgtgacctgcagaggtgccgtaggcttggctctaagttcaggacgtctgggctggagctaaagtggaagcaaagattcttaattccttctgactaacaagttgctatgtaatgcccaaccttgtttttactaaccctgtctttagactctccctttcctttaatcacctagccttgtttccacctgaattggctctcccttagctaagagagccagacagactccatcttggctctttcactggcagccccttcttcaaggacttaacttgtgcaagctgactcccagc

SEQ ID NO: 251513 - DNA, 275 bp, Homo sapiens
tgttgaaactgaactaccttaaactggtagttttcatggtgtcaaacagatgttaagggggcaacttggcacaaagtttggtaacaatggtttaaatgataaagctagtgtcacaaatgtgtctagtagaggaggatcatgtaattaattaacaggtaacaatttgctaattgtttaaaattatatctgtaatatgattttagaatccaataccaaaagtattttcaggtaaattaaaagaattttaatttttaaagtagaaacagaaaaaaata

SEQ ID NO: 251514 - DNA, 256 bp, Homo sapiens
gagagagaaagaatagaaaagaaagaaagaaaaaggaactgtccagccctggagactagagctattttgatcgcacaagaacataatcagagtcaggaacacagtggaggaaatattcccaaaggaaatcaagattaagatgcacacttcggcctcttcctacaagcaccaacctcccaagcccacaggtcattttgtttgacaatgtcacatcgatttacatttcacaatgcacttttaactttagaatgttaat

SEQ ID NO: 251515 - DNA, 473 bp, Homo sapiens
atgtatggtgtgagaaaggatccaatttcattctgctgcgtatagatatccttttctcaacaccgcttattgaagaagctgtcctttccccattgtgtgttcttggcacctttatcaaatattatttgactataatataaatgtgtgggtttatttctggatttctaatgctattcccttggtcaacgtgtttgtttttatgccaggaccatgattttttattacaatagctttttaatatattttgaaatcagtaagtgtgatgcctctggctttgttctttttgttcaagattgtttcagttatttgaggtcttttatggctccatataaatttaataatttgttttctattcctgtaaaaaatgacattggaattttggtaagaattgcattgaatctacaaattgcttcaggttgtatggacattttaaaaatattaaatgtttcaatccatgaacataacctatcttt

SEQ ID NO: 251516 - DNA, 129 bp, Homo sapiens
acttactttaccattcagaagtaggaaatccatcccaggtctgagttatataaaaacagagtgaactctgaatttctccataacgcacaccacagttattattaaatgatgattctctcattatttaaa

SEQ ID NO: 251517 - DNA, 488 bp, Homo sapiens
aagtgaagtcctctctcctccctccagctttcagggcacggagcgctcttcctggcattagaattctgagcaaccctcctagcaggcccagctcaagccgcagcggggaggaagagttcaaaggaagctgtgccaaagatctcgaaggcttagtgggagacccagcaacaggtggcaccaggtctgggaaagattcctagaaagcggagcgggtctcggagggggaggatttagccccaggcgcccgcgatcagcgaacgagcgcctgcgcggaggggccgggctgcagccccggggcaaggggagcgcgagctctgactcctcagcgcggccgggccgctccgagacccctcgaaggaggccgggcgccgtggggcaacccaggcagggcggggaccacagcctcccgggctcgtggggtgcagctctgaacctgaggcgctcggaagctcaaggccaagacccgctcgggtggcggccgagcgccc

SEQ ID NO: 251518 - DNA, 374 bp, Homo sapiens
aagatgaatttagctgtcgttattgtcaaatgtcaaaacttgcagaaacataaatcaatactgatttcctaactggacatcattttttgaggaggccaacttatcatttaatggttagttcattacatcagatactttataccctgaaaaagcagtgcagttgacctatgaagaatgtgggggttaggggtattgaagctcctacttagttaaaaatccacatacatcttttgattccccaaaaatgtaaccactaatagcttactgttgactggaagccttaactgattacatgaacattgattaacatatattgtgtatgttatatgtattatatactgtattcttacaataaagtaaactagagaaaagaa

SEQ ID NO: 251519 - DNA, 643 bp, Homo sapiens
aacagattaaaaaaatgagtgagaagagtggcactgttggatatgttttggaaatctccttaatgtttggcttgatgggagacagctggattctcttatctgcttctgcattcaatctgttgcaacactgcatttcatgcggcctctggaaaaccctattgtacacttgtgggagaatgagtgtgaggcaaaaaacaaccaagtgttactatcaaaatagttttgacctggcctctgaaagggtctcaggaaacctgcatagtcctgggaccacactttgagaattgctgaaatacagtacttaagacaatgggtcactgggagaggacaaacaggaatagaagaggcaggcaaatcctggtatacataactacctgatttatgaccaaggtagctctacaaagcaggaggagatggccttttcaataaatggaactaaacatcatcatcatcatcttcatgtcatctagaataacaaactgaccccatctcacaccacacagacaaaaattccagagattgttgatctaaatgagaaaggcaaaacagtaacagaaaataatgtagattatcttcacaccaggatacaaaaacccccaattacaaaggaaaaggcagaaatattcaactacattaaaattaa

SEQ ID NO: 251520 - DNA, 415 bp, Homo sapiens
gagtcccttaggagaatgtccagaaggatttgcaaaggaggtactaatgtgggctgaagcagtgagatggaacaggtgcagggaaactttgtttagtgggagcaaatgaggaaaaatgtcctttttgaattaaaaaaaaaaaaaaaaaaaaaaagataccagaggtataaagactgaagtttcacttacaactccataaaacactacttcatacccaattctgttttttctatattacctaacagctgacatagtcgaccagttctcaccttatactttcttttctttctcacaggtgtcttttttgttcccattgttagttctgtctggtctctgaatttcatttctttttgttttttctttcctttctttcttcaaatggacatacatttctattgcctgaattcaacctgag

SEQ ID NO: 251521 - DNA, 443 bp, Homo sapiens
ctttacattaatgtcacataaaattcacagctaattattgtcgactcagttcataacatttccaccttttcggtaactcttctttttttactccacagtccgcctggttaacagtgaggctttgtaacagcataactttaactatggctacagtttattggctcctattttggaaactgactcatgctgaactaatcccctttccctgggagtttaaaatcaaggttaggagatttttaacgtaccgactgctctccaacagcagcattataacctttgctatttttttcccttgtattctgaaaatagaagagaaatacagaaaactctctgggttatgtatagtgcactagagtctggtacagttcatgagcagcgtctctatctctggtttctgagacatccttgcatccttataataaattcctctttaactttagaaa

SEQ ID NO: 251522 - DNA, 145 bp, Homo sapiens
tcttaccctctgtctttttatctttctgggcccttctttacccttgttcttcctcttctcctctcttaattctataatgggtcttcacatattgctgtaccttctcatgttacttgaatagaattttgatacttaatctgaaaag

SEQ ID NO: 251523 - DNA, 341 bp, Homo sapiens
gcaattaattgcatacatactcctaccaaaaaaaaaaaaaaaaaattaagtaaagacaagaatttgccagggaggaacacaaatacctgtgcccacactggaaactcagagatggtctccttaaagcctcttccagttgatgcaaaccacaaggcagcccagggaacagtcccaggtgaaaatgctactaaatctttaaggatttcttctctaaatccttccacgttcactcagcaaagctcagaaagaattttggcagtcatttttcaaatcctctgcctgatctgcatgttaccatagtcacattcattcggaaaaacaggtgtttctgttaaaattag

SEQ ID NO: 251524 - DNA, 485 bp, Homo sapiens
gcaattctcctgcctctgcctcctgagtagctgggattacagacacatgccgccacgacctgctaatttttatatttttagtagaggtgaggtttcatgttgaccacctggtctcgaactcctgacctcaagtgatccgcctgccttggcttcccaaagtgctgggattacaggcatgagccactgtacccagccaaaatgtacattcttaatacattttgaaaaggatgatgtgaattctgtcagccttgggcttgtttcacactttaaaactgtctttgcctacggtataaacaacttgaatgttctatttatttttaacattgccatctgtcactgttagatgccaaatctgaaagatacagctatagtttgagactgaaaatttcaagttcctatactattacacaacaagggtaacataggaaaaatattctctttgaatctgttcttaaatgttattaatatgttcaattatttgtgtg

SEQ ID NO: 251525 - DNA, 428 bp, Homo sapiens
ttttagaaaatttgtacctaccactatgagtctgacagtttcctagtattgaaaaacttttctgatgagtggtggtattaacacatacgatttttcagatactgtgtaatgaaatgtgtccacacagggaatatctgcataactcagtgattcaatattttccaaataaacaacaaataatgttatcacatcatgcacgggtaaaagatccactcaacatgcaaaacagactagtgaattttaatgtaacagtaagaactgttcaccgatagggcttcagattccatgttgcaactaacctataacgattcagcatttgtcaagttttagtgtggtagaataaaaaagaacattggtagatatctgcaaatgctattaaaatacttcttcattttctctcatgtatgtgtgaggatgaatttttttat

SEQ ID NO: 251526 - DNA, 1187 bp, Homo sapiens
ccaattataaaaaaaaggtatatacttactattggaaaaaaaatccagatgatgaagaaaatatagagaaacacccaaaattttgccatccaccctaagtcagctactttcattgttgtggtgtatattgttccagtcttttctgcctgcctgtgagtgtgtgtatttttataaaaccgagatgattatacttgttattctacagcctgccttttccaacaatatattgtagagagatctccatgcctataagtattgatctgtatcatttttcttggctgcgtagtattttattgaaagaatgaggttgtgagggaatagccaaaaaatctattaggtctgtaatttggactaaggaaagaagtttgtgttagtagattaactcacttatccattgaaaggatgctagtttttgagaattttgactcgacccttctgaatgaggtttaaatatttctggtggtatatcttcacttgctagcttttatcaatttagagtgattaaatgttcatgttgatggtgttaaaagattctagatggcatcctagaatctcagaaatgaggaatgataataacagacaagaagttggggcccatgattcattcaatgttaatggaagctgaccatcatagttccttctaatggagctgcattcaaattgaaatcagtttggaggtttgaattgaaacaaaacagacttaaaattatttttgaacctttgaaagttacttatggaaaccttcatttctgtttaacttcgtaattttgtctttccatttatttgtattgtaaaagcaagggttagcaataagatcaaatataattactttgaatttactcagaaaaattgtaagttaaaaattcatggaaagcacttagcgattgcacagtagttacctgctgtaagaggagaggaaacattaataagtagatgtttccctgataagagatttaaatgaagtcctagttttttctaacacctccatcacttgtcatactttcataatttataagcacttttatcttaactcattaaatcttgggaggttatcataatcataatcgtggtagtattagtaaattattgctttctgtaagccaaacactattctaaatactttacatattttaactcatgtaattttcacaaccatatgaggtagttaagatgacgaggtcaggaga

SEQ ID NO: 251527 - DNA, 1988 bp, Homo sapiens
caattcagtccttgtaattcataagaattcatactggagagaaacaagtgtaatgaacgttgcaaaatttttaatcaacaagcacaccttccacgtcatcatagacttcatagtggagagaaaccttagaaatgtgaagcatgtgacaaagtttacagtggcaaatcgagcctcaaaagacaggagaattcatactggagagaaagcttacaaaggtgaagaatatcacagagttttcagtcacaagtcaaaccttgaaagacataaaataaatcatactgcagagaaaccataaaattgtaagagttcgtgacaaggctttcgggcatgactcacacctggcacaacatcctagaatttatactggagagaaaccttacaagtgtaatgagtctggcaaagccttaatgagcagtcaacacttactcaccatcaggcaatccatggtgaaggaaacttgactaatgtaatgattgtcaccaagtcttcagtaacgctacaaccattgcaaatcattggagaacccataaggaagagagatcatacaagtgtaataatcggcaaatttttcagacatcgtccataccttgcagttcattggcgaactcatactggagacaaaccttataaatgtcatgattgaggcaaggtcttcagtcaagcttcatcctatgcaaaacataggagaattcatacaggagagaaacctcacgtgtgatgattgtggcaaagcctttacttcacgttcacacctccttagacatcagagaatgcacactggacggaaatcttacaaatgtcatcagtgtggcaaggttttcagtctgacttcactccttgcagaatatcagaaaattcattttgagataattgttccaaatgcaatgagtagagcaaaccatcaagcagtaattgacattaaagtgtttatgttaagaggattgggccaggtacagtgtctcacacctgtaatcccagcactttgggaggccaaggcgggtagatcacttgaggtcaggagtttcagatcagtctggccaacaaacatgagccacttttcccagtttgctttttgttctttaacaaaaactgatagggatttttatgggtaccgtgttgaatctaaatcacattgggttatataatcatttaacaatattaatttttccaatccatcaatatgggttatatgtctgtatatgtttttaatcatattgatgtatatttgtagatttcaaggtacaaacttctcacctttttacttttatttctatttctttaagttctctagcaaatggaagtgtttttaaattttcttttaaaattgtttattgttacaaacttctcatctttttgcttttattcctaagtatttcttactttaagttctctagcaaatggaagtgtttttaaattttcttttaaaattgtttattgttaatgtatggaaattcagctaatttttggtgctgatattgtactgtgcagatacactgaatctgtttattacttccagtagtattttggttgagtctttgtgattttctacacagaagatcatgtcatctacaaacacatataattttacttctttctttctgatttggatgggtttgatttcttttgctatttcattgctctggctaggacagccagtatttattgaatagaaggggtgagagcattcttccatcatgtgagatcctacaggaaaatcattccatgttccctgcttcgttatctactcgttggtcatttcatggatggcctttctattgttgaggtaaatttccttttctgtctattttgttcagaatttctatgatgagtggattttgaattttgtgaaatactttttctccatctattgagatgatgtggttttcatctttcattctgttcaagtggcatatcacattgatttgcttgactatgttgaaccatcctggcatcccagaaataagtggcacttgagtatctacagtcct

SEQ ID NO: 251528 - DNA, 679 bp, Homo sapiens
tagggatcgctttgaccaggaagcctttttggacacaccaggcacagccaggaatcccttctctgtttaacctgtgcacctaggaccatctacatggaatcatcattgtcatcaatttgttagtctgcacaagactacatgcatcttaacacagggtccttctctctcccctgcacccagtacaggctccacacacagtaatccattaataaaaactgtcataagggaacacttaaataaaagaaatttcagtacaaaacagatttgaagcacggaagcatgaaccttcaagctgaaaggagacaactgccatctaatctcttcattttacagatgaacatgggaacagttagctgtgaagccttgggctgtcgtccgcctccaacccctggggctctgaccacacccagccccagctcagatcatcttgctcaaagggccgaaggaggacccatctccacaccttccacatgtagatatcctcaacgttcttcacagaggggatgcccgcaccccgccccaccgagttcgcggctgctgtgcccatcttcctagagaggagttctccgccacacccgacaccacacacttccaacttctgcggtgcttccctctcacttatctccacccccaatccttatccccgctcgtttaatcacacatttattggtcacctaaa

SEQ ID NO: 251529 - DNA, 431 bp, Homo sapiens
gcccctggaacctcccaccagcccagcacagctctcacagcctcagcgccccaggtcgggcagtcagaagcagaccatgccacagatgaacatgggaacagttagctgtgaagccttgggctgtcgtccgcctccaacccctggggctctgaccacacccagccccagctcagatcatcttgctcaaagggccgaaggaggacccatctccacaccttccacatgtagatatcctcaacgttcttcacagaggggatgcccgcaccccgccccaccgagttcgcggctgctgtgcccatcttcctagagaggagttctccgccacacccgacaccacacacttccaacttctgcggtgcttccctctcacttatctccacccccaatccttatccccgctcgtttaatcacacatttattggtcacctaaa

SEQ ID NO: 251530 - DNA, 465 bp, Homo sapiens
agggcttttaccagcagcaagagtgcagaagtgtctgctagttttgagaaatgtgtctggttctccttttcctttccttataggcttccctccaccaatcctggagctaaaagaatcatacccattggcagggactgacattaatgtgacctgctcagggcatgtattaacatcacccagccctactcttcggcttcagggagccccagacctccctgctggggagcctgcctggcttctacttactgccagggaggaagatgatggctgaaatttctcctgctaggcctctttggtggtgcagggtcagcggttgatgaaaaccactgtgatccagctccatatcctatgtgagtggaggcctgatctttcttgtcaaaataaggattattattttcccatttctagagagcttcttggccagcagtgcttcattattacagttgccacatttttctcattaaa

SEQ ID NO: 251531 - DNA, 463 bp, Homo sapiens
  misc_feature (57)..(57): n is a, c, g, or t
ttttaatgtggcttgtgtgttcatgtctggtctggtctctgttagaatgaaacatcncagccaaaagatgtgggagtaggtagcagcttcaaattgtagtcttttacattagacccaaaatccgcttccaaattttgcgtgcccgccaccacacctggctaatttttgtattttttttttgtatatatgttaaggtttaatacccaaagtatataaaaaacttctacaattcaacaacaaaaagacaaaacattttaaaacaaaatggttgtaaacaaacaacaaaaagacaaccatttttgtccatcttacaatggacaaaaggcttgaataaacatttctccaaagaagataaacaaatggccaataagcacttgaaaagatgtcaacatcattagtcaatggagacatacaaattaaaactccaagctatcacttcacacttactatgatgactattatt

SEQ ID NO: 251532 - DNA, 293 bp, Homo sapiens
ggcttctttctccccaatctcagctacagccttatccagttttcaatccagaagtgtttgtagattgaaagatgctggctagtgctgctcaatattcaaggagtagggggtgttctgcttactgcctgcctgattgacacttgtcccttggaaacaatatgcaaaaggcttaatttaaaaattctggctcatgcctgtaatcccagagctttgggaggccaaggtggaaggattgcttgaggccaggggttcaagaccagcctgagtaacataggaagaccccatctctaccg

SEQ ID NO: 251533 - DNA, 475 bp, Homo sapiens
gcttagtaggtgctcagggctgaggaacataattgatgttagcttttattatctttatttacttcaaataacctacttaattgggaaattttccgggtctggagggactctgagtttgagtccagtatcttccctgggagtccttgcttgcacaaatgtgtgggatagactcccgctgtgtctgtggactcaacgtctcagctccaggctctttgctgccaggcatagtgagccgtgacatttataaatctctgggctcttaatcccctgctgatcctcggagaggagtagacatttgttgctaaacacattgccccactttgaacaaagaaacgaagagataccccaagcatcaatacaacagctgcctgcgatggctgtgacgtcccttctatcctaaggaggagggtactgggactcagtcctgtgcactgacctgccccactcacctggctggtgaggggtgcagttacta

SEQ ID NO: 251534 - DNA, 336 bp, Homo sapiens
cctggcaggattctaagcacttccatttcagaggaaacgctgatgtttctgcctgcccaagttgctatcatctattctttgggaatggccccttaatactcccttgaagaaagcaccctcttttcctctgagtggggttgtgtggttgactccatctcctctacctccctcaaatcatacagattggttcaggaatagggatgtggcccagcccaaccagtgagacccagccttggaagttttgctggaaagagttgctgttgctttgtgggggctgccaggctggtagaagctagaatgctggggagcatgttttccacctgctggaggatgtct

SEQ ID NO: 251535 - DNA, 357 bp, Homo sapiens
gtctatattatatatttgtatatgtgtttaaagttttgcctatactgagttgtaaaatcaaatgcgttctactgtgggtcattgccaaaaagtttgaaaataactggtttaagcattctgtaaaagccaatctctgtctaaattctgtccctgacacagttccaaaagttgctgtccatcaaagtatttttaaacatttgagcctatggttttgctagataagcaacatggaactgcatttagaattatgttccaatgaaaaattcagtgaatttaattctgtatgtatatttctaaaaatagttgttattttcctctgtggtgaataaatatcaatggcaagtagttcaaacaaat

SEQ ID NO: 251536 - DNA, 383 bp, Homo sapiens
acccacacatatttgccaaattggtttttggctaaggggcaaaagcagtttgataagggaaagataggctttccaacaaatggtgctggagcaattggacattcataggaaaaagacaaaatagacccttgaggtaagtacctaagtcttacatactaagtaaaaataatactaaagtagaatataaatttaaatgttaaatgtaaaactataaaactttgggaaaatattctttaaaataaaaattgattaattggacttaatcacaattaaaatgttttgctctgtgagagaccctgttaaagggaggaacagacaagctacagactgtaaaaaaaaaatttcaaaccacatacccagcaaaggactagtagctagacaca

SEQ ID NO: 251537 - DNA, 537 bp, Homo sapiens
tctttaaaaaaaaaaaaaaagttaaaaattgacttaccatttgacccagaagttttgctcataggtttgtacccatgagaaatgaaatcatatgtatataaatattcatagcagcattattcatgacagccaaaagatgaaaacaaccaaaatatccatcagcttatgaatggataagcaaaatgtggtaaatccttacaaggaaatagtatttgaccataaaagtaatgaaatactgattcatgttacaatatgaaagccagttacaaaagactacatattgtacaagtgcatttatatgaaatgttcagaataggcaagtctatggagacaaagtagattagtggctacatgtggaggggaaggatgggggtattgggggcgacgggtaaaggatatgggatataaccattctaaaattgattgtggtggtagatgcacaactctgaatgtactaaaaatcattgaattgtacacattatatgggtgaattatatttcaataaagctattaccaaatttttctaatcttagagaa

SEQ ID NO: 251538 - DNA, 351 bp, Homo sapiens
ctattctttactttgaaagaataaagtccttcttgatttggaaaagaagaattactagtaactttattacttatgaaaaggatatatttttaaatagtaactttccacatcccctggtactgtcaggtaacttttggttgtggtaaaaactccccagtgaaaatttgttcaaattgttcttttcagagacttaagtttgtaggatttttataatgttaatatgttaatgacaaatacatttttcagttttgaataagaaatgttgaatattgaacccatattgaattggttgactgttcagccagtattgtaacttacagacaggtatgaaaataaagatgttgactttga

SEQ ID NO: 251539 - DNA, 418 bp, Homo sapiens
tccttttaatatatccaaaaaagtatgttcagcccaagaaccatgttccttcttgatgttcttgggggcctcaatgtacttacttatgaagaggagatagatttatggttgaaatacattgtctttgtcttctctaggaggaggttagatagatatctatccccagaaggattagatgtcctggtccaaatggtggtcagtattcaaaatatctaagccatgttggtgaattaaatgtagctaaactactgaggacagatggcattttcctgaggagttctgagagaactcaaggatgaactgggataatgatgtcccagaagtgaaaactgctaccattcctactctgcagattgcaaaggtgagccagttgaaaacaaactaattaattacttactaattagttttaaaagtctcc

SEQ ID NO: 251540 - DNA, 440 bp, Homo sapiens
gtctcagatgtctttgttgatgcatttgatactgacttgacttctggaaacaagagatgcctgaacaatactggcctaaataacaattcattttttcctctcccacttggtgctgggtgaaaagtggggaacccaaacctcccttctgttgctgggcatctctccagttgtcactcagatgctgtggtcctccagggctgctcaagccaccattttagatgcttccatttcagctggaagaaagaaagaaaagaccagagagctgtgcttccttgaaaacatgcttggaatctgagcccatgtcatgcacacttggccctttttggccacaagggaagctggagacctaaactctaagtgaacacctgctactgtggcagaggggagtgggatgaagactttccacctctgtagagaatatagtgtctctgtatttccat

SEQ ID NO: 251541 - DNA, 159 bp, Homo sapiens
ccacatgttttgtattttttttttttggaagttggagaaatttgggtataggtttggattagagataagttaaaagctataaaagacaaatatgttgtgacagatgtgacatttctagaaggaatgggaggagagttaaagacatggaaacaaaatggt

SEQ ID NO: 251542 - DNA, 595 bp, Homo sapiens
gactctagacatccccttatgccgtcttctcaaagggcgctgttttttagatcaggcttatgacccagagcactgggtgtgggcgcgagatgcgctcgctttctagagctcagggaccgtggaggctgaggtcatcggcctgagagaaggtcatctgcatcttccggggtaaaggcagaatattggggtctattttggaaatccgaggaacccaattgcttgatccggcttcaagcctgggcaacgtggcgagatcccctctccacaaaaatacaaattttagccaggcgatgtgggacgcatctctactcccaactactcaggaggctgaggcgggaggatcgctggagcctggaaggtcagggctgcacggagccctgattgggccactccattccagcctgagaggcagagcaagactctatctcaataatcaaacaaacaaacaaactgtccaggtgtggtggcacagccctgtagtcggagctaataaagaagctgaggtgggaggatcgcttgagcccaggatatggaggctgcagtgagctatgatctcaccactgcactccagcttgggggacagggcaagtctgtc

SEQ ID NO: 251543 - DNA, 881 bp, Homo sapiens
gtcagtttcatgagccagtaggcacacgcaccatttgttcctagatatatctttccaaacacatcaagtaaggttcacgacattagcctctttctcactcccaggcctctttctctttctctttttccagttagtggcagcttgaagccattatcttgtgagaagactcgattttttgcttcagggttcagtcttgatgggcctttggcattcaacttttttctcaatgtctcttattctttagcgtttaggagcaggtggcttctccaaccctgccactctagtcctctcagacccggacaagagaggtggctccctgaatcccacactttagagggttcttctgtcactcaagatctggtactcagcactagcacagcacaacccataacctcaaacatctgctcacataactcacaccattcagacctcagagaaacaccgctctacatctttcatatgccaccaaaaaagtgactgcatcaaagagttgtgaagttttttgtgggatgtgtcattgccagtgtcagagatgaacactagtttatagttcagggaagatctgagtggtggaagtacttaggtaagaaaaaagaaaaattaagttgtcaaatattttctctcaatgtgaatgcaatgtattcctgcacaaagaagtttcatttcccagttatctcaaatgcttattttcttcttttcctggtccagtttgtatattgtcaaaagatgcacacgctgcctgagaaacattttgcagtactaacaattcatattactcttaaatgtgtagtatatcggctctaaatgcatgtgtgaagtgaccgattccctttgtattggcaactatatggacattaaacactggaattgcaataagaatt

SEQ ID NO: 251544 - DNA, 340 bp, Homo sapiens
ctagagtcaaatgctctggagaactttgtctataacaagtttcagtagaataactgtgtttggccgggcgccgtggctcacgcttgtaatcccagcactttgagagggtgaggcgggaggatcacctgaggtaggagttcgagaccagcatagccaacatggggaaaccccgtctctactaaaaatacaaaattagccgggcgtggtggcacgcgctggtaatcccaactactccagaggctgaagcaggagaatccgttcaacccgggaggtggaggttgcggtgagccgaaattgtgctgctgcactgaagcctggacaacaaagtgagactacgtct

SEQ ID NO: 251545 - DNA, 314 bp, Homo sapiens
taaatcccaacagcccagggtggggaccacattgcaaggaactgtgggcagcctcttgaagctgagagcagaattcagccaatggcaagaagccaggcacctcaatcctgcagccacaaggaaatgaatcctgctagcaacccgagaaggcttagaaatggatccttccccagtcgagcctctgatgagaccatagtcctggttgacaccaaaactgtaaccttgtaagaaaccctaatgcaggggccccagctaagccatgctcagattcccaatccatgggaactgtgagataataaatgtgttgcttgaaa

SEQ ID NO: 251546 - DNA, 277 bp, Homo sapiens
gttttctattgagcgttctctgaatattcttgccttcagtcctgctgggagccttttctcagatcaccagtgcaagcctacagtcatacattgtttgtagttgatacaacctcaatgatataagttttttgatgattttaaaatatgagtaattaatcatttataacctataggttaaaatgaattataagtggatgaaggtgggaacccaaatgaatcaaagctatttaagtttggtattgacattgtgcatcttcccattatttattataccaaa

SEQ ID NO: 251547 - DNA, 568 bp, Homo sapiens
cagagtatgctactgctgactcaacagttccacttggatgtttgataaactcaaacctaccattcaaaactgactgttcatggtccccccaccaaacctaccccatgcataagctccttacttcactcaagggcagctctgtccttttagttgctcaggccaaaataggggcagagggagctggggtaattctcaacacctttctctctcacttcacattaaatcctacagaaaatcctattggctgaattgtcagaatatattcagaattcaaccatttatttccctttctactgttaccatcttgatctaagcctccattctgttttgtccagattaatgcaataggttcctatatggtctccctgcttccatccaattccaatccctcctcccaacatagtctgttcttaataaaggagccagagtaatccttttaaaattagattgtgttactttttggttcagcgtcctaaagctcctcagtttacttggggtaaaacccaatgtcttactgtggtttgaaaggatgtgtggccgggcgcggtgactcacgcctgtaatccta

SEQ ID NO: 251548 - DNA, 830 bp, Homo sapiens
ggcaaaagtgacaccacaacattcattataggaagtaagagacattcatcactggaatattttagcaaatgaatcacaacagactgatagcataactcatgttctaaggccaagaacaagaattgcatagtttattttaagacagcagaagagtaaaaaacagattgaaaaacatatgataccctctccagctcagagctctacaaacagcagtggcgtttgcaaagttctatgtatcttctcaaatgtggtttcagttttaatgtgtgttgacatctttgtgtgcagaactaactggaggaacaacagtttgtgctttttttcccttcttgctacaagggtgagaacagggaaagaaccaaacggtctgtgtttactttgagcagccatacaccatgcatggacactaaggtatggttttccttcaattattccaaattagtataatgaaaacatgcttatccctcgagccattggatgcgtataatgcagaagagatgcagtaatggagttgccttatatgctcctctgaagcagaagcaagtgaaagagacaagtaagatgattagaaaaactttgactttctaaaacaaataagcagtaaatgaactgattgagtgcaaaacttcacagaaccacacaaagaactggagcttcaaactgtaactttaaaaatagtagggtgaaaaattaaggggctctaacatgaaacaaatttaggaagaaagagaaagcaacagcatgccaagaactatactgattaggaagtaggcaatttaatttcttcaggagagtaaatctccaacatgaattaatttgcttcacgctga

SEQ ID NO: 251549 - DNA, 490 bp, Homo sapiens
gtgttggatttaaatatgcaagtaccaaatgttaaaggagtgggtctttgaagcagacacagatatatttagactgttggagatactgctgcatgggggtgattgttggaggaataatatgaggaaagtggaattgtccttgagtgcaggggcacaggggtgactagcagatcccaagtttggaagatccaagttagaaatggatcttaggctggatgtggtggctcatgcctgtaatcccaacactttgggccaaggcaggaagattgcttgctataggagtttgagagcagcctggggcaacatggtgagattctgtctctacgaagaatttgaaagttagctgggcatatttgcacatatgcctgtagtcctatctactcgggaggctgaggtgggaggattgcttgaactcagatcgagcctccagtaagctgtgattgcaccactgcactccggcatgggtgacatggggaggtcctgtagaaag

SEQ ID NO: 251550 - DNA, 485 bp, Homo sapiens
tatctgttggacttctttctgtcatcagtgtctgtgcctctttaccatagtaagtcttggtggagatcagaaaagctgggtctctctagatcaaagataaaggaaccaaatcagaaactgaagtcagagctcttatgaaatttgacaatgccctgaaggtagattctgaggggatagggttggagaatcactggctgtatatattatgtggattcaataaggatttgttgatgacttcataaaagacgagatgcctgttctaataataacacatgattaaatctatcatgactttgaaaatggctttactgttttgcttgagtttttttcatgctaactctggatagcctctattttttggtatttgctgtcgttataatttttattagtaattgttgattatttaccagatatgatcttgaatttttctttagaattgtttaaacattaatgaatctaactgtaaaggagtagatacaaatttc

SEQ ID NO: 251551 - DNA, 683 bp, Homo sapiens
attgtaaggcatgtaccactctggcgtgggatgttgatagcaggggaggctccgtgtttgtggggggcaaaggatatatgggaatgctctgtactttctgctcaattttactgtgaacctaaaactgccttaaaaacagtctattttctaaaaatatataactatacagaaagctgactcttctgcttagtttcctgttcctaatgacagatgcaatgttctagaggcattttagtcagaaagctctctctacctggacatccattcccactggtctgctgttactgatttgtcttcggggtgggaaatttagtttggaagtaccatcccaccaaggcctgcagtgcctaagagcgtctctcttggaggatggttaaagtagtcagggtattttacaaccgcatcttcctgcacaaccattatccaaaaacatttattttttagtctaaaggtgttcttttcatatttgtctgtgtagagctcaggaatgtatttcaggttaaaatatagtaggaatcaggtaaacaacatgcatgaatgaagaatataataaattctttcagtaccttttttcatagcatagagctctgctatgaagaatacataacacatacacagtatttaagattacatgtgcacacatgaacacacacacacacacacaccaccccttctttaaagaa

SEQ ID NO: 251552 - DNA, 394 bp, Homo sapiens
gtagacccaatggacctaacagatatgcagagctttctacccaacagcagcagaatacactttcctctcaagcacatggaatattctccaggacagatcacatgtgaggtcacaaaacaagtcctaacaaatttaagaggattaaaataatattgtgtatatttttccaatcataatggaatgaaactagaaatcaacatcagaaggaaaactgagaatatgtgaaaattaaacaacattctctcaaaaaaccaatgggtcaaagaaaaaaaaaaaagagaaaatttaaaatcttgagataaatgaaaacatgatataccaaaacttaggtgatgcagcaaaagcagtataaacagggaagtttatagaattaaatgtctacgttaaaaaagaa

SEQ ID NO: 251553 - DNA, 451 bp, Homo sapiens
acacctgaggtcaggagtttgagaccagccttacccaacatggtgaaaccctgtctctacttaaaaaataccaaaaatttagctgggcatggtggcgggcacctgtaatcccagctgcttgggaggctgaggcaggagaatcgcttgaaccagggaggcagaggttgtagtgagccaagatcacgtcattgcactccagcctgggtgacagagcaagactccgtcaaaaaaaaaaaagatattaaatccaggaggtcgactacttttgtccagcagcactgataagaaagatagctggtctgggcacagtagctcatgcctatgatcccagcaccctgggagactgaggtggaaggatttcctgagtccaggaatttgaggctgcagtgagctatgattgcacaattgcattccagcctgggtgacagagcatgaccctgtctcaaaaaaa

SEQ ID NO: 251554 - DNA, 476 bp, Homo sapiens
  misc_feature (217)..(217): n is a, c, g, or t
acacctgaggtcaggagtttgagaccagccttacccaacatggtgaaaccctgtctctacttaaaaaataccaaaaatttagctgggcatggtggcgggcacctgtaatcccagctgcttgggaggctgaggcaggagaatcgcttgaaccagggaggcagaggttgtagtgagccaagatcacgtcattgcactccattttgggcaacagggtganactccagcctgggtgacagagcaagactccgtcaaaaaaaaaaaagatattaaatccaggaggtcgactacttttgtccagcagcactgataagaaagatagctggtctgggcacagtagctcatgcctatgatcccagcaccctgggagactgaggtggaaggatttcctgagtccaggaatttgaggctgcagtgagctatgattgcacaattgcattccagcctgggtgacagagcatgaccctgtctcaaaaaaa

SEQ ID NO: 251555 - DNA, 619 bp, Homo sapiens
ttccaagctgggaaagagattaatttaacaaggtccaactattgttttcaaataactttggaaaatcctatatacatatattcaaagccagatgatttttgacaaaggcaccaaaaacatacattggagaaacaacactctcttgagtaaatagcattaggaaaactgaatatctcgatgcagaagaatgaaagtagacccctatctctcaccatatgtaaaaatcaaataaaaatgaattaaagatttaagtgtaaggcctgaaactataaaactggtagaagaaaacataaaagaagcacttgaggacattggtctacacaaatattttagggctaagacttcaaaagcataggcaacaaaaacaaaaatagacaaatagtactatattaaactaaacggctcctgcacagcagaagaaacaacagagtaaagaggcaatctgcagaatgggagaaaatatttgcaaactattcatttgacaggggactaatacctagaatatacaaggaacttgaagatcaaaaaaataaatcccattacaaagtgagaaaagaatctgagttgacatttcccaaaatgaaacatacaaatggccaacaggtatatgaaaaaaaaa

SEQ ID NO: 251556 - DNA, 848 bp, Homo sapiens
catgcaaaaggaaacggcgggaaacacacacgcactgcctgaagcaaccgattaaaaaaaaaaaaagcgggcgggggagttgggtgaagagccagcttccgagccaggcctgctggccgcccctggttttgcgagcgaatgtcagggcaggatggaggtgccgaactccccgccagctcctgagtcctgaaggtcgtcttctccccaccgtactccccaggactccgaggcccggcgcaatcgcgcgctgcggagggcggcggaggagaggcaccaggcgggccgtcgggaggtggaggcgctgcgtctgtggacccagctccaggagctacggcgggaacacgcgcggctgcagcgccggcttaagcgcctggagccctgcgcgcgcctgctggagcaagcgctggagctgctgcccgggttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctgcaggagcgcctggaggctgccagggagcgtacgctgcagtgggaatccaagtggattcagattcagaacacagcagcggagaagactctgctcctgggacgcagcaggatggctgtgctcaacctgttccagctagtgtgccagcatcaggggcagcctcccaccctggacatcgaggacacggagggacagctagagcacgaccagaccatctcttttcaaaatcaactctctgccctccgtggag

SEQ ID NO: 251557 - DNA, 1054 bp, Homo sapiens
catgcaaaaggaaacggcgggaaacacacacgcactgcctgaagcaaccgattaaaaaaaaaaaaagcgggcgggggagttgggtgaagagccagcttccgagccaggcctgctggccgcccctggttttgcgagcgaatgtcagggcaggatggaggtgccgaactccccgccagctcctgagtcctgaaggtcgtcttctccccaccgtactccccaggactccgaggcccggcgcaatcgcgcgctgcggagggcggcggaggagaggcaccaggcgggccgtcgggaggtggaggcgctgcgtctgtggacccagctccaggagctacggcgggaacacgcgcggctgcagcgccggcttaagcgcctggagccctgcgcgcgcctgctggagcaagcgctggagctgctgcccgggttccaagaggttccggagctggtggcgcgcttcgacggcctggccgagacgcaggcggcgctgaggctcagggagcgcgagcagctcgcggagctggaggcggcgcgagcgcggctgcagcagctgcgggacgcctggccggacgaggtgctcgcacagggccagcggcgggcacagctgcaggagcgcctggaggctgccagggagcgtacgctgcagtgggaatccaagtggattcagattcagaacacagcagcggagaagactctgctcctgggacgcagcaggatggctgtgctcaacctgttccagctagtgtgccagcatcaggggcagcctcccaccctggacatcgaggacacggagggacagctagagcacgtgaggacccctctttatggcacctccagcccccaaacactccctctttggaaaaatgagcctaaaaccccacagttagtgacaccttctctgggttaagcatggccctctacggtcagagcccttgccccagccgtggctcgattgtcgggcaggcacccggtctaggatggattcctgggtgcatcttggctctgacagtggccagaagaaagccatgcccctctctgcgacaaagctagactctatctc

SEQ ID NO: 251558 - DNA, 488 bp, Homo sapiens
tctgaccaccactccaggacactgcagacaggtgtgcatttactcagcatccagtaaacacctgcaaggtgcagagtactacactaggcacagggaacagagctactgactgactgccagagtttcgaagaatacagataagtcaactattaaagctaggaaacagaccggatgcggtggctcacgcctgtaatcccagcactttggaagaccgaggcgggtggatcaactgaggtcaagagttcaagaccagcctgccaacatggtgaaactccgtccctattaataatacaaaaaaattagctgggcatggtggcacatgcctgtaatcccagctattcgggaggctgaggcaggagaattgcttgaacccaggaggctgcagtgagctgagatcgcgccattgcactccagcctgggcaacaagagcgaaactctgcctccaataaataaataaataaaataaaataaaataaagccataaaaca

SEQ ID NO: 251559 - DNA, 906 bp, Homo sapiens
ctaattagatatatatttaggtatggtaatagttacttaggatggggaggaaacggggtgaactatggggataaaatataattaagagaggactcttgcgtgaccagtgatgaaaactggaataacaacattatttattgaatacaacacaccaattataagaatgaaaagattggaataattctagaatgccacaaaataacatatgtcatgtggcctggtacagactataagcataatagttcagaaaagggagatttgcagatagaatcatgtggaagcccttcctgatgaaggtgtcacttgcactgggccttgaaagaaaggaatttagacagatgaagagaagcttcaggaggccaggttccaggtcagttttgttttattcatcactgaatctccagtgcctgcctagcattgtgcctgctgatgtctgttcaactactccagccaatgaatggtagaagaggtatatataaattaaaatctttaaagattcatctgtatggcatttttttctttctttctttctttcttttggagatggagtcttactgtgtcgcccaggctagagtacagtggcactatctcagttcaccgcaatctctgcctcctgggttcaagcgatcctcctgcctcaacctcccaagtagctgggactacaggtgtgcaccaccatgcccggctaagttttgtatttttagtagagacgggggtttcaccatgttggccaggctggtctcaaactcctgacctcaaatgatccacccgccctggcctcccaaagtgccaccgctcccggcctgtgtatggtatttttctatggcatgtaattttctgtacacaccctctttctttcttaggcttttttgtcagcagcccaagatggaaaaggcagctttatgt

SEQ ID NO: 251560 - DNA, 471 bp, Homo sapiens
ctaagaattttactttgggccctatctcctatactcagagcaagcataaaccttcccagggccctacacaaacatattcccatcgaggcatcacataaaataaaatcaaccatttaaaaaggtataatttagtgacaattacttcccatttataagcaagggatgcatgagtgctacccatagaccggatatgggccatgtcgttagcgtttcttgatctcgttagataaattatctgaaattttgaggagacttcagcagaaagaagcaggggatatgctgtcaaatgcctgtggatttatactaagaaagaaagaaggggcataaggaaaattttctttatctcgattttggaggtggttacatgggtatgtatttgtcaaaattcattgacctgtatacttaagatttatacattttattttatgtaaactatatctcaataaagttgagttttttaatgtctagaaa

SEQ ID NO: 251561 - DNA, 473 bp, Homo sapiens
aacatacctaagttatacagttagtaggtggcagaattggaatttgaacctagtaggataggattggattgatgctttctaaacccttcacttagggattttttcttgaaataacatggttatagtgatagaccttttttcttttaaaagtggtggcaaagtactaaacataagctatatttttgttccccagaaagagaaatctaaattttatttttatttatttatttgagatggatggagtcttgctctgttgcccaggctggaatgcagtggcgcgatcttggctcactgcaacctctgcttcctgagttcaagcaattctcatgtctcagcctccctagtagctgggattacaggcgtggtggcacggacttgtagtcctagctgctacttgggaggctgaggtgggaggattgcttgagctggtgaaggttgaggctgcagtgacagagcaagaccctgtctcaaag

SEQ ID NO: 251562 - DNA, 432 bp, Homo sapiens
taacttccttctctgctgctattgttgcatggcactttccctgtgtgtgtgtctgtgcctcttctcctcttcttacgaggacaccagtcatgctggattaaggccctccttactctgatatgacttcatcttgattacatctataaaggtaacattcataggtaaacaggatttggacttcaggacatgtttctgaaggatacaattcaacccacagcagtcctttttccttcatgagaaaaaaatgaagtgcactccagagtcttactgtggttatagctatgtagtttggtggttcctgaattaattgaaaatagtttaactatcactcagtggaatgtgttcagcttctcaactaatctttttgttccctttgaaataactcagagctttcaacagccccatagtgtgcaagaactccttgaaactagt

SEQ ID NO: 251563 - DNA, 294 bp, Homo sapiens
ctgggtgacaagagggaaacatcatctcaaaaagaaaaaaaaaaaaaaagcaaagatgcctttgttagaagagaaaggatgagtgtcaatattcttaatacttgttgctcaacagtgaacagaaagttatcgggttttgcgtgatggattccagcttgtctgtaaagaagaggatggatcattcattatttaataactgcattaagtgctaggaacagagtggtgagaaaagaagcatattctttgctttcatgaagcttatattccaaagagggaaacttaccctgcataagc

SEQ ID NO: 251564 - DNA, 2987 bp, Homo sapiens
  misc_feature (2943)..(2943): n is a, c, g, or t
gatcagaagaattaatattgttaaaacgaccatcctgccgaaagcagtgtacagattcaatgcaattcctatcaaaataccaacatcatttttcacagaattagaaaaaacagtcctaaaattcatatgggaccaaaaaaataaaaaataaaaaagcaaagcctaagcaaaacaaaacaacaacaaccaaaaacaaagctgcaggcatcacatttcctgacttcgaactatactgtaagactacagtaactaaaacaacagggtacttgtataaaaatagatacatagatcaatgaaacagaatagagaacccagaaataaagccatatatctacggagtgccagctgatctttgaaaaagttaacaaaaacatgctctgcgtattctgagatgttctcaggagtatatgttagtccttctccacatacctgttttccaggttggtcttgaactcctgggtgcaagcgatttacccagcttgacttcccaaagtggtaggattacaggcacgagccatcatgcctagctaggctaccttttaaatatatatcatggccaatttttgtttattctgattatttattagttcctttttgatgtctggaagaacttattttctagccagacagactcttatatcaaatatcaaatttccagccttccaaatgggttttcctaccttgtctcaagccaaagcaaaacaaacccccaccccacaaaagaaaaacaaaacaaaacaaaaacttctcctccaaaatcagccgttacaccacccacctctggtgtggacatgacttccttgttcttcctcaggagttataaattatgctacggggttatgatggtatttagccagaagaaggagaaaaaaaaaaatgaaacatgttcaaactgggatcgttttttcattcctttttatggattcaattttgtgatatatagtgtttataaagtccttcagtgaaaatgtactctggtttcagcttggccttgagtttatgctggtacactgatttagctaaaacaaaacaacaacaagaaaagcttatcatcattattcactcaagcatcaatcattgcatgtgcttccacccactcccccaccccacgattaaatgctagccattcttcacttcagctcctccctctgcccccttcttcatatcggattagatttctcttccctgtattcctgaaagcaacagtgctcccttctctcctggcatgtaacacttaccactgtgaattataaaacggttgctttgctttttctcttttaaaatagactatgagctcctccagggcaggggccatgtctgatttacttttatctcttagtgatgctttgctaggcatatggcagagctcaataaatcttgtatgaatgaatggtctcatgactggttccttctcatacttcagctcttagctcaaatacggtctcttcaagaaaggcttgcatgatcacccaacataaagtagttgtgcatccccggcacagcctgttccattgtcctgcgtcattttcatcacagaagttaccactctctgaaattgtttgctaagttgtttattctgtctccccacagaatgtgagcgctgtgaaagcaggaccctgtaggtcttgcccattgctttatttcatgccagttcctaggctgtcagcacagtttggttacatgagtgagtgaattttccctgttttccttcctaccctcagtggaaactgtgaaggctaaatgtataaggaagactagatattaaagcattaatcacgtgtaactgtctgtaaacagcggttttgtagttttttgcttttagtaaataggctcccccgtgtgatcaatactaaactgacagcaaaagagcagtccattcttattagaccatgcttggggagataagttgctgctggctcatgaaggacacattcttcttgatgtagggaggtggaatgaggatttaggcgctgtcttcctcccctttggggtagggtaccttgctgtcttttgacagaatgaggatgagaggaggtggtaggaaggcgggggaggatcagtgatgagatggcactggggacagtggagagaatggttgtgcatatgatttacggtctttcttttcagtatactacagtgcttagatgtgtatgcagaaatcaagagttatcagtgatgtttgaaaattagatgttgctggcatggaacttccgttttcattgagaacagagcgtgcttagtgacgtgtatatttagtacagtaagacagttgcagaaggatggccctgatggtgacagtgataatcctaaccctagatgctcactggctgggcacaagtacaggatctcactggaacctcactaggtatctgttgtcctccttttatagttgagaaacagaaagcttaagtaatttgcccaagatcatgtaactaataactggcagggatttgagtcaggatctccaaagctacatctcttcctaaagctagttttaaaatttcatttctcatatatggagtagcccacaaaggctgtatgcaaggtagtcttcagaaagcttacatcttcaccaaggcacatgaaactgcagaaagaagcaatgttaggcgttcctgataataattatctgcctggatgacagcagtcctgctttatggtcacagaccccagctttctgccagaacatggctcaggactcctgaaaatcatcccattcgggagcaagtgggtttaatttccttttcatgaaaggaaagattagctttcatgcaaacacttggtccatttggccatttaataagaagactgaagtctcatgttccataactttatcagcctaaaagtccctttgttgtatcataaacacataggctgaaacccctgtccttccaactcagagcaaattctgttgtattaaataaccatgccatgtactgaatntttttacacttatttattggacttgactcctacctccttcccgc

SEQ ID NO: 251565 - DNA, 2951 bp, Homo sapiens
gatcagaagaattaatattgttaaaacgaccatcctgccgaaagcagtgtacagattcaatgcaattcctatcaaaataccaacatcatttttcacagaattagaaaaaacagtcctaaaattcatatgggaccaaaaaaataaaaaataaaaaagcaaagcctaagcaaaacaaaacaacaacaaccaaaaacaaagctgcaggcatcacatttcctgacttcgaactatactgtaagactacagtaactaaaacaacagggtacttgtataaaaatagatacatagatcaatgaaacagaatagagaacccagaaataaagccatatatctacggagtgccagctgatctttgaaaaagttaacaaaaacatgctctgcgtattctgagatgttctcaggagtatatgttagtccttctccacatacctgttttccaggttggtcttgaactcctgggtgcaagcgatttacccagcttgacttcccaaagtggtaggattacaggcacgagccatcatgcctagctaggctaccttttaaatatatatcatggccaatttttgtttattctgattatttattagttcctttttgatgtctggaagaacttattttctagccagacagactcttatatcaaatatcaaatttccagccttccaaatgggttttcctaccttgtctcaagccaaagcaaaacaaacccccaccccacaaaagaaaaacaaaacaaaacaaaaacttctcctccaaaatcagccgttacaccacccacctctggtgtggacatgacttccttgttcttcctcaggagttataaattatgctacggggttatgatggtatttagccagaagaaggagaaaaaaaaaaatgaaacatgttcaaactgggatcgttttttcattcctttttatggattcaattttgtgatatatagtgtttataaagtccttcagtgaaaatgtactctggtttcagcttggccttgagtttatgctggtacactgatttagctaaaacaaaacaacaacaagaaaagcttatcatcattattcactcaagcatcaatcattgcatgtgcttccacccactcccccaccccacgattaaatgctagccattcttcacttcagctcctccctctgcccccttcttcatatcggattagatttctcttccctgtattcctgaaagcaacagtgctcccttctctcctggcatgtaacacttaccactgtgaattataaaacggttgctttgctttttctcttttaaaatagactatgagctcctccagggcaggggccatgtctgatttacttttatctcttagtgatgctttgctaggcatatggcagagctcaataaatcttgtatgaatgaatggtctcatgactggttccttctcatacttcagctcttagctcaaatacggtctcttcaagaaaggcttgcatgatcacccaacataaagtagttgtgcatccccggcacagcctgttccattgtcctgcgtcattttcatcacagaagttaccactctctgaaattgtttgctaagttgtttattctgtctccccacagaatgtgagcgctgtgaaagcaggaccctgtaggtcttgcccattgctttatttcatgccagttcctaggctgtcagcacagtttggttacatgagtgagtgaattttccctgttttccttcctaccctcagtggaaactgtgaaggctaaatgtataaggaagactagatattaaagcattaatcacgtgtaactgtctgtaaacagcggttttgtagttttttgcttttagtaaataggctcccccgtgtgatcaatactaaactgacagcaaaagagcagtccattcttattagaccatgcttggggagataagttgctgctggctcatgaaggacacattcttcttgatgtagggaggtggaatgaggatttaggcgctgtcttcctcccctttggggtagggtaccttgctgtcttttgacagaatgaggatgagaggaggtggtaggaaggcgggggaggatcagtgatgagatggcactggggacagtggagagaatggttgtgcatatgatttacggtctttcttttcagtatactacagtgcttagatgtgtatgcagaaatcaagagttatcagtgatgtttgaaaattagatgttgctggcatggaacttccgttttcattgagaacagagcgtgcttagtgacgtgtatatttagtacagtaagacagttgcagaaggatggccctgatggtgacagtgataatcctaaccctagatgctcactggctgggcacaagtacaggatctcactggaacctcactaggtatctgttgtcctccttttatagttgagaaacagaaagcttaagtaatttgcccaagatcatgtaactaataactggcagggatttgagtcaggatctccaaagctacatctcttcctaaagctagttttaaaatttcatttctcatatatggagtagcccacaaaggctgtatgcaaggtagtcttcagaaagcttacatcttcaccaaggcacatgaaactgcagaaagaagcaatgttaggcgttcctgataataattatctgcctggatgacagcagtcctgctttatggtcacagaccccagctttctgccagaacatggctcaggactcctgaaaatcatcccattcgggagcaagtgggtttaatttccttttcatgaaaggaaagattagctttcatgcaaacacttggtccatttggccatttaataagaagactgaagtctcatgttccataactttatcagcctaaaagtccctttgttgtatcataaacacataggctgaaaccccggcttcaatcaagcaatctgggataatacctgctgtcggtatttacttttttggatgaccaccctcc

SEQ ID NO: 251566 - DNA, 478 bp, Homo sapiens
tggggacttttgtccagggagagcttttgtccagatgggagattatagccctttagctcagcacagcagagccacgcatggctattgaaatcaaaattaattaaaatgggataaaattagcaattcagttcctcggttgcatctgacacatctcaagagctcgacagccgcttgtggttggcagctcccctcctgggcggagcagacagcgaacacctccctggctgcagagtgctctgttggacaacagaacgcgctgccctgcgatgctgatgctcagattagacagatggaaggggccccagggagggggcggctggtttaagtagcagtttctcaccagagactctgattcagctggtctggggcagagcccaggaatccgcatttttacccagccacccacttgattctgacgcaggcaatccaaagatgaatctggccattaaaacataatttttcattttaaaacttctcg

SEQ ID NO: 251567 - DNA, 648 bp, Homo sapiens
ccaagagggctctgtagctaaggactgagcttgcaatttcagagaccataattccagatgtggcacatttgagggcttgtggctgtagcagctttctgggatgaaacccagtcccctgcacaacccctgcaaaaagtcccttaagtcaacaccaaggaaccagctgagcaaatcaaaagtgacatttcttcttagatctgtcagaaaaacgaggtcacagggcaaaccactgtccccagaattgaggagttgggcagggtaatatagagaatcacaacttcctgaagccaaaacctctgtgggaaccagtgccggggaaggaaagcctgcactgtaattgaagaatttcttgaggctcagtgtgggccagtcttagacacaaactcgaggaggacccaataacggaggtctcccacacttttgtgagttttatctctgggagcttggttagctcgtcagagtgaatataggagaaatattcacttgtgctcccaggacacggaaaggaaaagcaatcacttaaaaatataccagagtgtcctattgttctttcgcttgttccatatagtaaatatgcaagacaaaggcaagcactgttccaactactgttgatacatttttagaaagaaataaaacaatttaactctc

SEQ ID NO: 251568 - DNA, 709 bp, Homo sapiens
gggaatggctcctctcaatttgagaaattctgaaggaatttccattggcaagttcagcaaggccaactgacggagagaggaagcaccctgactgttccagttcagacactcttggggcttgttagtaattgagtatgtgtctggataagtgagtgtcatttgtgggtccagacagcaggatctgcttttctcaatttgagaaattccgaaggaatctccatttgcagattgaactagcccaacaaacagggagaaagcaactcaactgtttcagtttggactctcttgggacttgcttattgttgtagcagttagattgtattctggtggttgtttgtgtgttgatgtagttgtgggagatcagggtttgatctgagtgcagaccgcttgggtgtattcttcagggttggtctgcatgtggctgtgggccagtggagtgagggaacatctctacccgtatcacgctgaacatgcccaatctcatctgatctcagacagtctttgaattgtagcactgccttatatttggatttattttgctgttgaatgtgaatatgggatggaagtccatgtctccaggcttctatgctgctgctctaaggacaggcaggcctgattagtatgtgctgctgtttggctacagagttctttggagtctggagagatttggcctttaaaaatcaaactgtcagaccctgtctcaaggaaa

SEQ ID NO: 251569 - DNA, 429 bp, Homo sapiens
gttcctagtgccaaaaagtttggggaccactgctttatagtacctaaaattatatgtttttgttgacagagttttctagagggatctgcaagaagctgttacgatttattgcatggggagggaagctcagggtggttagaattctttacttctcctgtgttgattgcactttctacattgtatgtatgtacctttaatattttataaatgtgtgttttttagaagagatatgctgacataggacacagaaagatttaaaataaaatgaaagaaaagatatattaaaccaatattacccattagaaagctgctgaattgctatgactgtcccatgaaatagacttaaaggcaaaaagcatcatgaacgttaaagaaaataagaagaatgactcaccagcaggacaaaaactgtgatggacaaaaactgtg

SEQ ID NO: 251570 - DNA, 358 bp, Homo sapiens
gaaagcttccccggctcgatagacccaagcaagccctgcctaccaggaggcctgagtccccacagtgaccttaccctgccttgggccagccccagctggcgcccagcctcagtggctgaaattcctgaaccagatcagggccatttggaaagaagatgttgctccacattctcctctcctggaagctgcagtgccattttggacagaaagaggataatcaaggatcagcctacaattctgagttgccacttaatcaagggtatgcaaattaatgagcattctttccgccaaattactttttagtatgaaggtttgaactcctggacatcctgggcgacgagagagaaactccatctca

SEQ ID NO: 251571 - DNA, 737 bp, Homo sapiens
ccgagccctcagtgggaacttgttccggtgctattccagtgtgtggaagcttcgttctttggctctttgcaagaaatcttgctactgctcactcttgggtccatgctgcctttatgagctgtaacactcaccgtggaggtctgcaccttcactcctgagccagcgggaccacgaacccaccagaaggaagaaactcccaacatcaaaacgaacaaactctggacaggccacctttaagaaccgtaacactcaggcgaggttctgcaatctcattcttggagtcagtgaaaccaagaacccaccaattccggacacgagtgcagagttgatgtgagaagaagctaatatggtatgaaatgcacccatctcggtttttgacctatagtattaaatgcacccatctcagtttttgacatatggcaccaggattacaaagcttaacaagtcatgatttagattcagaagttacaaagagtggaaaaggtcatattctttcttatgaggagacaagaactcaggttgctgcagatccatatggaggatatgcctctggttacatattttggtgccatgtgagcatgtcctactccggtggatttttttttttcatctctgagcttgacctgagattgaccatctgacctgagctataattttgacataaattttgactaaaaggtgagcatgtcctactccggtggatttttttcatctctgagcttgacctgagattgacc

SEQ ID NO: 251572 - DNA, 732 bp, Homo sapiens
ccgagccctcagtgggaacttgttccggtgctattccagtgtgtggaagcttcgttctttggctctttgcaagaaatcttgctactgctcactcttgggtccatgctgcctttatgagctgtaacactcaccgtggaggtctgcaccttcactcctgagccagcgggaccacgaacccaccagaaggaagaaactcccaacatcaaaacgaacaaactctggacaggccacctttaagaaccgtaacactcaggcgaggttctgcaatctcattcttggagtcagtgaaaccaagaacccaccaattccggacacgagtgcagagttgatgtgagaagaagctaatatggtatgaaatgcacccatctcggtttttgacctatagtattaaatgcacccatctcagtttttgacatatggcaccaggattacaaagcttaacaagtcatgatttagattcagaagttacaaagagtggaaaaggtcatattctttcttatgaggagacaagaactcaggttgctgcagatccatatggaggatatgcctctggttacatattttggtgccatgtgagtcggatacgttctgttgctaacaatacagtacgtaaccttttgagaatggcttccttcactcaacgtgatgcttttgagattcatccaagttgttatgggcatcagttgccagctctttttaatggaaagtaaatctacttgcaaagcctatctg

SEQ ID NO: 251573 - DNA, 241 bp, Homo sapiens
gttagccttcctctttccccttatgtgaaagttttcaactgacctgaggaaaccatctggctgtcttgcagccgctaggggtgtcatgttcattttcaaaataaaaagtaaaataggaaagtaggcactttctctcttttaattctgaagattgctcatcatcgatatactgatagattcccctgaaacttttaaactttaatttaaggaaatctgctcatggtttttcatcattggttgt

SEQ ID NO: 251574 - DNA, 372 bp, Homo sapiens
atattatgcttttcccaggctagctatgcaaatctcatttcccttacatttgaaagtcatttcagaattgtttcattagggttgaggcaagcacaaatcatgaatgcctgtgtcttctaccaccaaacagattctgttggacccacaactgatatgctttcagccaggttccatttagcattcaccctggacttagggactctacaagagtgctgggtatttagttttgttttgttttgctttttgagacagagtcttgctctgtcacccaggctggattgaagtggcgcaatctcagctcactgcaacttccaccccctgggttcattctcctgcctcagcctcccaagtagcagggattacaggtgccca

SEQ ID NO: 251575 - DNA, 636 bp, Homo sapiens
ccgaggcccagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatcccccatctcccttgcccgcagccctagaatcccagaaacccaactccgcgcagctttcggtttggagagcccgccctggtttgcaagcacagatacatgtgcccacacccgaacacacgcagacaccgccagagagcgagacagcgagcgggcgcctccgtagcagcggcctgcggggcggaaccggagctggcgccgcctcaaggggaaaccgaactgtagtgaccggaaatgtccccaggacagaataagccattccttctgtccacgttgccaggacttctccagctcaacacaccttggtttgtttaatgttacacgagggagaagatttagaggcagagacacatgctggctcaatcggcgaggaaatacgagcagagtct

SEQ ID NO: 251576 - DNA, 370 bp, Homo sapiens
caggcccagaaaacttgggggcagatatgagagttaagggaaatgtggttatgaaaccacaggctgaagaccagcacatggtttaccttagaacagttatttaatctttcttgtatccaaatactggtattacctagcgttaaagacttacccctgattagacagatctactcaaaaaacctactgtattcctcttctatgcgaaacatgctgggtgaccaagagatacataacctattaaagccttgagaaggaacagattcagtcagaggggatgtagtaagttaaaatggtgttatccactcactagatgtatgacctatttctgataaatacatcaaaatactactttctacatcaaaatacaact

SEQ ID NO: 251577 - DNA, 404 bp, Homo sapiens
ttttaaattaaaatgtcaagctataaaattttatatggagtaagatctcatcttggttggaagaaaaacacattctggaggaactaaaaataaaagctagaatgtgaaataatacctgtggctgaaaagaagctcttttgacccaggatcctggtcctctgcataacagtcaagaccattctcatttgcctgaaagtgttttagagaagaaagagaaattcaggaccaatcagcaattcccttttccactcttatgaagaaagaaaaaggatttgtgttatttgagatttaagttacttccttttttcctatgacaggttttggtaaatgcccagctccaataatacgttaacattttcagagtcaatctgggttataagtaaataaactccattttgatcttg

SEQ ID NO: 251578 - DNA, 531 bp, Homo sapiens
actgggaagcagaccaagaatgcagaacttctcaggatccctgatctctctctctcaggttagtcacaccaccatatatgagcatttccagctgcaggcggccaggctcaaagaagagatgccagaaaactctgacgctgggttgaggttgagagtgcggtaatcggcgtcacggggtgtcctcctggtgtcatgacgatgctccgctgatttgcatgtacataatgagatatcttggggataagacccaatctaaacacaaaatttgttgatgtttgagatacaccttatacatgtagcctgaaggtaatttcatccaacatgttaaaataattttgtgcatggaacaaagttttcactatgttttgactgcaacccatcacatgaggtcaggtgtggaattttccacacgtggcttcagggcagtgctcaaaaagttttggattttgaagcatttcggattttggattgtcagatcagggagggccaacctgtgcttaacaaaataaaacaaaatgccaaagtgagaaa

SEQ ID NO: 251579 - DNA, 751 bp, Homo sapiens
gtccatttaatcttttcctattgcccattttttttacagtaagcatgtcgctttggtaactgaggaaaagaacatacataattaatttttgcttctttttaagaacagatgactggagcctctgacaaaaatctcctcattaaaatactctatttctcaagttgggtgaatgtggctttttaaattttgttgaggaagtgtcttgctcctatctgtgcctcttgtttacatttagaactcacctggagaacacctgctcaggcacatgcacacaagcacacacacatttactcactgtcactccttcctttaatcgtggaaatggccaaacaagtaatccaggctcccgccacatggcactgggagtaagccagctgatcacacccccattttatggtgaactgtccctagtgctgggctccgggcattcagcactcagatcaaaccatcatctttaaacaaaaccaccgcccttggaaatgtcagatgcctctgaactcaacacctgatggaagctggggtgggcaggagagaggaagggttaagaagtgaatggagaaatgaggactcaaaaagattataggagtcaactgcactgcattccatatacttacaccttggagagcaggttgcattgttgagggccattgccatacaccaagtccatgggtttatcatcatggtggtggggggcatactgactcttccatgctctcccacgtggcatctctctgtataattaccaacctat

SEQ ID NO: 251580 - DNA, 761 bp, Homo sapiens
atcccctggctgtacatagtattgatgtctgccttctgccaggctgtcggacatacttctggtgggcactgtgcggaaacttgaggatgaaatcagtgagctgcatgcacttgaaaggcatggcctgtctcctcacttgagtgcaaggtccatcgaccaaagccctgttctgatcaatactcatgtacagccagctggctgtacatgagtattgatgaaagatatgagcccacagataaagaaggcacattatatattaaacaggataaacagctctacacaagattacaaaagcctactcaaatacatcaaaaatcacactaaacagaaacagaacaaactttacagctgaaagattgaggttgtcaaaaaggatgaagaaataaacctcctagtgatttgctatttaatagaggcatgcctatgataaataatagaaaagggttagaagtaaaaggatagaaaaaataccaacactacctaaaagagacttgaactataaaaatgccacttcaaaatattagcaacttgttacggttatataaatgtactgaatagcaacataattgaataaattttctatttttctatttttatttttattctatcatttgacatcaaattaggaagttgaatcaatcacttaattttattttattattattattatttttttttagagactgggtctcactctgtcacccaggctggagtgccaaggcatgatcattactcattgcagcctcaaactcccggcctca

SEQ ID NO: 251581 - DNA, 218 bp, Homo sapiens
agaagctgaaatttgtgaacttttatgactaattttctatttttctatttttatttttattctatcatttgacatcaaattaggaagttgaatcaatcacttaattttattttattattattattatttttttttagagactgggtctcactctgtcacccaggctggagtgccaaggcatgatcattactcattgcagcctcaaactcccggcctca

SEQ ID NO: 251582 - DNA, 241 bp, Homo sapiens
tttgttttgttttttttttcaggagtggggatatgttctacgctatcgccataccctttttgcaaagtgttagtccagccaccttgagagcaaagtacttggccacaggagttaaattcgtttcttcattgataccaattggcaaatgatatgagacatgaattgtcttttttctttcttttttggggggtggggacggcacgtccgcagaccattttgacaagcaaaaaaaacacttctg

SEQ ID NO: 251583 - DNA, 184 bp, Homo sapiens
agggtttgtttgtttgtttgtagacaatttattgtctctaggagaaagccccatttcttgaatttcttcccatttggatcagagaataatattttgagatctttacagcagtgttttccaaattgaaaaatacaacttataaatcggttgtgatattgatttgataggcctagacaaccaatta

SEQ ID NO: 251584 - DNA, 814 bp, Homo sapiens
aggtcgagcgcaggccgaaagctgttcaccgttttctcgactccggggaacatggtgggatttcctttctgcgccgggtcgggagttgtaaaacctcggccacattaagatctgaaaactgtgatgcgtcctttctgcagcgacgcctctttctgaatctgcccggagcttcgagccccggcgtctgtccctcagcctggcatggcttcttcgggggtctgctttgcatggggagaggggccacgcagcggcggactaggtttggggattctcggtaatggacccggagcaatgactaacagccgctccctctcactttcccacagcgatcaccctctaacaccctccctcccattcccggccccgcgcgtgacaaggtcggctgctttcagccgggagctagatcggtggcccggctcttcggagccttagcaggcgttcgccaaggggtgactggctgtcattgggagcaatatttggccttgaggagaccctggggaggaagtggcggggagctcgtgtttgcttgtgtgtgtgtgggggggggtgtgtgtgtacacgcgcgtgggcagggtccctctgcgctttcctttttaagtgcctctcggtggtgaggctttgggcgggtgagactttcccgacctcgctcccggccccacttaagccgggttcgagctgggagacgcagtcccttcagtgcgccccaaatcctctggcttcaggtggcccggcgcgggggcccagcacgacgcaccgcgccgagaaccgggttctccgtgcgctgcgccagtagccctgggagcgcggcggccgc

SEQ ID NO: 251585 - DNA, 392 bp, Homo sapiens
ttatagtatcttttgtcatgtggaaatttaaaattctgatgtaatcaaattaattaactttgtgccttatgatttgtgtattttttatcttctttaagaaatactttatcttaggccaggcgtggtggctcacgcctgtaatcccagcactttgggaggccgaagtgggtggatcccctgaggtcaggagttcgagaccagcctggccaacatggcgaaaccccatctctactaaagatacaaaaattagctgggcatggtggtgggcgcctgtaatcccagctactgaggaggctgaggctagagaatcgcttgaacccaggaggtagaggttgcagtgagccgagatcacactccagcctgggtgacaagagtgaaactctatctcaaaa

SEQ ID NO: 251586 - DNA, 393 bp, Homo sapiens
caaagccttgtattgctgatgctaataacataatattcagcgactcacagagatggaaaggatgttagaagtcattaaactcaacctctaagcctcactcttccaaccccagtggtgttaggaaagtttataatgttgtgggtggtgaatggaacataatgagcagtttataatagatgttcagtaaagaagtcagaatagtgattgttaatgttaaagtggactatgtccacaagagaaggatcagtacagtaagaggactaaaaccaggaactgtgatggtgagtgcagaggagaaacattttagaaggtggaacatgatacatgtcattaactctctggacagctatcatgtagtgcaataattgttttttttatgtagtgctaagaaca

SEQ ID NO: 251587 - DNA, 443 bp, Homo sapiens
attctgctcagagaattgcttctcaccttggaagctcctagctcatgtaattgtgtgttatgaactagacatttctgaaaagcacaagtattgtgctactcatcgttttatggcaaaatcaattaattaacagatattttttgagcaggtgttaagtatttcaatattggtaactctaccagccatgggaggtatacaaagaaaatgtaaaacctggaccttggcctcgaaacttggcagctggtggtagaggaaaggagaacacacagaagatcatcagagagcaatacccaacccttccatcactgtcggggaaagccatgcacccccttgtgatgtctccttctgcttgtgacttttggttcaggtgactcccagatagattggaagtaaggcctgcactccagcctgggcaacagagcaaaactccatctcaaaaaaga

SEQ ID NO: 251588 - DNA, 592 bp, Homo sapiens
tcagtatttggggaaggtggtttgagcagtatttattgacaatttcattagtggggatgtttctattaaaaacacatagtaagatcattaagtgttcttgcaatataaagtaataataccaccagtgtttatcttactgttttcgtgttctaaatgcatgcacctgagtaaaaggatctgggctgcagtctaggctgagagatgccagcaaaggctgcctaggccagtgcagtccagtaaatccctctttaatcttctcttccacacagacagcagtgatgagcatgcccacgaacccacatgattattttgggaaaaatgaaagagttgtattctttttgtggtagtaattccacttccaggggcaaatacattttgattattttatcacctttcagtgagttgtttttgttctttaaccaaggatgtatgtttgaggtaagaagtaaagcataaagtatatgattttttgtgtgtatttttatcttgctatacccatagggaatgtttaattctgccttggaagtggccatatttgaaggtgctgtgattcaaactgtcagcgagataaggcagcagatcaagaaagcac

SEQ ID NO: 251589 - DNA, 252 bp, Homo sapiens
tttttcaaaagcgacataagaatagtctctgaatcattaagttaattaagagaattttttaaaattacataaacctactagcaaatgctagtagcaatggctcatgcctataatcccaacagagcttttctttttaccttgtatccttctgtactctttgaatattttgccatgaatgtgtatttcttttataatattaaaaacagttaactaaaatgaataaatacatttccctgatctgatttattctat

SEQ ID NO: 251590 - DNA, 420 bp, Homo sapiens
aaatctataatttctttaatcattgtgatcaatgtgaatcatggcatgattaatgtggccggggtaataggtaatggttaaacagataatcaaaatatttggatagtgataactcactatacagcagtgtttctcaaccagcgacaattttgtccccccaggggacatttggcaatgtctggagacgtttttagtcatcacaactcttatctactgggtagagaccaggaatgctgctaaacatcctgcactacagaggacagcaccctacaacagaaaattggcccaaagtgttaatagttccaaggttgaaaaatcctggtgtagagaatggataacacgtataatgatattgacattttaaaaagtttggtgactaccaaaatatagatagctctgtagtgtcgttaatctagatga

SEQ ID NO: 251591 - DNA, 524 bp, Homo sapiens
aatggataaagtaaaaacagacttggcttacatggtaagagactgtaatatatatttcagtaaaatctccagattgaaaatcagtaagtctgagaacaggagcctcaatggaacatgaacaggcctaggctcttttcctgaactataatcgtttaaacacacatccagatccagggcacgcagcacgggccttggcagcaggagggcaaataagagattagcatttagccaaacgcaacatatgtttcggatagattcagtgtaatttgtctatttacagtgactgtctttttcccagaggaaaaatcagtgggctctgtccatgtttgtttctaaacattttaaacacaaaatgttcccgactctgctttgcttgaggtcctttcttaatgacaacactggcatcagtcacagattcacaaccatgggtgcaggtaaaaacgccttttctggacagagatgaaagagcatgattgctggtttgcttaatcccttttgctgctaattaaatcagtacccagaca

SEQ ID NO: 251592 - DNA, 539 bp, Homo sapiens
accagcattgttacctctttctgtggctcccttctttgtgctcttaaaaaggccgacatctggctagtctttaaaggagaaagctactgtgctgggacttgtctttcagcaatatcataggttaaacaaatgccttccatttatttcagtttacttcaatcccaccactcatgctaccaacaattgctctggacttcatactttggaactttctttccactacagttgatagcgtttattacacttttcagcttggacatctcagatgttctgatattttacattgggttttttgtttttgattttgttttttcaaatcttgctctaaccacgtaacctgataaaatgtttctcaatggttctaaccactttctagcaactaagaattttaatactgtaattattactatgaaggatcctgagttttcctttacagccttgaatttacatggttaagattttaatttgacgaaaacagaaaaaaaatgtgcctttgcaaccagtcaggtgataaagtgtgattcaggaagtaattttgt

SEQ ID NO: 251593 - DNA, 347 bp, Homo sapiens
cagggcagcctggcagggaccctgggaggtgctggtgggcaagctggcctgcaaaacagacatgctgcaggccctgttctctccccagcagttagctggggccagagtctctcagagggagacaggcagccttgaggagtaggcacttatggccagtctctgccagagctgccccaaagtcaaaggtccctagctctgagcttgctttaactccatctctgtcgaatctctggggagatccccctgccacttcacacatctgtgggagtgtggggtcccctgtagcagctaagatcctagaggtacatggcgagagtgccttttggggccaggaaccagccatagca

SEQ ID NO: 251594 - DNA, 228 bp, Homo sapiens
ggtgcgacagagtttcagttcagtaagacaaaatgggagtgctggatttaggtatagctgatgaactgaaactctaagcctgttgcaaacccattaatgagaggaactatagaaccaatgtgtaggaagaaggatataaagccaaaagaagcagttaaaatgacacaattctatcagtggtttgttgggtttttttaaaccttaaattcatgtattaaactctaagaa

SEQ ID NO: 251595 - DNA, 459 bp, Homo sapiens
ccagctactcagcaggctgaggtgggaggatcacttgagtccaggaagtcaaggctacagtgagccaagatcacgccactgcactccagcctgggtgacaggacactttgtctaaaaaaaagaaagaaaaaaaaaagtgtgtaaaaaaaaatactggtaatcattttgagatctttagttattacttagtgatatgttccaaaactggagctgagactccaaagagattcctgtaattgaaatattacactttaatactggagttgccctctctataaagcactgacaacattagcatttattttaaataatagcaatatccctggaaaagcagcaggacccagagtgaccactaagccttagtgataataaatggcatctcataactggatgcaacagttatctctaatgaagcctaggatcagatttgtggcataccaacagcacatgtgaaagtca

SEQ ID NO: 251596 - DNA, 571 bp, Homo sapiens
atttggtcacaagatagaatcagtaacgttaggaaggggtggtccactaaatactttcgctttttatctccctgctttctgtatcatctcatcaatcatacacaccagctaatatccccaaaatacagaattacctgtatcatgccatctttctacttgataatgagtcttaaaatgtttctgttgcctgcaggactaggttcacagtttccaaggcctttcactatctggcccctttctgttcattaggccttatcttttattttttgcttttgtgaatgttttccaggctagttttttcactggtactttaaaacttactcaaaagtgtagagatctgagatgtctggtattcctttactcctgttactcctctgttttgagtaccttctctttgtttctacccatgtcttaccaatccttagtgagtaatcttaaatcccacctcttctatgattctcaataacataaggtaatgtcaacttaaaaaaaaacttcctaaatatttttatgtcttttattatctgttatgtaagcttaagattcctaaaattaatgacagatctctttt

SEQ ID NO: 251597 - DNA, 534 bp, Homo sapiens
cagagatcccagaaattatgtaactgcagttcttcatttcctcttccagcatttctaaactttagcctgtaatttaaatttagcatgaatgtttcaaaaggcaacataagttagtatcatggccccacttgcttgcatatgcttgcagtttatgacttttgacactgctattgaatacggtgtggctgtgtcttaaatcatgttagcttgtcaatcaacaattaaattacttcattcagaaaatcagctcatgatagaatgcccagatgttgttgtcagcatctggaatagtgtaagtatgcagtggaggaaatctcatcctttaaagtcttttgatacgtaaaataaaataactccatagactctacttgaaataatcaaaatatcaaaatgtttattattttctttgttaatgatttataaatacactatacaccccactggaaaatgttactctgataaataaatgttttgcaatagatgcttcatttgtattttaaaataaactactgcaacaaagtatataagtgtata

SEQ ID NO: 251598 - DNA, 558 bp, Homo sapiens
gcagttcaaagctgtgttttgtttgagggtcagttttatttttatataaagctctagaaactaccaactaatctataatgacaggaaacagatgagtggttgcctgtggattgggcagggtgaggaagggcgagatgtaaggattacaaaggggcacaaagtacttttggggtgatgaatatattcattgttttgaatgtagtggtggtgttagtatacatagtcaaaacttgtcaaattgtaaacatcaaacatacgtagtttattatatgtcagttatacctcaataaagctgcttaaaaaataaaaggctaatatcctacttaatgttgaaaaactattggtatgataaagaaccaaatggaatttatagaaataagaaatgaaattgggccatgctcagtggctcatgcttcagtctcccaaagtgtgattacaggtgtgagccaccatgcctggcaaggcattcttttttattaggggggtgttgtttattacctcttctatagaaaagtaaagacattaaaatgtaagatgcataataaaaatctaagtgga

SEQ ID NO: 251599 - DNA, 765 bp, Homo sapiens
  misc_feature (715)..(715): n is a, c, g, or t
taccagggaggctgaggcaggagaattgcttgaacctgggaggcagaggccgcagtgagccgagctcatcccattgcacttcagcctgggcaacaagagcaaaactccatctcaaaaaaaaaaaaaaaaaaaaaaaaaaagaactgataaaccagttcagcagggttgcatggtatgagatcaatatgcaaaaattgtttttctgtattctagcaataaacaacctaaaaattaaattaagaagaccgttctatttacaatagcatctggaagagtaaaatacttaggaataaatttagcaaaagaaattcaagacttgtaaagtataaactgtaaaacattattgaaagaaagaagacctaaataaatggaaagatgtctcatgttcatggattgtaagacttactattgttaaagatggcaatacaccccaaattgacctacagatttaacacaatctctatcaaaacctcagctgcttttttttatagaaaatgacaaatctaataaaatttctcacggaaatgtgggagacccagaatagccaaaacaatcttgaaaaggaacaaagctagagggctacaacttccaattgaagcagtactacagagctacagtaatcaagactgtgttgtgctggcataaagataaacatacaggtcaatggaatacactgagatgccagaaaaaaaaaagcactacatttatgttcaantgacaactcattggggaaaagatttgccctttccaagatggtgcttggaa

SEQ ID NO: 251600 - DNA, 434 bp, Homo sapiens
cgagtccttggaggcccttccagttctgccagtcacatgttcccaaacatttgtactccgtggttcattctcagacaaaacctcaacccaaactctggcatataaaattgcaagccaggcactgactcacacctgtaatcccagcaactaaggaggccgaagcgggaggttcatttgacgccaggagcttgagaccagcctgggcaacatagtgagaccccccatctctacaaaaatttaaaaattagccaggcgtgatggcttgcacctgtagtcgcagctgctctggaggctaacgtgggaggatcactgaagtccagaagtttgagggtgcactgacctatgatcatgccactgtactgcagcctgggcaacagagtgagacccccaactctaaaaacaaaataaaataaaattgcccattccccaggcct

SEQ ID NO: 251601 - DNA, 474 bp, Homo sapiens
agccacaactttcgtgcattcccacatgcatatggataaactttgtttattttcctgcgaatatgtcagtttcagtttagttcacatgtccgcaaacactgaacttaagagggtagagacaaagtttttcttcctcagtagaacacatacagaagtgccagtacttaacagttcaagtgctgagactaaattctcacctggaggctgggcatgatgtggctcagacctctaatcctagcactttgggaggctagtgctgatcccttgagctcaggagtttgagataagcttgggcaaccccggcgagagccatgatgaaaccctgtctctacaaaaaaattaaaaaattagctgggagtggtggtctgcacctgtggtcccagttacctgggaggctgcgggccaggtggaggtctcagtaagctgagatcgcgccactgcactccagcctgggtgacagtgagaccctgtctc

SEQ ID NO: 251602 - DNA, 426 bp, Homo sapiens
agggatggagacagatcagtgggaagagaattgagagtccacaaatgctatgggttgaatgtcccacccaaaactcaatgttgaaatttaattgccatggtaatggcatgaaaggttgagacccttaaaatggccatgaaggggctggtcgtggtggctcacacctgtaatctcagcactctgggaggccgaggcgggtggatcacctgaggtcacgagttcaataccagcctggccaacatggcaaaaccccgtctctactaaaattacaaaaattagccgggtgtagtggcacacacctgtaatcccagctacttgggaggctgaggcaggagaattgctccaacccaggaggcagaggtttgcagtgagccaggatcgtgctactgcactccagcctgggagacagaatgagactctatctca

SEQ ID NO: 251603 - DNA, 459 bp, Homo sapiens
tagtttatatctttgttcaaagatgaccttagcaggagacctttttttttttggagttgatcggtaggtcaagccatgtgctaacctggcttgtctgggtatgtctgggaagcagagcaggaccaaggctgcagggcctttatggaatttctgtgctaggaagggagatagacatttaacacaaatatctctatatcttgacatttgcgatatggcaggaaagtacaggcacctatgggactataaaactgatcctaaaacaagcaggcatgaggaggtagtgaggtcacctctaggaatgcctcctcaatggaaacatttgcactgaaccttgaagattaggtagatgagccagtgcttttgcacaccttgttccatgaaagcaagactgtttttttactgttgtattccccagtgtctgcttccttgtaggtgatcaataaagatttcttgaataaa

SEQ ID NO: 251604 - DNA, 245 bp, Homo sapiens
caggcaaaaaccacccagccaagctctgttgaccaacagaatcatgagagataataagaaataacaattatgtaatgccactaagcttcaagatgacttgttcagcagtaagagataactagaacagtgtccctccccttttataacctgtgtttttagatttcaaaaagaaaattctagatttatttcttccaggaaatcataatgctaagtagcaaatactatgacgtagtaagagataacta

SEQ ID NO: 251605 - DNA, 393 bp, Homo sapiens
aattgatgcaccaaacttcatggttgtcttatttttagaaattgtcacagccactccagtcttcaaccaccactaccctaatcagtcatcagtcatctacatggaggcaggaccctccaccagcaaaaagattacaattgcattgttatgtttgttcgcatttttttttgcaatgcagcattttaaaattttgtgtacatttttagacataatgctattgcagttaatagattataatatagtgtaaacataacttttatatgctttattgcaatttttgctttatggtggtggtctggaactgaatacacaatatctctgaggtatctctgtatacagttgagagttgcatataaatataagaataaaattatgttttgtactattttataa

SEQ ID NO: 251606 - DNA, 1120 bp, Homo sapiens
cagcgcttaggattactcaaaaaccaccaatttcgtactactcttcattagctatataaaaataatctatgtcttagattcgtgcttgacttcacattcttagaagtaactaaaggactttacattctcttctttgatttaggttctgtataattttagatcactcagcttagtcaagtttgaacaaaataataaaatggtttggccaaattttataggcacacaactcaaaatgcaaaaagcagtgaagaatgtaaccatctccaccttcaatacggggcaatgctgttccctgctcccctcaactgtactgccggtactcaccaaacagcactatggatatgaaaaccttagactttaccacaatgcttccaaatctgctgacttggaataaacataataaatcagtacacttccacgagaagaattactattgtagtgttaggaaaactagcaatttaactaaacagcatcaagttacaaaccaggaaagtgatttaaaactaaatgctggcttatctttctgaaacaaagcatctaaatttgacagtccaaaatggcacttattgaggtaatccgtgaggggcctcacggcttacccaagacaagtaaaactgctagtgttgaagaggctagcagttaggtgacaggaaagggtaggttttggtgggatggaatctggaggttaaatgaacagaaaagtcacaagggtcccgagattccagtcaagagacctacagtggactagtgtatcacaggagtaggtaagacttagacagtttggacccagctgggtaaatgaaacccctgtcagttgcatctgtttaaactaagtgcatttgatgaagaaagctttcactggggattgctttgcagctgcaggaatgaacaaaagaacagaaacagttaaaagacacaactgtggtcagtgaaactgctgcttaattgccaatgcttgagaaaaaggaaaaagaaaaaactcccggagagttggtaatatgcttgttagcatattcagatttcaattaaagccaaatagccctctgtagtctgaatgctctggcctgctaggctgcaaacaatatctctctaagtagagagcgagagcggcagacgtgtg

SEQ ID NO: 251607 - DNA, 791 bp, Homo sapiens
gcaagactccatcgcattaccactactaccactactactaaactaaccattaacccaccaaatgatagcactacacacctaccagctaataaagaattcctttgttttaataacagctttattgagatacagttcaaataccatacaatttattcatataaagtataaaactcaatggcttttaatatattcacagttgtgcaaccatccattttagaacatttttattcactcccctaagaaattcatacccattagctgtcacttctcatttcctcccaacccctccaaccctagacaatcactaacctactttctgtctctatagatttacctattctggacatttcataagtggaagataatttcttttccaaaatattagtcattttgggaaaactttttcttaattaacacccagtttttcctttttaaacagattataagaatcccaagttaaccattcttgatactcaatgttcatcactataaataacaaatacaaaaatactataatgaggtgatatccttatgggcttttgagatctgtcaggtggtttgagttttgattgccccaggatgtggtgcctaaaaactagaaaacagaaagaaatgtccttcctataattctaatagctcttttctctgtaggcagctgtcactctttactcccatcacctaagttctgcggtataatcacaatatataacttcttgaagttgcttatgaaaagactttacctttttatgaattaaatttcactggttcggtttgacacatagacttaatga

SEQ ID NO: 251608 - DNA, 1337 bp, Homo sapiens
atggaggttgcagtgagctgagatctcaccactgtactccagcctggtgacacagcaagactctgtctcaaaaaaaaaaaaaaaaattaaaaccattttaggaacatggaatatttcaactgagaattttcttaaaaattagtccagtgtagtagaaaaaaccacaacttcagagctaggaaacttggtttcaaattctgggactctaccatttaatagcttggacaagtcagataactttctggagcctcagtttctcatctgtaaagtgaggattatactaatatctccctcacaggactatactaatttgttgtgaggagttaatgaaataacatgggaaagcacccagcagaagagttgacacttattaaacactcaataaatattttttgaatctgagtggcaaaaaaaaaaaaaaaatgtagaacacatgtttgcatgggttgaagcctaaaagcaaacacctaaatatattattggtaaaagtgggaatattctcacttattttggtttttatctctttctgtgtgcctgaagggaaatggctttgtcatctttcctagcccaggtttctaatgggagggggtaaagaacacagtcctgtcattgtgctgaaacatgtaaccacacacagcaaataggtttggagtatggtgtggttgttgaggtgacatttattattgagagacaatgaagaatggtgtcttgttgcttcatcacagctactgaactcacagactgcctgcttgccagagcctttgactcctcagggggtggagcaaaagatttctttcctggatggagcagtcagtctatggtcagtgtaagagttgctgtagcaacctcacagctgtgctctgtctagcagaaacttggtatgatttcacggattttgttcacttaagtaaaaaacagatttgtttggtttttatgtaattagaaattgaaataatggaattggaattttctagccaaggcaggtctcaattttgatgaaactgaagccagaaagttccagtgtttgaagcagcaggtattgtgactatattctgatactggaaatgggagttggaatcctgaattaactgtacttgggtggatcattggcaacccagccatttttattaggttgtagataaagacaggagggtcagagggaaatgttcagttttcaacaatgtaagattaaagtgggagatacttagtacatagtaagttaactggctgggataatgtagataatgtacttgaaaattatttttgagcttttttggtagctttcttactttattcctttttttctatacctgccagtagatgtgagagcttttctt

SEQ ID NO: 251609 - DNA, 1364 bp, Homo sapiens
atggaggttgcagtgagctgagatctcaccactgtactccagcctggtgacacagcaagactctgtctcaaaaaaaaaaaaaaaaattaaaaccattttaggaacatggaatatttcaactgagaattttcttaaaaattagtccagtgtagtagaaaaaaccacaacttcagagctaggaaacttggtttcaaattctgggactctaccatttaatagcttggacaagtcagataactttctggagcctcagtttctcatctgtaaagtgaggattatactaatatctccctcacaggactatactaatttgttgtgaggagttaatgaaataacatgggaaagcacccagcagaagagttgacacttattaaacactcaataaatattttttgaatctgagtggcaaaaaaaaaaaaaaaatgtagaacacatgtttgcatgggttgaagcctaaaagcaaacacctaaatatattattggtaaaagtgggaatattctcacttattttggtttttatctctttctgtgtgcctgaagggaaatggctttgtcatctttcctagcccaggtttctaatgggagggggtaaagaacacagtcctgtcattgtgctgaaacatgtaaccacacacagcaaataggtttggagtatggtgtggttgttgaggtgacatttattattgagagacaatgaagaatggtgtcttgttgcttcatcacagctactgaactcacagactgcctgcttgccagagcctttgactcctcagggggtggagcaaaagatttctttcctggatggagcagtcagtctatggtcagtgtaagagttgctgtagcaacctcacagctgtgctctgtctagcagaaacttgggatacagaaaaacagcaaatacaaatcatggatgaaatttataagatcacttccacagaaagggtccagctgttggagaaaaaactggctgtgcaactgactgaactgaagtctgagatagaagagcagggagctcttcagggaacagctaatcgagtttacagctctattcaaatgccaaaggatatttattactttagaagagagagggaactagcactgaagaaaaccttacaggtggccgagtcgaagccccttgttgttcaggcagatgccgtgcagagggagctagagagctgcctaagaagggagtacacccctgaaaatttacctttgcttctgttgcagtattacacagagagaattgcccagctggcccagagtaaatatttacacatgcttaggtggaagaggttttgccaacacagtaagatcatggagcaactttatcctctttacaagaaacaagttggctacattatgca

SEQ ID NO: 251610 - DNA, 641 bp, Homo sapiens
gttgtcctccattactgaaagaagcagtacagccggctaatggatggagacacaggggagagattttctttgtgggagttcattacagaggcatctgcagacctctaactctctcctgcatgccctttctctttcatagcttccatctctaagctgtaatggatgcaaaattactgcagcattttgttctgccgggctgaccccattacgcatacaccacagtcataaagctctggcttagttactgtttgcatgttcaagactactctgaggcagggaggtgtgaagtttggctacattttcaaacagagtggatgccttcttcattttaaaaacaaggaatccagcctcctttcagagtgaatattgttttgattactgctggactaatccatacttatttaccccttaatgatgatgtttctctggtgtgtgaagggtctttaaataaatgttagggcagtgatgccaggaagtcatcatttcacatgcattagttgcagaagtttgggagacttcatttccaccccaacatcctgttgtcttgataatattttattaagacatagcaaaagatatagcagggtcgttagataatggttaataaaatataagagtttggaaaggtagtgattctcaaa

SEQ ID NO: 251611 - DNA, 380 bp, Homo sapiens
ctcaaaaaaaaaaaaaaaaaaaagaatttttctaagcccgcattgaagtttatactgtagaatatccatcaaacttgagctgatttcttatcaaagacccaggttgcacagataggggttagaagtttggattcggttttgcattttcagtatttaaagtcttgtttcatcttgttcattcttacctttcctttgattgtattagtagctcaggacaaataagaatttataattttccaaggaactaaggttgctgttgaggaatatgggtttcagagacaagagtttaggcactggctcattggtactaagcttcaggggtttgtagtgttgttagagctaattggattttacaaataagccaagattattaaaaaaaa

SEQ ID NO: 251612 - DNA, 722 bp, Homo sapiens
catccaggagcaccctggcctgtccagccgttcaggtgaccttgctgtctctgtgcagatggacccaaggcttccagtgctccctttcctccacactgtatagagaatgggcaagtccctcctgctgacatcccagctcctaagcccgtgtcctagaacaccccacttgggcctgcagaaccctttctacttccctctcacagaatctcgtttgggttccttgtcctggtggaggcggtatgcgctcaaaacccaggttctaaagtcctgtgtgtgcgtgtgttaggcctcagtatcctcatctggaaaatgggtactttgcagatgaggaaacagaggcccagattagggatgtcacttgttcaaagtcacatggctgggaaatggtggtgctgggcttcagtcccaggcattatgactccagagcccaactatttaactcctgctctacagggtccctttaaaccacagcaacaattgctattgttcagtgatgggaaaatattggctaattcatactaaggtcttcatgattgctcgcaatccgtggagataaccaatctaaagggcaatacaattaactgagaacaatgctacagtgaaggactgggaggccaggcggggtgactcaagtctctaatcccagccaaggtcacaggattgagcccaggaggtcgatcacaccactgcatgcagcctgggtaacgaagcagtgtctcaaa

SEQ ID NO: 251613 - DNA, 491 bp, Homo sapiens
tggtggtgtgggcctgtagtcccaaatacttgcagggctgaggtgggaggatcacttgatcctgggagggggaggctgcagtgagccaaaattgcgccactgcactccgggctgggtgacagagcaagactgtctcagggaaaaaaacaaaaaagcatcagttttgttttcccttcctgggagacatctctcaaaccagggatattcttgaaaagagcatgagcaaggaaactgctggtgatattacaagtttctctccttatcttgcctgttgacttcaatagatttgagaataggctgaagagggaggaaaacttcagtgattgagattctagatgaaatatcaggactgactcctgataggattatggtccaggttaaccaaaaaccaattccttgaatgttgaaatctaactttttatattatctttattattgttataaaaacagttcttcatcttttctgttttatttttctaaaactgctttca

SEQ ID NO: 251614 - DNA, 567 bp, Homo sapiens
ccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcccgcactctgtgtataagctgatgctcagctgctgcagaagagatacgaagaaccgtccctcatccaagaatccaccttctgctcctcaacagcgacgagtgtgcccctatgcggg

SEQ ID NO: 251615 - DNA, 321 bp, Homo sapiens
ggcactgaaaaatggaagtctaattcacctgcctcgttttaaatatgagaaaactgagggtcgggaagctgcattgacttgcacaaggtcacacagccagtttggatgccttttagaaagctgaaggtcatgattcttgcaccatgtcccatcttcaaacttggtattccaattctcttatctgagataatttttgtataatcaaaacaacatgttaatatagttttgacccctaaactagtcttttaagtgaaacactaataaaaataactcaactaaaaaaatcaataaaaataatagtccattggctggatttcctca

SEQ ID NO: 251616 - DNA, 1217 bp, Homo sapiens
  misc_feature (988)..(988): n is a, c, g, or t
  misc_feature (1082)..(1082): n is a, c, g, or t
  misc_feature (1098)..(1098): n is a, c, g, or t
tcctacgggaaggtgaaggtgctggcaggtcttcagcaccccaatatgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagacttggtctggcctgcacagacatcctacagaagaacacagactggaccaacagaaacgggaagagaacaccaacacatacgtccagaagtgggtacttgtctggtacgcttcacccgaacagttggaaggatctgagtatgatgccaagtcagatatgtacagcttgggtgtggtcctgctagagctctttcagccgttggaacagaaatggagcgagcagaagttctaacaggttnaagaactggtcagttgcggaatccctccgtaaagggtcaggcaagccaagtatatccagcacttaacgagaaggactcatcgagagacatctgncattcagctgtggagngacttctccaaaattcctggaatggtaactcaccctacagatgagatatagagcagaaaaagaattgcgaactaaagagcgtaaactcttctcaaacaagggtgaggatgacgaaggat

SEQ ID NO: 251617 - DNA, 962 bp, Homo sapiens
  misc_feature (733)..(733): n is a, c, g, or t
  misc_feature (827)..(827): n is a, c, g, or t
  misc_feature (843)..(843): n is a, c, g, or t
tcaggtgttaaagaacccctacaacagccaaccttccctttgcagttgcaaaccaactctgctggtttctttgctggagtcacttgagccacgtgcatgaaccaaacccacttcgttcaagacaggtgtataagctactttgccagacgtttatcaaaatggggctgctgtcttctttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagacttggtctggcctgcacagacatcctacagaagaacacagactggaccaacagaaacgggaagagaacaccaacacatacgtccagaagtgggtacttgtctggtacgcttcacccgaacagttggaaggatctgagtatgatgccaagtcagatatgtacagcttgggtgtggtcctgctagagctctttcagccgttggaacagaaatggagcgagcagaagttctaacaggttnaagaactggtcagttgcggaatccctccgtaaagggtcaggcaagccaagtatatccagcacttaacgagaaggactcatcgagagacatctgncattcagctgtggagngacttctccaaaattcctggaatggtaactcaccctacagatgagatatagagcagaaaaagaattgcgaactaaagagcgtaaactcttctcaaacaagggtgaggatgacgaaggat

SEQ ID NO: 251618 - DNA, 751 bp, Homo sapiens
tcctacgggaaggtgaaggtgctggcaggtcttcagcaccccaatatgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagatggggtatgattttgctgaattttaaataaaatgaaaaccataaattacatgatgcttttattgccccttgccaactggcctaaataaaaagactttgc

SEQ ID NO: 251619 - DNA, 421 bp, Homo sapiens
gagaaaacactttgagccccagttttaggaagcagacaccccacttgtatgcatcagcctctcccttcagctgcatccctagaaacagatggatgtggcctcaaccggcacctctgtcccctccacccttggaacagagaatagtcttgtgtttcctaccgtgaaggcagagtgttctctctctttctaagaaagataataattgaagacacaatttaagaggactgtattgctaatacaatgaagaaaggaaatatctgttgtccgtatttgcgcaatcccagataaaaggaaagaggaagaatttttgttgtttgtttaactctggccccatgataataaaagtatttttaaaaggtgttctaatgttactttgttctatatggagctgtaaataaatgaaatgtaatattcttaaaaa

SEQ ID NO: 251620 - DNA, 968 bp, Homo sapiens
ggttttgttttggctctaggcacttcccactccaaaagccctctgttctaactcctgtgcatgctggttttatctgattttctcagtggccatagcaactttcttagttcaggccacctgcaacctccttctagtagcaatcacacccccagcagcctggaactagagtattctgccaaagcagaaaccctgtcactctactcacctatataatgattttctgtgaacttaggtatgaagttgaaaatcctcaacttgtcatacaaggctctttatgttgctcctgctttagtggccaccaatctaccaccccattcactctcccactcccaaccctacacatgcacaccctcttcacattcaatttcttctcctttctccctctccgctcagcaatactacattactttcaactttgcagaagtttcatgttgctgtgtctacaaatcttctgtacatacatgctttttatatatcctggaatcctctccccctaattcccacctgctgcatctctacctgctaagtccttcttatcttttaggtgtcagtgtagtctttactttttgggtctcttgtatgcttttgtaatctctggagctacttctgttacagtatgtatcacacactggacaggaatgatatttgcctgttttctggtctctcttactaggcctttggtctaggaattacagaaaccttatctgtcttgtttacttttgtttccccagggtccagcacatgtgtagcgatactacgcccggcggagtatcgcactccgaggtcaactccatgtcaaaggtgagggactcaaactgccctcctgctgagggttcagcaccttcaccattatttccaaactgcatcaatgaatctaaagtgcggggggacatcggcaggtcaatggtattgctgcaggtcgttggtgtcacacagataaacttggtcttcaggtattctcagccggg

SEQ ID NO: 251621 - DNA, 705 bp, Homo sapiens
  misc_feature (84)..(84): n is a, c, g, or t
tggtcctgataccaaagcttggcagagacacaacaaaaaaagagaattttagaccaatatccctgatgaacactgatgcaaaantcctcaataaaatactggcaaactgaatccagcagcacatcaaaaagcgtatccaccatgatcaagtgggcttcatccctgggatgcaagtctggttcaacatacacaaatcaataaacataatccatcagtgagagagaaccaatggcaaaaactacatgattatctctacctgctaagtccttcttatcttttaggtgtcagtgtagtctttactttttgggtctcttgtatgcttttgtaatctctggagctacttctgttacagtatgtatcacacactggacaggaatgatatttgcctgttttctggtctctcttactaggcctttggtctaggaattacagaaaccttatctgtcttgtttacttttgtttccccagggtccagcacatgtgtagcgatactacgcccggcggagtatcgcactccgaggtcaactccatgtcaaaggtgagggactcaaactgccctcctgctgagggttcagcaccttcaccattatttccaaactgcatcaatgaatctaaagtgcggggggacatcggcaggtcaatggtattgctgcaggtcgttggtgtcacacagataaacttggtcttcaggtattctcagccggg

SEQ ID NO: 251622 - DNA, 361 bp, Homo sapiens
tggcccttcccaacaccttgattttggacttctagcctcaaaattgggaggtccttaaaattggagaatctttcccagctttggtcaaagagagagatgtgactgtgggagaatgattagagatgcaacattgctggtctgaagatggaggacgggtccaggagaccaggaatgtgcacagcctctagaagctgaaaaaggcaaggaaattaacttcctcctagtatctccagaaaataatgcagtgactttagcccagtgagatccatgttggcattctaacctatagaattgtaagatgattgttttaagccactaatctgcagtaatttgtaacagcaacaattgaaaactaattgta

SEQ ID NO: 251623 - DNA, 497 bp, Homo sapiens
tctcattgtcgccctgccttctcagcttgaatcctaagttactggaatgcagagtttcacaagctagccccctgcccactctgggcctggcccttgtttggctctcaagtggggctacgtaaccaaaggaggtgacagcatgctacttggtcaggctgttacctctacatttctgaaatgtatggtttagggtttgtggttaagaaatacattatagttcacagcagtatgctatgatgtaggggctgggtttttgccaaattgcagtatatacaaatggagtatctcctctctactgtgtagagttccaaatagtacttcatttattgcgtagatatttcactgattcgtagaaaatgtaggattttccatttgccacagataggcactattcaccatagataatcaaatttctatgacaattgtcatacagtttatagtatttcatctaatacgctatttattgtaagaaataccattattacatgtactacaaa

SEQ ID NO: 251624 - DNA, 791 bp, Homo sapiens
cattgctttaattttaatgtttttactctaatttggacatctttttttttttagacagacgattgctctgtctcccaggctggagtgcagtggtgtgatctcggctccctgcagcctccacctcccaggttcaagcaattctctgcctcagcctcctgaggagctgggattacaggcgcctgccaccatgcctggccaatttttgtatttttagtagagatggagtttcaccatcttggccaggcaggtgttgaactcctgacctcatgatccacctgccttggcctcccaaagtgctgggattacagacatgagccaccgcgcccggccgacatcttcttattaaatttttattaaattaaatcttactaaattttattaaatataaaatcttttatcattagttttcaaatgtacaacaatgatttatttttcctgttttggccgtttcagaatacttgtagttttcctgaaaatttatgacttcttaaatattctctttcgacgtgtgcctgccccacctccttccccgcagctaattcctatacctctttggagaagtagcttagggatgcaggtggagcttggatcagtctacctgttagtcacatgctttacttgcatcccactattagctgttcatttatagaaaggggatggttgcagagtctgggcagggatgggtcagctgtggcactgtggtcctggagagtcataccctactcttggacaaaaatgtttctcttagcagagaactggagtgagcatattttttttactctgctttctct

SEQ ID NO: 251625 - DNA, 892 bp, Homo sapiens
acttgagatttagttttaactttagatataaatatctgagaatttgagtaccagttaacccattcaaaagataactagatttcaactgtgacccaaggaaaggttacataaacttactctctcctcccctcctcccgcttctttttttcttctctcttcctcttcctcccccttctctttttcttgtcctctgactcctcctcctccccgctctttcttgcctgaagatcaagggcttcgctagtgatgtgctcacccttaaccaacatgtacattatgaatctcctgaaagggtgtcgggaacgtgggaaacagctccctctgtccggtgaggactgaagaagtagtatttatacttatgtttttaaaagatgcagaaaaacatgctcctgcttttttccagagcaaagacataaagcaatgggtgtcatagaaacagtactggaatcagagacagattcctacttcgggctctatcacagactagctatgtggcatcttgggctagtatgggatgttcagtgctttatctttatctataactctgcttcattcgttcattcatataaaaaacatatgtggcgaacctagactgttctaggtgctatgctggcttctggggaatgtgaaggtaaaaacatcctaccttgatagagcaaagagtggatgggggggagggctcccacagggtcgataaatccagagataagcaaatttactatgatagtgggatgatatatatgctatgagacaggaggacgtgagtatctacaaaaacaaggaggagtgtctcctaacagggactggagaaccaaggttgcagtcagggaagtttttataagggaagagatgttggatggacaacatagaatgagactctgtttcaaaaaac

SEQ ID NO: 251626 - DNA, 435 bp, Homo sapiens
gacatttttcccctagcttttaacaacatgttcaaatattctcaatgcacagttgttaatgagtaattgccgttaaaatatatttcataagaagtctcaatctcaaactctccatctctcaatcctcctcctcctcctctttcttgctttctcttttccctctctctttctctcctccccttctctctttctgtctttcaaatgttcttttggctttaacattctattaattatattttttctagattgaatactgtgaatgctaagttttattaatctggtcatcttattttgattttaaaaattaggatgctagttgcattctgaattactgtttctggtttgaaacatggagaaaaacattttaataattcatatttcatgttggatggtttctaataataaatatctcaaaagtgacttaacataaaaaga

SEQ ID NO: 251627 - DNA, 400 bp, Homo sapiens
gggctgcctgatgacagagatggatgagacccagtcctgtgccttagctctgaatcttggagggaaacctgccaaactagccatgtaacctggggaagtcagctcacctttctacacctcggtttcttcttctgtaacatgaggatggtgacatccacctagactgttaccgcctagctctgctccactgcctggtgctggtttccattcttcccacctctcagacttcccctttactgagaacagctacttggatgctcaccgatggcagggatgatgaagaagatcataatgagctcgaacactggggcctcctgagacctcccgcctcctctctaaactctggcccccctcctcccacacactcccctcccctccaacctgatgctgaaattgctga

SEQ ID NO: 251628 - DNA, 704 bp, Homo sapiens
ctcctacactgctaccacttgagtagaatcctttaatcttttctatcctgaacaacagcaaatgcctctttatgggacttcttgctgccttcagcagctagactaataatgaaaagctttaagtgagatcatttaaatcctctgccaaatattctccaacaccttactaactcactgaaagtaggaaacaatcttctttccacaggcttcaaggccgcacaggatctgataccaccgacctgtctgattttccctccttttcttaccccttggttcactccccagctactttgcctctctgctactctttacggcatcaagtttaaaccttttccagaatcttttgcctaaaacgctcttctccagatatacactggcttcctggcttccttcaagtctgtacttaaatgttatccctcagagagtccattcctgaccaccctaaattaaatagacacatttctccttcatttttgttcatgtcacttgtaaattcctgaaatttcaccatatcctcgtttgtataagtctgttatccctatcatataaccagatgtagaaatgtacatactttgagaccatactctttattttgtatcattgctgtattaccagctcctaagaaggtacctggcattcaataagtacttgttgaataaatgactgaatcaataaattgatggcaacccagtcaaataataatt

SEQ ID NO: 251629 - DNA, 372 bp, Homo sapiens
ggtggagagtagcccttgatgagctgttgaaggtctacaaagcacgaatttaacgaccctttcttaaaaagtaaaaaacaaggctttccacgtatagatattcaaagcactcccccgcccatagcctccagatgcaagccatgaggactgagtacaatgcaagtaggaaggaacacgtgtgagggacagtggggccttcgtccttaagactgaaaaaaaatcacagaaatagaacaaaagtacagcccggctgggcggagtggctcaagcctgtagtcccagctactcggaaggctacggtggtaggattgctcttgagcccaggagttcgagaccagcttggataacatagaaaaccccatctctcctaaa

SEQ ID NO: 251630 - DNA, 448 bp, Homo sapiens
caaccccacctgatgctgggagaagaccactcatcaaaatcagtgactaagaaatgatacaagtgtagttactttttcttcctaaaagacatttcctgagttcctaaaattaatcaagtattccttattagtatgtttttttttttcagtttagacgtggcttctctttctctcaacaaacacatatttggaatcagatgtccacatatctaattctattgtattcattttggctgataaatgtatagagcataattttagaggtgggctgcacagaccatttattttatgttattacaccttacattctagatcaaagtagatctttaaatattttctatcattaaatgcttttacatgctgtaagtaaaataatacttaatggtcatttgtggggaaaaaataagaaagtaattaccaaaaataataataaatgcatagacttttg

SEQ ID NO: 251631 - DNA, 527 bp, Homo sapiens
gaagaactgctgaaattgagggcttggagaagatacagtaattatgtaaggtcaaatagttgtttagttccaaagcccatgctcattctgttgcaccaggaagtgacttggttaggaatgtgcaccaagatggatctgaaggcagatctgtatcagacagaaggactggggaagggaaagcagtaggtaaggtgctgtaatagtttaggtagaattctaggcaggaactaatacaaactgcattcagggtagaggaagtgggatgtgtaaggtattatggtagcatcagaggacttagcaatcgtctagatatggggactggatgctggggaagaatcagttgccaagtgttggtgactgggatgatgttgctccactaacaggtaaccaagaggaggggctttgggatggagaatgggcagagctgatttttggcttgaatacattacagttgagagatctatgagatattttgttggagatacccagcagctagctggaaaagtgaaacaggaacttgttaaaaa

SEQ ID NO: 251632 - DNA, 412 bp, Homo sapiens
ggttgtattaatagacatacagtagccataataaagaagataaacgttcccccatcttctataacctaaatgagaaaggaattggtgatggttagcctggagaaagaagggattggtggaagcacggtgacattagaacggcatcataaacatatctgtagcatgggacaactgacctgcctagaagacgactgggccaggagcatgacataatttcaagtcagttgaagaaaatagaaaaggaactgctgagtagacgtactggtccaagaacagtgaaagacatgtaaagcagatgtaaccccaaacaacagctgaagaagagttgcccaactccgccagcctagatcaaactgcagtcaaatgtacacccttgagcatgggaataaattcatgtttttgtaaatcaaag

SEQ ID NO: 251633 - DNA, 406 bp, Homo sapiens
tacagatttacagtgaagaagaagaatcaagtgtacatcccaatctgaactactgcattcaaagaaaaattaccactgctagccactctacaagaatagcacaggattggtggaagcacggtgacattagaacggcatcataaacatatctgtagcatgggacaactgacctgcctagaagacgactgggccaggagcatgacataatttcaagtcagttgaagaaaatagaaaaggaactgctgagtagacgtactggtccaagaacagtgaaagacatgtaaagcagatgtaaccccaaacaacagctgaagaagagttgcccaactccgccagcctagatcaaactgcagtcaaatgtacacccttgagcatgggaataaattcatgtttttgtaaatcaaag

SEQ ID NO: 251634 - DNA, 232 bp, Homo sapiens
tacagatttacagtgaagaagaagaatcaagtgtacatcccaatctgaactactgcattcaaagaaaaattaccactgctagccactctacaagaatagcacaagaacaagaaagtcacctaacttgaagacttggtgaccaaaactcatccagcaaagataaataacaaagaacaatattgctgattaatctcttcctaggatgtacaaagagaaaacacaaggaaaaaca

SEQ ID NO: 251635 - DNA, 565 bp, Homo sapiens
cttccttgcttgctgcttaggttatcacctggagcggaattacaggatgttttgttgtattgcttcctgcacttctgcaggcctttcactcttctgagcctgatagtgcctgctagagttggtggtaggaggaagagtggatttcttcctgagggcacctgctttctcctccaaggcaggaggactgaggggagggctgtgagactgtgaatgtgtgaatgaggggcccaccggctatcaggctgcagtgagctaatggtgacagttttctaggagaggggccagaggagaattgtttgctttaccctgtttttcactactggattttgacattttcttctaatgctgacccctcatccagctctttggcatgctgggttagtagctgccttttcctcagtgagtccctggggaaggagagggcttcttgtggctatctggaacccagcaggttcccgcacattctgagccctcgcccccagggagcccacttagtggctctgtgacccatgaagagcccaggagcccccagatgtggcttgctcaggacgggagtggcggccgc

SEQ ID NO: 251636 - DNA, 613 bp, Homo sapiens
tggggagcttgccaagaattcctcgggagcacaggactgcaggcacctcttgccaaccacaatacccctctccagctgtgtcacagacctccccctgcagatgcccgtgaatttgcacaaaacttgccgctgtttgagacggtgtgactgagcaatgttcttccatactaaatcttccctaaagctcttaaatttaaatctgtatagttggagaaggggtctgaatgaagcacgatatcagttctttatctggtcaactggatggatgctgagtaatgaacttgtgatatgttttattgtatataaagttatttaataatttatttgtaatagtttcatatttcttaattataatttctattttgtgttctgatgttaatagatatttgactattttagaaaaaagttttgcaatgtataaaataattatactttttgaaattttatatttatttcaatttttgataaatgttcaagtttttttgaatgccagtgaattttatttttaattctatgtaacattactgtcaaatatacaagttctaaagaaaaatgcaagctctaaaatgctccttaattacatcataattagacattttgctgaaatgaaagc

SEQ ID NO: 251637 - DNA, 129 bp, Homo sapiens
tgcagaatcctcattctcctcatccacgtgaccttctctggcattcgggcattggctgtacccttccgcttacctatgcccatatgcctgcccttccggcaggccaaggtgtttttccggcatcaagcg

SEQ ID NO: 251638 - DNA, 502 bp, Homo sapiens
tgagaaagtaatatgttgagagaggagtctttgtcctgccagatgttagaacattacacagctactgtaataaaaatatatagcattgctatgagaaagaatacataagagaaatggaatagacattccagaaatagatgcaagcatatttgggaacttaacacaggcttatctaatcttagggaaagccgccttcataaaaacagcaaactcaggaacctaaggaaaaaatgttcggattgaactgagtttatgtatatataaatactatatgtatataaaatatatatatagtattatgagcaaagttttttttaaagcctgagaaaacaaacttgggaaaaaatatttcagcgcatatccctaatgtacaaagagcgaataaagtgacaagtaatagaaaaatggacaaaaaattaatatatatcaagcaatccacagaaaaagaagtatcaatggcccaaaacatggaaagtatccacctccacctttcgctatagat

SEQ ID NO: 251639 - DNA, 235 bp, Homo sapiens
acgcacaccaagaaggctgactcaggtcacacacttagggtgagtgctggggtttgaatccagcctctagttcagcatttggtctcctctatgatgacacataaaccactacccttgcattgcttcaaatccatccagatgcagttcatagttcttacaaagaggaccagaccagctttctactgaagaagcttaacttttgtttttaagagatcacataatcttctctcttttt

SEQ ID NO: 251640 - DNA, 415 bp, Homo sapiens
acaagactggatgtctggcagtgaggcctgggaagctgtaagttgtaaaagccccatctcgggtggttctgatgaagtggtgggcttgggaatcctggggacaggagttgaagatgtgaagacatgcagcccaatggacagatagcccccagcggggagatcagagcttcgagatcagagcgtcaggtctgagtgaaagctgataaattgtttcttcacaagtgtgcttagaccccagcccaattccccttacgtgtttccccagaacacagatctgtggggttgggattcttccccaggcaggttgtggcagcaggcatcaatgtcagctcactatgaattttcctgagtcttgcaaaaatgaggaatgtgtagtaatgagcattttataaagcttaagtttattctctataaa

SEQ ID NO: 251641 - DNA, 440 bp, Homo sapiens
ggttttttttttaaatcatgggctattcaacatacaataatcaagctattttacaaatctgtgacctcagtcttaacagttttccaaggaatatactgttctttactgagtttttttttcatgacatctggaatacatttagatctttatgatattttgtgctcatttcttatcttgccagctgctaaggagcagaaattatcaaagaagatcaccgaactgacagacaactgtatttccacactcctgccctttgaaatctgccttctagtatgtgaggcaaccttcatcagcatgtagtagcatgtcggtgctggctagttactttccaagagggagataaacacctcaaaataagcaatgaaattgcttcaagtcagttttaaaatcgttagttttaataaaactaaaatgagaaagtgttttcacattaactgctg

SEQ ID NO: 251642 - DNA, 497 bp, Homo sapiens
cccagtccttgtccccatgccctagcttgcccctctgtgagtagggcaggggctggcatttctgaggatgacctcggtgacctcagcaagctgctccacccctagggtggctccattctcaacgtaatgggttagacctcgctggcacctcagccagctggagtgggtggcactaacctcccccagacaaataactgtccacagggtacctgccttacgagtcactccagggccactggttagtcactgacactgaagccactgcatcagccccctgatgaggacagggaagttgggcagagatggggacatacagggcccaagccacagccagccaggaggggttacactagggctcccccactttccctctgggcagagccctgggctgggggtgggtgtcactcctctgggcagttcctgattcctcactggtcaaatgttcagccacacgctcaggccctggggtgcctggcccagttccaagtgtgtgccgg

SEQ ID NO: 251643 - DNA, 301 bp, Homo sapiens
gagctggtgcaagattactgtggttcccaggaacctgtccaagacctccaaaccatctacactaaagaagataagcccaagaaggcagctaagcattggccctgtttctgttcctagcttctaactgcagattttactttggtgttggaatactttttcctttgttattcagtttttatcaggacctgcctcattacaggatcacacactttttaatgaatctgggttcatctatatcctgtttctttccttcttcatttcataaatgtttgcattaatacatattcattggacacttact

SEQ ID NO: 251644 - DNA, 445 bp, Homo sapiens
agggattccctggggcttcactatccctggggtgggggcaatggagacctcacagggcaagcactctccatcctgggggtcagtgggctggcacatccctgaggctcaagcgtggaggagaaacggacagaaacctgggcccggaggccttttgcccctgtgggtcctgagcaccgaattcggcttttgaggacagagtctggcgtgatttcagggagagaaaaacccctccccaaaacggcaggagtgctgcctaataaagccagctgctggaccagggaaaacagccctttgaaaaaaaaaagcctttcattagaaaaataatgcatttcatccaaataaggtaaaaatattcggaatggggcagaagtaagcagcaggcagcgcctgtcaggccctttctggaagggagaagattattaaactcaattacaatgtattttta

SEQ ID NO: 251645 - DNA, 447 bp, Homo sapiens
acagcacattgaaagcttctgctcttatgtctgcttctgttttgttgaacaaagtaagatacctggccaagctcaaagtcaatggaataggaaagtataattgtcctccaggggaagaaggaagggaattaatattttgtaaaaagttgaccagatcagctgggcgcggtggctcatgcctgtaatcccagcactttgggaggctgaggagggcaaatcatgaggtaaggagatcgagaccatcctggccaacatggtgaaaccccgtctattctaaaactacaaaaattagctgagcattgtggctgcgtgcctgtaatcccagctactcagtaggctgaggcaggagaatcgcttgaaccagagtgtcagaggttgcagtgagccaagatcgtgccactgcactccagcctggcaacagagcaagactctgtctcaaaaaaaaaa

SEQ ID NO: 251646 - DNA, 724 bp, Homo sapiens
ctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacgtgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgagtagcaattaggcgacttctaacatgtccagctttaaacctgtgacctcaaggcaaatgacttccacatctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaa

SEQ ID NO: 251647 - DNA, 549 bp, Homo sapiens
gtttcactatgttggccaggctggtctggaactcaagccagccacctgcctcggcctcctaaagtgtgggattacaggcgtgagccaccgtgcctggcctaaagcccttatcaaagtgtatactgtactgtacaaattcaggtattccattctttcatttattcaaaaaatattttaattcctactgttaacgtgtgcagtaaaagaagttcaaaaatgaaaaaaaaaaaaaaaaaaaaaaaaaaaaaaaaaaagataaaaaaaaaaaaatgaaaaatacgtgtctgacgttttacagcctatgaaagggggagaccttggcttaccgacagcttgtccctttgtacggattgacactttgcacaatgggcatgtttacataatggcccctacgttaggcccttcaaacttttttgggctcagtctgtgaaagggcacccatgtatcctccctttaatgtttaattcgcgtcgaaaacgtgtttaaattagtttatatcttaccatttaccgtattctgggacctccttttttccttgtggccctgttt

SEQ ID NO: 251648 - DNA, 400 bp, Homo sapiens
aatataatatcctgttcctggcctcttggagtggagcagatttgccaataacgtgaacactctaccatttttttttctttaagtacttaaaggttttggggccacctaggttccattaatgtattaccactcatattaaatgattatagtgtcaaaaatggtctggaaatttgtatagaccttcaaaatgctgtgttacatccacggtttgttctagaggttctctccttttctgggtaatattaacaaatgcttaagattcacattttggtaaagagatccatcagtgataaatgcccctgattttgaacccagaccaccctgctgttgaaattataagcagactttgtctccttccctaatcaatactgctgccttaaatttcccagtagccacttta

SEQ ID NO: 251649 - DNA, 352 bp, Homo sapiens
aataaatcttagccattacaaccctaagctgatcccatgagtccttctagcaaatctccaaacatggaggcagtcttgtggatccctgacacaaatatagtgttgtgatctcttaaggtttatccttcctcttaaactataaagagctggctgggcacagtggctcacgcttgtaatgccagcactttgggaggccgaggcgggtggatcacgaggtcaaaagattgagaccatcctagccaacatggcgaaaccccgtctctactaaaactacaaaaattagcagggcgtggtggcacacatctgtagtcccagctactcgggaggctgaggcaggagagtcgcttgaacc

SEQ ID NO: 251650 - DNA, 380 bp, Homo sapiens
gggtcctgtcgggggcggtgctgcccctctggagcgcgcttccgcaatataaaaagaaaatcacagacaggtgcttccaccactctgagtgctacagtggctgctgcctcatggacttggactccggtggagccttctgtgcccccagggccagaataaccatgatctgcttgccccagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtcaaa

SEQ ID NO: 251651 - DNA, 359 bp, Homo sapiens
gggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtcaaa

SEQ ID NO: 251652 - DNA, 773 bp, Homo sapiens
tgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacttgaagccagagttcactgtgagcattctgactatgaagtgagaagctaag

SEQ ID NO: 251653 - DNA, 250 bp, Homo sapiens
gaaaaataggagcctctgcatcttcactggaaaaccagatgatggcacttcatgtaggggtgaacaatagcgtaaggacatttcagaattctgatttgatcctgtatgccctatcattctaaacaaatgagacctgttctcttcaaatttcttattatttggtcttcccaccccaccccaagttacagccacagtgattagtttggtgtttgttcttccagattatctaataaatatactaatacgtatc

SEQ ID NO: 251654 - DNA, 893 bp, Homo sapiens
  misc_feature (330)..(330): n is a, c, g, or t
  misc_feature (351)..(351): n is a, c, g, or t
  misc_feature (401)..(401): n is a, c, g, or t
  misc_feature (403)..(403): n is a, c, g, or t
  misc_feature (422)..(422): n is a, c, g, or t
  misc_feature (434)..(434): n is a, c, g, or t
  misc_feature (444)..(444): n is a, c, g, or t
  misc_feature (490)..(490): n is a, c, g, or t
  misc_feature (514)..(514): n is a, c, g, or t
  misc_feature (527)..(527): n is a, c, g, or t
  misc_feature (529)..(529): n is a, c, g, or t
  misc_feature (544)..(544): n is a, c, g, or t
  misc_feature (548)..(548): n is a, c, g, or t
  misc_feature (551)..(551): n is a, c, g, or t
  misc_feature (698)..(698): n is a, c, g, or t
aaaaaaaaggtcacgtggtatcattaagagaacactaaatacagagacattttacaaataaaaaatattatattgctcatgttttaaaagtctaacatttgaacttttatataaactattgaatttgttgtagactagttttctttttttggctagagaaacaaagctatggactgcatcaggaaattatttcttcattaatttcaaaaacaaaagcaagaaaaatggctaatgtcaaataattgaggttaaaattctaaaaatgggttgtctctcgtgccgaattcggcacgagagtcaacagtaagttcttttaatgaatatcagttntaacttatagactggcatggnctttaaaaatatctgtacaatatactggactgtgttgcacagacactacntngctttctctttgagcatgntgcatacaaccntggtgggatngatgggtctgtaaatgaaggatattaaaccttgtactggtgtcacnaacattatggtcatgggaccattncacaaaatggggnancttgtgtgcctaaangaanatntggactagaaaggggcacttggggactgcgtaagttgtaattgaccaaagtaaaccttaagggtgggggggaatcactctgttccattaaggagatcaaagcttttccaaaattattgtgatataacctgtgggggaaacctataangcctggacattgaaaaatgagatcttttatatggagcgcttttgtgggaacggtcttacccttataataaagcgtttatggggggtggcggttattaaaagctcttatggaggggcgctttttttgttctaagggtgttcattttgtaaaaaaaacctaaaaagagtgggcgttaaaaaaattcatatctcaaaa

SEQ ID NO: 251655 - DNA, 469 bp, Homo sapiens
agctcctgtggttgtgacatgggtaagtactatttgcaccttaggcttggggaagttaaatagcgggatcccttagccagtgaggggcagagctgagactcaaaccagtgcttctgattttgtgcttcatgctctctcagctgtgtcgtgtgggatctagtgagtgtgaatctcagacctggacagcagacagctcagtttggtgttcccgcaaaagcacgggcactggaactggttctgatcctggttctgccccatcctattttatctctctgagccttactttctttaccataaagttgagataataataatgcctactttgaagtgttattataaggattaaatgaaaaatgagtaaattgcctgatacataggaagcacttggtggatggttgtcctttcctttgccacccttttcctttatcccccacatttagatactaagatggatttcccttacgggtta

SEQ ID NO: 251656 - DNA, 470 bp, Homo sapiens
tttacaatttcagagtattccactatctggatgtatcatgctccttggcttgtgtttgttagtcactaaagaaagcaatatgcttgtcgcacttctagggctggcaagggcctcttccctggtttactctcccaaaagcagattacaacaggaatggagtatggaagatgtggtaaagatgaaattggctatgtgttgatgattgttaatgttaatattaatacatgggagttatgttaacttagtctctctgcctgtgtgttttgaaatttccataataagagtttttgaaaagtaagaccacgtatacaaatgcatcttgtagaggctagaatgctgcagatgaaagagagcttaactaaagtgtccaaggccaaacaagtcatagtttaattctgaggtcagcagcacagcaaaaaggtcttaagaggaaggggagcaaataatgaagataatcctaggctgtcacc

SEQ ID NO: 251657 - DNA, 467 bp, Homo sapiens
tcagtccatagcatgctctgtggcaagtaaagcctagcgagaatctacactttaccattaatcagctgcgtgatgacggtgaaggtacccaacctcccagtgcctcacttgccttatctacaaaacatgagcaacagtacttaccacataaatctgttgtaaggatcaaataagataaacgcttaaaacagtgcctgcatacagtaaacatgcaataaatatgtcattcttactgttataattatatataaatgtgtgtgtatgtgtgtgtgtgtgtgtgtgtatatatatatttatttagagacagagtctcactctgtaacccaagctagagtacagtggtgtgatcataactccaactcctgagctgaagtcatccccccacttcagcctcctgagtagcagagaccaagcgaacccccttcgaccttgccgaaggggagtccgaactagtctcaggcttcaac

SEQ ID NO: 251658 - DNA, 478 bp, Homo sapiens
gtcagttcattacctgaagaatgtatccagaaaatagtgccattattttatttcctccaaatacacacctttattaaacaaagataaagctttcattttaaaaaaacacagataatagcacttaggttaatttataattcaatagtacagaaagttgggaaatttctgatggaattgtcaaatacaataaatatttgtttaatttgttttatagcttgagcctaatgtatgcagtcacagagttaccagaaaaagtaactgaaatctttaaatagctaatttattatcatatattcccccaaaagctaaaagtgagtttagatttatgagttccacaaatttaatttaaaattttttgagttttaaaaatgtttaaaatattttggcagtgggttatttgtatgtttgtgatctgctaagtgatttcaatgttaattctttattaatgctaagaacattaaactatttcttccacttc

SEQ ID NO: 251659 - DNA, 495 bp, Homo sapiens
  misc_feature (45)..(45): n is a, c, g, or t
  misc_feature (53)..(53): n is a, c, g, or t
tgcactcagccagggcgacagagcaagactgcctcaaaacagaanagaaaacnaaggctaattctcaggctctacaccgaacctactggatcagaatccctggagctagggaccagaatctgtttattggtgattctgttgcatgcttttgcactattctaaaacctatgtgtgtgtgtgcgtgtgtgtgtgtgtatgtgtagctgggctgtcccagcgctatccacagggaagctcctataaagggctgcatctctggactcacagctatcagaccattgagatgtggaagctgttgctgtgggttggtgagtgtggcaggtcccagcagtgtcactcagtccaggaagtgccaggctttatgagttcgtcatctctctggtgcctgagagagcagcctgagactcagggaagcctagattaggtagagatgggatgggccatagttaatggtcagaggtcagagggacccagggagaagtggtggacagcagt

SEQ ID NO: 251660 - DNA, 734 bp, Homo sapiens
ctgagctgtcatctccattttacaagcatggaaactgacctcacagaggcaggtaatttgtgcaagattacaaaacttctaagtggtgacactgagattcaaactttgaattcaaaccttggattcaaagcctaaatccaaagctatggtttaaactttttttaaaaattacgctgcttcccagccaataatcttttaataatagaattgctgctaccatatggggtttctcccccatattcagtccctgtggtactgaataccaggaagaccctcttcctggtattcagtgccaacctggtgctgttgctttgttggagagggaggccaggtcgttctggggtcactgtgactctcataaattactgatcctggcactggggtgtgtgtgtgtgtgtgtgtgtgtgtgtgtgtgtgtgcgtgtgtgtgtgtgtatgtgtagctgggctgtcccagcgctatccacagggaagctcctataaagggctgcatctctggactcacagctatcagaccattgagatgtggaagctgttgctgtgggttggtgagtgtggcaggtcccagcagtgtcactcagtccaggaagtgccaggctttatgagttcgtcatctctctggtgcctgagagagcagcctgagactcagggaagcctagattaggtagagatgggatgggccatagttaatggtcagaggtcagagggacccagggagaagtggtggacagcagt

SEQ ID NO: 251661 - DNA, 333 bp, Homo sapiens
  misc_feature (45)..(45): n is a, c, g, or t
tgaaactccacgcacctcaggtgtgtgtccccgttctctcctccntgcggtccttggtaaccactaagctgcttcctgtctctatggccctgccgctgtggacatctcttgtcaatggaatcactcagggctcgtccatgccgcagctccttttttttttcttttctttttttttttttttttttttttttgagatggagtcttgctctgtcgcccaggctggagtgcagtggcgcgatctcggctcactgcaacctccacctcctgggttcatgccattctcctgcctcagcctcctgaatagctgggactacaggcttccaccaccacgcc

SEQ ID NO: 251662 - DNA, 441 bp, Homo sapiens
cacaaaggtgcggatgaagaccgttcgctgggcttcactagtacaaagacaggctgacagtgcaaagacgaagaggaacggtcccagccatcagggaactcagcagcttggaagatactaaacagccactcctccaggatgtaagttccctcattacaaagctgccatattaagaaacatctttataaattaaaggaagcagggttggcaggattgaagggtcaatgcaagcactgaaacacagtagcaaggaataggtagaggcagaaactgtgacgtggtaatcatcttctacccacatgtgctgtccccatacctcccatgacacactctcccctcagtcaccactttccctggtctctatgctctcaggtaccctcttcgtagtccctttttcttatgtttaaatgaggagtaacgtgacactagacatctgtactt

SEQ ID NO: 251663 - DNA, 444 bp, Homo sapiens
ggataaattccaaagccagagttccctggatgctgctccataattttgccatttggggtcaagagcggcatttccagcaggctgttcaacaaaggggcaggctgccttgggtggcagtgagcctcccatgcccggaggtgtgcaagacaattggggcggcaatccattgatctgacaactatttgttgggtctcacagtgtaccaggcagggttaggggctggggaagctcaagactggtgactccctggctcatgctgtgaggaccgcactccatgcagccacggctctgcatgtctggatgaatagtgcctgggcaaggactatggtatcccatgcttcaggaacctcagctccatcagcctctggctctgtcttcccctggtgaccttgcaattcagagaggccattgcgtgagatatgattgttccattcaatcctgact

SEQ ID NO: 251664 - DNA, 350 bp, Homo sapiens
ggaaaaatattaaatttagaaaatgatggatgcatcatattgatttttactttgaaaaaaatggcagtgtaacaataatagcacttgtttcttgcttaactaggtttggaattatatttatttgtgtggcttttaagtaattccagtatggaattccacaagggtcaagatcacattttctagaagagtacattgcacctaataggcattcagtaaaaactgttaaaggaatgaatgaaatgagtttgcaaatatatttccatcttagttatcgttttctcaggactcttctgattttagagtcagaggaggcagtgctggactggctttgggccagcactaaaaaacaa

SEQ ID NO: 251665 - DNA, 501 bp, Homo sapiens
tcttccagaaaggatttagggagcttaggtaatgtggaggtctgaaggtgtagatactcatgaaagcctcagattaatatctagaacatataatgtgtccagatagttttcaattatcaatgcattaatctaagcttggaaaggacttttaaactgcaatgaaacctcaactagtttcaaacctgcattttttagtaagctattttgtcatttggagacccacacaaaaaacctattgttcctttaaaaaggagagagagaaaaaaagaaaaacaacctgctggtgttgctttgttcatcttatcaccttatcattcagcagcctattcaggatcaaatgtgggaaagtctgtgtgtgagattaagccctatactcagcacaggaatttcttggataaatgtctttcttaaatggatagctatgtaaaaaacagaagagaaactctattattacaatgcagttgggtttttttgtttggtatgtttcaaatcaaaaaaaaa

SEQ ID NO: 251666 - DNA, 247 bp, Homo sapiens
agatattaaagcattaatcacgtgtaactgtctgtaaacagcggttttgtagttttttgcttttagtaaataggctcccccgtgtgatcaatactaaactgacagcaaaagagcagtccattcttattagaccatgcttggggagataagttgctgctggctcatgaaggacacattcttcttgatgtagggaggtggaatgaggatttaggcgctgtcttcctcccctttggggtagggtaccttg

SEQ ID NO: 251667 - DNA, 789 bp, Homo sapiens
aacggtggccgcctgttgctcgcaggcatccagtgctttttggtgttggggtcaatctggaagacctgtgctccggtggtgaagatgggctgttcttccatccccggcactgctccggcggccactccgagccggcctctcacgctcactgtccgcccgcttggcgtctgctaccggcgcggcacgtgcggaggcccctgcgcgcctggctcagcccaggctctgctccattccaccaggcgcgggcaggcaggggctctcgaaaaatcattctaagagataaattaaaagagtaatctgtaataaggggaataatctgtaataagcattccaactcagaaaaaaactgaatatatgtaatacatataaactcctgagaagaaaggtcgaagcacaagaagggtctcatgtgtagcagcctgttgagaaaaatgaagagccctgtaatcctgaggagggggcttaatccaaagagagatgctccaggtcctgtgcacatgaaagatttgcctgcttctgcccatccaggagcttacttcctgaagcctttgaagccttcaggaggcaggaggctgaatgagtttctcaggacaatctaatcatatcctgacagggagaaaaaaatcatgacctaggacggattaaaaaatgtataattaaaatttcattgaaaattgagaaattttgactatgtatttatagagtgcaaagctatgttatgatttatgaatgcaatatggaataactgaatctagctaattgacatatatatcaactcaaatcctcaaa

SEQ ID NO: 251668 - DNA, 684 bp, Homo sapiens
caggcatgagttgtagtgctgttggctgtgagctcagcatgaatgagttaacaatacagtccatccagaaaaaggaagaagactgccaatctgtgatgaagctatggagaagtggctacatttgtggattcctgagatgacgacccatttaacaaaaccaaccaaacatagcagacagcactgtgaagctgaaagcccaagaaacttccagtcacgtgatacaggattagaacattgttaaacccttctcagccactgctggtcagcaagcgtgtttcagaaggtgacatggagtgaaaaacatcaagttgcaggtgaggcatgttctgcagatctggaagaatttttaaaatacctgctgagtgatattttaaaagagtcctgtggaagaacaggttttcaatgctaatgaaactggtttgttatgcaaggaagttggcaaatgaacctgtacaagtggcatttcagtttataaaaatgtggccagaggctcataggaacttaaccctgtatttccactaggaacaataatttagtattaacagattcagtgtttgcaatgactttatagaacataactgtggtgaataatgagaatcagctatttcaggcataaagcctgatatttaaaatattaaataatataaagcctgatattataaataaaaaaaatcaacttcttca

SEQ ID NO: 251669 - DNA, 433 bp, Homo sapiens
tactctgtctcaaactttatatatatatatatatatatatatatagttttagtataaaggttattttaggaagctttcttctttgaagattttctcaggatcatattattcttaggttacaatgtgggtttttgttactgacttttgcctttttatctttataggaacatggtacattcatgaatcaacttcttgttcgtctttgcctgtattgttcagcctatgttcaggcacataatacttagtcaataaatattttttgaatgaataagtaaggctatatagagtaacattttactttcaaaagtctattcttttattttattttttttagacaatctcactctgttgcccagactggagtacagtgggccgggattgcgctactgcactccagcctgggcagcaagagcggaaatccgtctcaaaaaaa

SEQ ID NO: 251670 - DNA, 922 bp, Homo sapiens
gccatgttggccaggctggtctccaattcctgacctccagtgatccacccccctcagtctcccaaagtgctgggattacaggcgtgagccaccacgcccagccaatagtggaattgttgccggacaatatttatttaaaagacattattgtaaagagtaacagtgtaattctggctccttgaaatttgaggggaatgatttttctggacattcgaccagtgctttctaaatttctccactgaattctatctaatgacagatgagaggacactgaaagtaggagtagccataagtcaccagtgcaaaatgtcttttgaagtttgcatttattgattgctaccatttatgtaaagttttacagttttgacagtcatagggttcaccaatccaccatagaagagaattaagtcatgcggacacagcagggtttagaatggatgagtagaggagtgtgtgcaggctccagtccccaaagtctctaggactgtcctagaacctgcagctcatctgtcaattctgtcaactactcaggatcctctcaagaattatccccccatacccaccttttaaatttcctcaagctagtttcatttgagttttgtcacttgcaactgaatgagccctgctaatgcagatagattcaattgagaaggggaattctaggctaggagtacaaggttacaggcaaggagacaggaacatagcttgggatttcctggggcagtgagaaaactgactttaaaaaaatggaatggtttctaaaatgtttgtacaacttctctgtatggcaatggggtaggagtataaattctttcagcttcttctgagggcagctgaacaagaagtataaaaattttgaatgctgataacatttgacctagcaattccatctctagaaataaattctacagtagtaatctta

SEQ ID NO: 251671 - DNA, 446 bp, Homo sapiens
gagaagggccagccaggagtctgtgaaatggtccagttgggaaatgcctaatgcataaacacaaatcttggtgacaggtaggttagttatctgtgaactttctaaagattaaataaacaataataggattttgttaatgtgccaaagtgagtttaaaccatgaaagacacgatgcaaatatgcaagtacctttaattgggcataataaaaagtagtgaggtatggttaaaataacatttagaacaagagagaagttagggagaatttttgtctaaaaagccaaaaagtgatagttgattggtgattttgttgttatcaggagagagaattttcttaatgtaataagttaggtactttggcaagtgaaatgggttctaggccaattgcaagtccttaggattccctggcagctagaaaccttggcactcccaaaagacagcttcagt

SEQ ID NO: 251672 - DNA, 391 bp, Homo sapiens
gctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtatagcagctttatgattatgagaaaacaaattctttatttttttttctgttccaaagattcatcctatggggtggccataaagtctagaattagatactaatattttgtcattcattataacatatcaataaaccatttgtta

SEQ ID NO: 251673 - DNA, 340 bp, Homo sapiens
aatgagaaggagtgcggtctgtcctagtcctcatatctttcagcccctgccagcctgatcagatcagtatctggttctgccagggtgtggcagcccctggccggtggcctctttgtctctccgccttggccatttccctcattgccttatggacatttatccttccagtgtcctttctttttgcattgtgcacattgatccttctctaaccttggtcagctcttgaatccttgtcttggcctcttccatgtccatgtccacgtccacttcctcatcctctcacattgctagtgtctctctctatgagggctgttgccaacagatcggctttctttttaag

SEQ ID NO: 251674 - DNA, 5554 bp, Homo sapiens
  misc_feature (2109)..(2109): n is a, c, g, or t
  misc_feature (2548)..(2548): n is a, c, g, or t
  misc_feature (2809)..(2809): n is a, c, g, or t
  misc_feature (3193)..(3193): n is a, c, g, or t
  misc_feature (3559)..(3559): n is a, c, g, or t
  misc_feature (4170)..(4170): n is a, c, g, or t
  misc_feature (4206)..(4206): n is a, c, g, or t
  misc_feature (4364)..(4364): n is a, c, g, or t
  misc_feature (4555)..(4555): n is a, c, g, or t
  misc_feature (4861)..(4861): n is a, c, g, or t
  misc_feature (5011)..(5011): n is a, c, g, or t
  misc_feature (5030)..(5030): n is a, c, g, or t
atgtttctaccaataaacagtaactaaaatataaactatgctccaatgaactaatttttttttactgctatttgtcttctcttttagaaaattattactatatgtttatttgaattctgtagttttttgttttctaatttgaatattaattctccttatcccaattgtgagattaccccagcacttaattattttgatttctctttctctatcctatgaattcttgttttatttttatcgttttaaacataatctattgagggaaagttaagtaattttctgtattccctaaacctagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgctatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggtacttatgtcataaaactttccaagcaaattttctgcttattaattatatccaatggtgaccaactcatagaagcattaggataaaattatcttttgttgtttatggtcactaaatgggtattagtttaaatgatgacattgattataatcagttacccttaactgagtcatttagttgagtaggatttaaaatgaatcatttcctgaaaatatactttttttatgtttttattttatatttatttatttatttttgagacaaagagtctcgctctgtcacccaggctcgagtgcagtggcgcgctctcggctcacttcaagctctgcctactgggttcacaccattctcctgcctcagcctccctagtagctgggactacaggcgcccaccaccacacccggcaaacatttggtattttttttagtagagacggggtttcaccatgttagccaggatggtctcgatctcctgaccttgtgatccgcctgcctcggcctcccaaagtgctaggattacaggcatgagccatcgtgcctggccttatgtttttatnttttgtgtgtattttttgagacagtcttattctgttccacgggctggagtgcagtggcacaatcatagctcactgcagcttcgacctcccgtgctcaagcaatcctgctttagccttccaagtagctgggaacacaagcacacaccaccactcctggctgatttttaaatttattttttgtagagacagggtcttgccatgttgcctagtctggtctcaaactcctgggctcaagcagtccgcctacctcggcttcccaaagtgctgggattataggcataagccaccgcacctgatcacatttattactttaaaagtaaacaataatgtcttacttttggatcagaagattataataatttgtttttatgccaatttaaatgtagaataagggagatatttgcttatcaggttttttttaagtagaatatgctgattntttctttgtggctacagggtttcatatttgtttgccctttcttgtgctgcccggcctcccccctaccccccgctttttttttgagacggaagtctcactctgtcatacaggctggagtgcagtggtgtgatcttggctcactgcagcctcccctccccccaggttgaaaggattctcctgcctcaacccccccgagtagctgggattacaggtgtgtgccaccatgcctggctaatttgtatatatttttttagtagaganggggtttcaccatgttagccaggctggtttcaaactcctgacctcagacaatctacccacctcggccccccaaagtgctgggattacaagagttagccaccactcccggctcttgtgctgctttttgtttgtttggtttggtttggtttgagatggagtctcactctgttgcccaggctggggtgcagtggcatgatctcggctcactgcaacctttgccgcctgggttcaagtgattctcctgcctcagcctcttgagtagccggcattacaggcgactgccaccacgcctggctgatttttgtatttttagtagagatgagggtttcaccatcttggccaggctggtcttgagctcctgaccttgtgatccacccgcctcancctcccaagtgctgggactacaggtgtgagccacaacatccagctgacaacttttttttttttttggagacagagtcttgctctgtcacccaggctggagtgcagtggcgcgatctcggctcactgcaagctctgcctcccaggttcacaccattctcctgcctccggctcccgagtagctgggactacagggacccaccaccacgcccggctaattttttgtatttttggtagagactggatttcaccatgttagccaggatggtctcaatctcctgacctcatgatctgctcgccttggcctcccaaagtgctgggattacaggcgtgagccaccatgcctggcccgacaacttcttaaagagnatcattattcaagatagtcactaggacagaaaaatgatatgtcttttaatttacccacccccccccccgtcttataggatgattgaaatttttagttcatataattaattagcatactgtgatacatcgattgattttgataaaataagtataatcaatttgatattaatgatttttgtatgtgtaggaatttgccttataatcagatatgtatgtcttgttgtgtacctattggtggcacaaagacttgctctataccttgccacgtgagcttcactgacaagatttttacaactctaaatggtataatttgcagtatactcccatgactataattcgaaagccaaactctactggaagtttgagtttgaaacaatagtaaatagagtttccaactataataaatctccaacaaaatgcagttgttttgttttccagtgaaatcagactttagctttatggattagtttgtttagataatcctttaggcatataccatatagtcaaacaaataaatgcattttcttttagaagctaagttgttgtgtatgtatttgtgttcatttagaataatgattctcagtagagaggaagggacatatcagagtctnggaggggagagttccctggcagaagattttgaaaangatacccaggtatggccaggcgcggtggctcacccctgtaatcccagcactttgggaggccgaggcgggcaaatcacaaggtcaggagtttgagactagcctgcccaatatggtgaaacactgtctctactaaaaatacaaaaaaattagccgggcgnggtggcacatacttataatcccagctactcaggaggctgaggcaggagaattgcttgaacccgggaggcagaggttgcagtgagccgagatcgtgccactgcactccagcctgggtgacagagtgagactccatctcaaaaaataaattaaaaaaaataaaaaataaaaaaattagccaagcatggtggcncacaactgtcatcccagctacacaagagggtgaggcaggagaatccctgtaacttggaaggtggaggttgcagtgagctgggccactgcactgcagcctgagcgacagagctagactctgcctcgaaaaagaaaaagataaccaggtatatagtctacttgtgtgcccatgttattcctttctcttcccatagcgtgcatacacataaactcttaagtaataatttatgtgctttttatttttatgtgtttgaatattttattaactaaagggaaagaccatgaatgaggtctagtagtctctganaaatgatcctatactaagaaaaatgagctatttatattctaaacaatgttgatggtgttttgttttgctttttttgagacagggtttcgctctgtcacccatgctggagtgcagtggcacaatactgctcactgcagcctttacctcccnggctgaagcagttttcctncctcaccctcccaagtagttgggaccacagacgcataccaccatgcccagctaattttataatttattttttgtagaaacagtgttgccatattctccaaactggtctcaaactcctgggctcaagcaatcctccggccttggcgtcccaaaatgctgggattacagatggatgtgagccaccattcctggccacagaatgctaatactagtatattttttaccaaaagagtatcaaggccagagtggtgggtggcacatgcttataacagcactttgggaggctgaggtgggaggatcgcttgagcccaggagttcaagaccagcctgggcaacatgttgagaccctgtgtctagcaaaaaaaaaaaaaaaatcattagccaggcatggtgggacacacctgtggtcctagctactcagtagtcttaggtgggaagatcacttgaacctgggaggtccatgctgcagggagctgaattcgtgccagtgcattccagcctgggtcacagagtgaaattcgatct

SEQ ID NO: 251675 - DNA, 569 bp, Homo sapiens
tatttttacctgagttgttttttatgttgccaggagctaaatgaaaaccagagtacccccaaaaaagaaaaacaggagtggctttcaaagcagaaggagaatatacagcatttccaagcagaagaagaagctaaccttcttcgacgtcaaagacaatacctagagctggaatgccgtcgcttcaagagaagaatgttacttgggcgtcataacttagagcaggaccttgtcagggaggtaagtttgagtgatgagaaattttaaatcctttatcaaaagaatctttcctgaaaatattccaattccattctagtctcagggactttgcacttatacttgcctctgtctgaatcattcttccccagatattcacatggattgtttgctccctgtatatctttactcagatgtcatttcctcaaaatctctttcttaaccaccaaaattttttttttcaagacagtctctccatgtcgccaagtatggagtgcagtggctccatcttggctcagtgcaacctccacctcctgggtgcaagtgattttcgtgcctcagcctcccaaatagct

SEQ ID NO: 251676 - DNA, 471 bp, Homo sapiens
cacctcctggctcaagtgatcctcccacctcagcctcctgagtaactgcgactacagacagggtcttgctctgtcacccaggctggagtgtagtggcacaatcacagctcactgcagccctgacctcttacaccgaagcagtcctcatacgtcagcctcccaaagtgctgggattacaggtgtgagccaccatgcctggcctagattctttactttgacatgtcgttattagtgataatgattttttaattctctagaaaagtacaaataatttgaaaatggagtaattaaaagatcatttcatcttcagcttaggtagtgaaaaagtatttttgtgttttatgtgtgaatgtctagttctataaaataatgccattaatctttaatcaagaataaaaaagttggctgggcatgtaaaaaataaaacagtgttgagatatgaaatatttctgtgtgtgtgtggggggggat

SEQ ID NO: 251677 - DNA, 353 bp, Homo sapiens
cccctcctcctcctcactcctcaccctccagggtagcggctaccggagcgctgcagggggctgcgcctgcctgctccgccccagacctgtcggcgaaaggtagtttatgccaacgtgacttcattcatacagatgaaccaaggatcgggatagcagtataaaattagaatcaagacagctgactgctcagcaggatgccatcaactaacagagcaggcagcctgaaggaccctgaaattgcagagctcttcttcaaagaagatccagagaagctcttcacagatctcagagaaattggccatggaagctttggagcagtgtattttgtaagtgttagtggcttgatgtcagtg

SEQ ID NO: 251678 - DNA, 4709 bp, Homo sapiens
  misc_feature (4232)..(4232): n is a, c, g, or t
cacctcctggctcaagtgatcctcccacctcagcctcctgagtaactgcgactacagacagggtcttgctctgtcacccaggctggagtgtagtggcacaatcacagctcactgcagccctgacctcttacaccgaagcagtcctcatacgtcagcctcccaaagtgctgggattacagatgaaccaaggatcgggatagcagtataaaattagaatcaagacagctgactgctcagcaggatgccatcaactaacagagcaggcagcctgaaggaccctgaaattgcagagctcttcttcaaagaagatccagagaagctcttcacagatctcagagaaattggccatggaagctttggagcagtgtattttgcacgagatgtgcgtaccaatgaagtggtggccatcaagaaaatgtcttatagtggaaagcagtctactgagaaatggcaggatattattaaggaagtcaagtttctacaaagaataaaacatcccaacagtatagaatacaaaggctgttatttacgtgaacacacagcatggcttgtaatggaatattgtttaggatctgcttcggatttactagaagttcacaaaaagccattacaagaagtggaaatagcagcaattacacatggtgctcttcagggattagcctacttacattctcatactatgattcatagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgctatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggagctaaatgaaaaccagagtacccccaaaaaagaaaaacaggagtggctttcaaagcagaaggagaatatacagcatttccaagcagaagaagaagctaaccttcttcgacgtcaaagacaatacctagagctggaatgccgtcgcttcaagagaagaatgttacttgggcgtcataacttagagcaggaccttgtcagggaggagttaaacaaaagacagactcagaaggacttagagcatgccatgctactccgacagcatgaatctatgcaagaactggagttccgccacctcaacacaattcagaagatgcgctgtgagttgatcagattacagcatcaaactgagctcactaaccagctggaatataataagcgaagagaacgagaactaagacgaaagcatgtcatggaagttcgacaacagcctaagagtttgaagtctaaagaactccaaataaaaaagcagtttcaggatacctgcaaaatccaaaccagacagtacaaagcattaagaaatcacctgctggagactacaccaaagagtgagcacaaagctgttctgaaacggctcaaggaggaacagacccggaaattagctatcttggctgagcagtatgatcacagcattaatgaaatgctctccacacaagccctgcgtttggatgaagcacaggaagcagagtgccaggttttgaagatgcagctgcagcaggaactggagctgttgaatgcgtatcagagcaaaatcaagatgcaagctgaggcacaacatgatcgagagcttcgcgagcttgaacagagggtctccctccggagggcactcttagaacaaaagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacagagcagggcatgagcagaagcacgagtgtcacttcacaaatatccaatgggtcacacatgtcttatacataacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccnagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaatagccaattatttaaatgtttagttgccacagtgaaccaggagtcactgagccaatgactttaccagctgctgactaatcttcatcaccactgtagattttgctgcatgtgcaggtcctctatttttaattgctgttttcgttgctgcagtactttacaaacttctagttcgttgagacttagtgaccatttggcatcaagttaacatcacacaataggaaacaccacttccacaagtctcaagcctcagtgctaaagtactactgaaaaggaactaggaagtttggccaatt

SEQ ID NO: 251679 - DNA, 2327 bp, Homo sapiens
atgtttctaccaataaacagtaactaaaatataaactatgctccaatgaactaatttttttttactgctatttgtcttctcttttagaaaattattactatatgtttatttgaattctgtagttttttgttttctaatttgaatattaattctccttatcccaattgtgagattaccccagcacttaattattttgatttctctttctctatcctatgaattcttgttttatttttatcgttttaaacataatctattgagggaaagttaagtaattttctgtattccctaaacctagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgctatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggagctaaatgaaaaccagagtacccccaaaaaagaaaaacaggagtggctttcaaagcagaaggagaatatacagcatttccaagcagaagaagaagctaaccttcttcgacgtcaaagacaatacctagagctggaatgccgtcgcttcaagagaagaatgttacttgggcgtcataacttagagcaggaccttgtcagggaggagttaaacaaaagacagactcagaaggacttagagcatgccatgctactccgacagcatgaatctatgcaagaactggagttccgccacctcaacacaattcagaagatgcgctgtgagttgatcagattacagcatcaaactgagctcactaaccagctggaatataataagcgaagagaacgagaactaagacgaaagcatgtcatggaagttcgacaacagcctaagagtttgaagtctaaagaactccaaataaaaaagcagtttcaggatacctgcaaaatccaaaccagacagtacaaagcattaagaaatcacctgctggagactacaccaaagagtgagcacaaagctgttctgaaacggctcaaggaggaacagacccggaaattagctatcttggctgagcagtatgatcacagcattaatgaaatgctctccacacaagccgtgagtttgctttttttggggcaaaacaaatttagtgccccttttcttccaccacctgaatgaaatcacagcaattaaagtactagttggaaatgatagctctcctgaagcttggga

SEQ ID NO: 251680 - DNA, 2596 bp, Homo sapiens
tcttctcagattactcaaaggtttattttcttatttttttactttgctttattttctttttaaagcactagctccaggataattttataagtattgctgtatagtgttatttttaaaattttctttaaaagtggttttgatgtcctttttgacatggtagtttacaaatgcttttatattcgcaaagaaatagttgcctagatttcacctgttaatttttacagtgcttctttctttctttcttctttaggcacgagatgtgcgtaccaatgaagtggtggccatcaagaaaatgtcttatagtggaaagcagtctactgagaaatggcaggatattattaaggaagtcaagtttctacaaagaataaaacatcccaacagtatagaatacaaaggctgttatttacgtgaacacacagcatggcttgtaatggaatattgtttaggatctgcttcggatttactagaagttcacaaaaagccattacaagaagtggaaatagcagcaattacacatggtgctcttcagggattagcctacttacattctcatactatgattcatagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgctatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggagctaaatgaaaaccagagtacccccaaaaaagaaaaacaggagtggctttcaaagcagaaggagaatatacagcatttccaagcagaagaagaagctaaccttcttcgacgtcaaagacaatacctagagctggaatgccgtcgcttcaagagaagaatgttacttgggcgtcataacttagagcaggaccttgtcagggaggagttaaacaaaagacagactcagaaggacttagagcatgccatgctactccgacagcatgaatctatgcaagaactggagttccgccacctcaacacaattcagaagatgcgctgtgagttgatcagattacagcatcaaactgagctcactaaccagctggaatataataagcgaagagaacgagaactaagacgaaagcatgtcatggaagttcgacaacagcctaagagtttgaagtctaaagaactccaaataaaaaagcagtttcaggatacctgcaaaatccaaaccagacagtacaaagcattaagaaatcacctgctggagactacaccaaagagtgagcacaaagctgttctgaaacggctcaaggaggaacagacccggaaattagctatcttggctgagcagtatgatcacagcattaatgaaatgctctccacacaagccgtgagtttgctttttttggggcaaaacaaatttagtgccccttttcttccaccacctgaatgaaatcacagcaattaaagtactagttggaaatgatagctctcctgaagcttggga

SEQ ID NO: 251681 - DNA, 2089 bp, Homo sapiens
atgtttctaccaataaacagtaactaaaatataaactatgctccaatgaactaatttttttttactgctatttgtcttctcttttagaaaattattactatatgtttatttgaattctgtagttttttgttttctaatttgaatattaattctccttatcccaattgtgagattaccccagcacttaattattttgatttctctttctctatcctatgaattcttgttttatttttatcgttttaaacataatctattgagggaaagttaagtaattttctgtattccctaaacctagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgctatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggagctaaatgaaaaccagagtacccccaaaaaagaaaaacaggagtggctttcaaagcagaaggagaatatacagcatttccaagcagaagaagaagctaaccttcttcgacgtcaaagacaatacctagagctggaatgccgtcgcttcaagagaagaatgttacttgggcgtcataacttagagcaggaccttgtcagggaggtaagtttgagtgatgagaaattttaaatcctttatcaaaagaatctttcctgaaaatattccaattccattctagtctcagggactttgcacttatacttgcctctgtctgaatcattcttccccagatattcacatggattgtttgctccctgtatatctttactcagatgtcatttcctcaaaatctctttcttaaccaccaaaattttttttttcaagacagtctctccatgtcgccaagtatggagtgcagtggctccatcttggctcagtgcaacctccacctcctgggtgcaagtgattttcgtgcctcagcctcccaaatagct

SEQ ID NO: 251682 - DNA, 658 bp, Homo sapiens
caaactgagctcactaaccagctggaatataataagcgaagagaacgagaactaagacgaaagcatgtcatggaagttcgacaacagcctaagagtttgaaggtatggttagcctaagctttttgataacagggaggagaatgaaaaggtatccatgtaagcaggaaaagtcttaagatgatgtctagtcataaagaaattgactaagcttcttttcatttttagcatctttggttgactttaatgttaaatgcctgttgctacagtcttttgcttatgtatttctcatcagagtacaaaaaagtggccaaaacttttaaccatgggaagtgccagtagataagaatcaagattcttgttttaaacttatccaagggcagggtgcagtggctcacgcctgtaatcccagcagtttaggaggccaaggcgggtggatcacctgaggtcaggagttcaagaccagcttggacaacatggtgaaaccctgtctctactaaaaatacaaaaattagttgggtgtggcggcacatgcctatagtcccagctactcggggggctgaagcaggagaatcccttgaacccaggaggcagaggttgcagtgagtcaagaacacaccacagcactccagcccgggtgacagagcaagaccctgtctca

SEQ ID NO: 251683 - DNA, 796 bp, Homo sapiens
aatatgctgtttctgtttcagtgttaataatttataactgagacctatttccactttgaactagggttcagtaggatgaaaactaactttgtcttttatttatcacacttgattgtctaataatttccataagcagcagttgctctccacatacagatagaaccctacacctaacgaatctctcccttggtccctcctaaaaaggcactccatttctcattttcattaactttgctacagcatggccaaactcagtaaaatttttttttctgttttctttgtctttaatattgtctttaatatttcacctgtctgtttcaatttatcttggtaaaatatttagatatataatatctgttcacttttgaaactaaattttcagttttagtcaaatgtataatgatactgcaagttgagcaaactgtgatcaaagaccatgatagtacctgtattaatgttacatgcgtgttctttacatacctaagcagtatagtgacaactgagtgtgtttacctgggagaactttaggtattttccctaagcccatgtactttgaggttttaatgtgcaggatgagaacagcatccagccaggaacagcgtaatgccccgatgtcatgggaattgacaagcttgctctgcacctaataaccataggtttctatatcacatcatctttgcctaagacataatagatactctactgattctaaatatccaacactatttttgtgtcctaaacttaaacttcgcaacacatagattgtaccaatgcataaacagttatttgagaatga

SEQ ID NO: 251684 - DNA, 325 bp, Homo sapiens
gggacacttggctatccatttggaagttaataaaagtggatacatccttgtgtcaagccatatacaaaaaaaagtgaattccatatgaatttaaaacattaatctgaaaagcaaactttttaaacatttagaaaagattctaaattaggggaaatatctttgtgacattgggagaggaagacataaaaaaccaaaacccataaagaaaaactttttgaatagaatatgcctaaaaatattaaacaaaaggtttgatatatttgactacatgacaaaaagaaaatgttagaatgacaaaataaaacataaagttaacacttcacaa

SEQ ID NO: 251685 - DNA, 494 bp, Homo sapiens
atgctaacatgaatcaaatgaaagcaggaatggaaatattgatgccagatgcagtcaacttcagagcaaggaaagttatcaggtttctaaacgggtattacctattatcaggtttctaaacgggtattacctaatcataatggggtcatttctcaaggaaaatatagtgatctttaacatgtatatgtttaacaacaaagcataaaaatatgtgaggcaaaaattaatacaacttaatgagaaatacaggtgtccacctttatagctggagactttaacgctgccctataaggaactcattcagcaagcagaaaaaaaaaaaaaatggaatacatgaacccaggaggcagaggttgctgtgagctgagatcgggcaattgcactccagcctatacaacaagagcgaaactctgtaacaaaaaaaaagggggtgtggggggagaatacaaagataaaaagaaaaaaagtaagaaaaaatgggaaaatttgggaaa

SEQ ID NO: 251686 - DNA, 332 bp, Homo sapiens
ctgtgagccagtattgtgccattgcactccagcctgggcaacagagcgagactctgtctcaaataaacaaacacatctgaatttaccatttgaaaaaatatatttgtgtgaccatgaggtcaagagattgagactattcctggccaacatggtgaaatcccatctctactaaaaatagaaaaaatagatgggcgtggtggcacgcatctatagtcccagctactggggaggctgaggcaggagaatcactggaacccaggaggcagaggttgcggtgagctgaggtcgcgccactgcactccagcctggcgacagagtgagagtccattaaa

SEQ ID NO: 251687 - DNA, 192 bp, Homo sapiens
tacacaaacagttaagggagaaaaggtttttgatcagctttgctactttattgccataggttattcaagtgattgttttcccctgtagccattaaagcagctttgctattgctatacccaaaacctgacccttcaagaagatagaagtaatatcttcagtctgaatagtattagtgaatttagccgtaccat

SEQ ID NO: 251688 - DNA, 623 bp, Homo sapiens
aacgaattccactctgggtctggcacccctgaagatagcagagttgggatcggctacttcattgaggggcgtcacaacattcgaggtttaagctggagtcgtggtctttgtgctcttccctcctctgtcggttctttgaaatccatgttggatcgtggaagggaggaccatctctgaagtggctgcccagttgggggcctgtttcccagtcacctgggtgactacctcccctgcctcctaagaagtcatccctgaagcttcgtcatctggtacaccttttctgaatccaaagccacctttatcttgttttctgccttctgcaatgtccacatgaagtgactgattgcccaacagtgcaccatcgtatgtcaagcttccttaagggaatccacttcatcgaattctatatagcagaatcctttaaatttatctgtgtctttgtctctgactacccgtacactccttatgctgagatccttaaagatagcatctatgtcgccctgaaccatattaaaaggtagattccctacatatgctgtgtgtggggctctgtgagcgactccttctggctacgggaaccatggccaccagtactgccgtgggaccctctgtttttttttttt

SEQ ID NO: 251689 - DNA, 852 bp, Homo sapiens
taggatctcaaaagcttttttaggaataatgtcatatataataaataatagcaagaatgttacagcatctatagctctttaaactacctcccaagggaaagacaatgagggcttagttcctgtgtcttttaaactttaactttacgtgtatttttttggacatgtgctgtccagtatggtagctacaagccacatgtgaggtgaacacacagctagtcctaattaagatgtgctgtaaatgtaatagacacaaaatattttgaaaatttagtatgagaaaaatattaacaatttttatattgattccttgatagtattttggatttagttgctttctgaaaactctcctgtgttacccagtttgagtgtaccataccatccatctcttgcagggaccttgactgatacaacattaaaatgaagtgtaattttaaaaaattttatttacatatttcttattaagaattggatgaattgaaacttctttattttctttctctttcttgtcacacagaaagcctgattaagtagcattattcttttgtctacagaagtaaccacttctggccaggcatggtggctcactcctgtaatcccagcactttgggagcccgaggcaataggatcacctgagattgggagttggagaccagcctggccaacatggtgaaaccctgtctttactaaaaatacaaaaattagccgggtgtggtggtgggcacctgcaatcccagctactcgggaggctgaggcaggagaattgcttgaacccaggaggcggaggttgcagtgagccgagatagcaccactgcactccagcctgggcaatggagtgagactctctctcaaaaa

SEQ ID NO: 251690 - DNA, 412 bp, Homo sapiens
ctgttataaaaagtaaaggacctaatacaaatggaaagaaacatggttagtaagcaaagctagttatgagcagctgtcatgttctaacagttggaatttgaatcagagcaactattggtatttgaatcagagaggggccagaccagtttgggtgaaactcagttcatcttttaaactgacaataaagggaatatattttcatagtaattttatcattatgtggcaaactttgttctgtgagctattaaaatattcatcttggccaggtgcagtggcttacgcctgtaatctcaacactttgggaggctgaggcaggagaattgcttgaacccaggaggcggaggttgcagtgagccgagatagcaccactgcactccagcctgggcaatggagtgagactctctctcaaaaa

SEQ ID NO: 251691 - DNA, 265 bp, Homo sapiens
gatggaaggcttgcagagggcaaaaagagagaaggtataattatagggttggactcctaggcccatctgcttagaattacagagcagttttaatctttggctgaaacatgaaacaaatcagagccaatgaacagatcaaacagcagctgccacacacacaagaaacaaaagagagagatgaaacaggaaacattgtcccccttaaaaaaattgttgtaatatctgtgaagaaaaaagatagtatggtcaaatgattttaaaattt

SEQ ID NO: 251692 - DNA, 794 bp, Homo sapiens
ttggttttctaactaatttgttcatttcttctttttctttaaaaatatgatacttatattctgtgccagatttttccagtgtctaaaatccttcaggttctgattctgctttctattatttttgctattagtatcttgtttcatttcatgtctatgtcatatgactatttacaccgagctcttgctctttttaagcattgatgctttttatttttaaattgacaaataaggattgtatatatttatagtatacaacatgctgttttgatatatgtattcattgtggagtggctaaatcaagctaattaacatatccattcctcacaaaattatcatttttttgtgatgagaacatttaaaatctactcttttaacaattttcaagtgtagtcatgtgctgtgtatcaaggttttggtcaataacagaccacatatatgattgcatcctatgattataatggagctgaaaaattcctgtcacctagtgatgtcgtggctgtaccgtcctagtgtgttactagttatgctgtacctagtgtgtacgctagttatctagtgtgtcccagttacactggtataaacaaacctgctgcattgccaatcatatagaagtctagcacatttcattatgtatagcacataatacttgataatgatagtaaacaactgttactggtttgtgtacttactactatattcaaaaaagtttaaaagtaaaaactcaaaaatagaaaaaaaaagaggagaggcaaagaaaaaataaaaataggaaaaagcctataggataacgatat

SEQ ID NO: 251693 - DNA, 387 bp, Homo sapiens
ccatgacaaagagtgaggtgctgataaacggtaccacgtgcagggaccttgaaaacagattaagtgagagaagtcagtcaccaaagaccacatattacctgattccattcatctgcacggtccagaacaagggagtctacagagatagttggttagtggttgcctagggcttggggaagaggtctggggagtggagaagtgatgggtatagtatacacggttcctttttggggtgatgaaaatgttctaaaatggactgtggtactggttgcttattttaatatatctgtgaatatattaaaaaaccattgaattgtacactttacatggatcagctatacagtatgtgaactatttctccataaagctgggggtttttttgttttt

SEQ ID NO: 251694 - DNA, 491 bp, Homo sapiens
gtgatttgaatgtaacctattgcacttggcattggaagtctgtaggtaatcacgtagacaaagttttcaaaagtatgaacccagaagctagcctgtggaaaattctgccaatcttcagttatgtaaaagtctgagcagaggatttaattctcaaagacgcctgatcaaaatggaagttctgtcctgttgagaatatacatgataagcagtgtatgcaattataaacccaatattttttattttttgaggtaaatcacacaaaatagaatttatcagaaatcctgtgattgtaggacacagaccagtgccaggttcacaatgactgtgcctgtttgtttagtcatgtattttatgcatcccaacatgttggatcacatcgcatcctaaagacaaagagcagctttagacaaaagagaatgaaaaagtattcatcaatgaatcacaacaacctaaagaaacattccaatgataaaatcaccacacatatttat

SEQ ID NO: 251695 - DNA, 462 bp, Homo sapiens
aaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactctgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcatcccttggttctgtggaaaatatctttcttaggagttcttggcaatgtctaagtcagtgtctgctgatagaattagaccaaataaattttttggaggcttta

SEQ ID NO: 251696 - DNA, 216 bp, Homo sapiens
caacatctgcagacattgcccagtgttcccctgggggcaaaatcacccctggttgagcatcattgctttatagttgcctaggatctcatcgtcatctgcatgatcaaagcagattttgatccataatgaagagaaaaatcaatcattcgaaatcactctagattttataattggcagacaaaaacattaatactgtaactttattccatatgttca

SEQ ID NO: 251697 - DNA, 431 bp, Homo sapiens
tgagaaggcagtgaaggtaccaaagtgagtttgcatttctgactgatgaggtcctaggtccagtagctgcagcatgttcaatcagctggtggcgtcccagccggactctctgtgtggacgtgctgccccctgctggccactgggaccttacgcgctcactgtcaggaaaacaaaaacaactcgtgctgaatgtaaaaagccctgcattttggaatccttataaagctaataaaccacgatgattttctttgactgttacttcctttttccccctgtagagtcactcaaattctcttaaccctcattgagaccagaaaacaaatgtaaagagaaagaattgtgactgttttcagatgcaaattgaataataggatgcttacctctaagcatcctgtggtgtttgaaataaaagaaagaagcaactcttaatc

SEQ ID NO: 251698 - DNA, 464 bp, Homo sapiens
gttgaatatacaattactatatgactcactcctaggtatataccaaagataattgaaaacatgtcacacaaaaacttgtgcagtgtggaagaaaatgaagtaactaaggtgaaggctttctaaagtggagtcaggagattgctaggggattgcattcacacctgctaaaaagtcaaaccaccgaatagacctgtagaaacaactgaagtcagtaagtatctgccagccttcatcatctctcagcgtgagtaccctaattaaccaaccaatcagaatgggtttgagatttaagagttctacccagccaatgaactgcctctgaaaacttcttgtgggaatcccctatttaaaaaaccctctcctgtgcttgccttatgagacactattcagggctgctctgattcactgtacgtgaattgcaattctttgtttctcaaataaattaaatgctatttcctttgacc

SEQ ID NO: 251699 - DNA, 714 bp, Homo sapiens
ccctgtctcaaaaaaaaaaaaatgttttaagtgcaggccagatgtggtggctcacacctgcaaccctagtgccttgggaggccaaggtgggaggatcacttcagcccaggagtttgagaccagcctgaacaacatggtgatacccccatctctcaaaaaaaaaaaaaaaaaagaagggtgaggtgcggctgcacgcctgtaatcccaacactttgggaggccaaggcaggcagatcatgaggtcagaggatcaagaccatcctggctaacacagtgaaaccccgtctctactaaaaatacaaaaaattagccgggtgtggtggcgggcacctgtagtcccagctactcgggaggctgaggcaggagaatggcatgaacccgggaggtggagattgcagtgagctgcagattacaccactgcactccagcctgggcgacagaacaagactctgtctcaaaaaaaaaaaaaaaaaagaaagaaagaaaatagctggatgtggtcgtgagcacctgtagtcctagctacatgggaggctaggtgggaggatcccttgagcccaggagtttaaggctgcagtgagctgtgattgtgccactaaactccagccttgtgtgattctcccaaattactgagtttattagatgtgttttcaaagaaggggactctactagtagtaaagtgtgaagacagggtgacagtgagaccctgtctgt

SEQ ID NO: 251700 - DNA, 453 bp, Homo sapiens
cgttgcaataattcaaatgaaaaatgatagtagcagtggtggtagagtgaagtggctggactcctgcttatatatttaaggtatagctgaaaaaatttgctgatggatgaggtatagtgtgtgagagaaagaaaagtcaagagtgactccaaagcttgaggctttagcagctggaaggatggatttgccgctgaatggaactagaaaaacttcaggaagagcaagcaggaagtggaaggcttttgccatgttaagtttgaaatgccaatgagatatccaagtagtgctgtccaataggcagttggacatacaactctggtgtcaaaagagaggtttgggagtcatcagcccatggaacaggtaaagtcatctttgcatgagtggagacagaaagaagaggaataagaactgtgttttgggatacacctgtgtttggaatctggggacatgagg

SEQ ID NO: 251701 - DNA, 449 bp, Homo sapiens
tttcttctgtatacttttctatgctttctagattatctacatgagaatatactaattttatatgcaagaaaaaaagcacagtattttttaaatgcaatgaagacgtgcttattttcactcagcagtgttatgaaaggcacgtagtatatagagcccaaagccctgggattgcaccctgacactggcatttagcagcagtggaaccgcgagcaagtcccttccttttagagcgtgtttcctgttaagtaaaatcataaacaccgatcctttgtcctttttaatttaagacaagctgactttaaagttgtcaacaaaatatataataacactgttaggttaaaagaacacagcaaaaattcactgaaccctccttaccacagttttggaaggatctgagatgatggaaaactacctaggcttcatcttttcacatatgtctacacaacccg

SEQ ID NO: 251702 - DNA, 667 bp, Homo sapiens
tcaccattgtgaaagtattaagagatggggccttttgggaagtgattaagccatgaggactcaaccttcatgaatgtttcatcagtgccctaataaaagagactgaagaaagcatgtttacccatgaagctagacgggaggaatggaagggccacaatgaagatctggccgtatctttcactacacccttacatttactaccacattatagccaaatagggcttttaaaccattttttaaacaatttttcttttttatctttcagctcagttattttgcttctatttttcctcagcttataaaaccccacatctctacttttgaaattataactattcattaaaactcgttcatttgttgctttgtctttgatcacagccagaagtgatatctatcttcggaacacctatcattccttgtttataccacttttatattacttcttatttacttcaaaaatttttgtttccactaaaagttaaattccttaaggaaagggaacatattttggtcattttatgttatttcacagtgccaacacaatgccttttctgtagtcagcatgtaaatatttgctgaacagatattatattacatatttatacttaagcagcaagatagaacctttaaaaggaaataatgttttcctatttctatgggctaattt

SEQ ID NO: 251703 - DNA, 395 bp, Homo sapiens
ccctgaaaaaaataaaagaagtatcagtaggcactttgccactaattactttttaagaatacagctgtagtgccaaagagaatgcaggtaaacattagaaagatgggagaaggctggtgtggtggcttacacctgtaaccccaatactttgggaggccaaggtgggaacattacttgagcccaggagtttgagaccagcctgggcaatatagggagaccttgttcctacagaaaaactttaaaaaattagccagatgtggtggcacacactggtagtcccagctacttggtaggctgaggtgggaggattgcttgagtctgggaggtcgaggctgcaatgaggtgtgatcacgccactgcactccagcctgggaggcagagaaagactctgtctc

SEQ ID NO: 251704 - DNA, 109 bp, Homo sapiens
ttgttgctttattcgggggatatttactttccttttgaaaagaaaattcttgaagagaaacctgatggtgggatttcaggcactgtggcaggaagtaagaaagatgtgt

SEQ ID NO: 251705 - DNA, 478 bp, Homo sapiens
atgctcatccacgttagaagcagcagtgaaaggcgtgttgcttttcattattaacttcaaatcccagtccctaaaccagctcttgacgcccctctgtcaggtgctaatcctggaaactggaggccacctggtctccactttaggtgaggaaaacctgggagaagccatcagactgcacctgtggcatgagatgctttgagacaggtcaagaggaggagcaaagggcagtttggaggagaaaagtattagccctaaggaacaagtgcttttggaagctcagcccggtcagcctggtggaaagccgtcttcagcagggaattcagggcttggtccaagctcttaagtagaagcagggacaacacagtgcccctgtgggctgccagcattccttttcatttgggtgatatttgtgcaaagtaaaaattggtttactaatctttttttctcaagataacaaaaagagacattttgtttaaaa

SEQ ID NO: 251706 - DNA, 438 bp, Homo sapiens
ggaaccaataatagtttccaaaccttgaattgtcctgagggatagaaccaggatcctcttaaagaaaacgtagtacatatacaacatggaatactgtgcagccataaaaagtgaaatcatgtcctttgcagcagcatggatgcagctggaggccattatcctaagtgaattaatgcagaaacagaaaaccaaatactccatcttttcacttataagtgagacataaacattgggtacacgggaacataataatggaaacaatagacactgaggacttcaaaacagaggagagaggaaaagggcacgttgaagaactacctatttgagtagtactgtgttaactgtttgggtgatggttccatcaaagcccaaacctcagcatcatgcaatatatccatgtaactaacctgtacaggttacccccgaatctaaaaagaa

SEQ ID NO: 251707 - DNA, 548 bp, Homo sapiens
ctactgtcaaactataacaacctagaagggtatattcttgctgaacgagaacatcaagaagacaggaaggaagctgaagatatctctgtcaagtcatcctctgtgtctgtcatgtgtcccacatgtgtagtcctaaatgccactgtctcacagttggcctcttatcaggacctaagccctgtggagacagcaacttgcagagccccattccaggggcagcaaggggtgggcaagatggaatcactcagcttaaggaaggtcttccccatctatgcttttgaagaaggaagaagtgggactatcattcactagtctaatcttactgctaaaattagactgagtgctccatctccaaacctggagggccatggtgtggtgtgtgtcacacaagccaaaagttgttcttcccaaggtctgggcagtggaagcagtataaacactgatgaataaactcatctgaattttaaaaagatgaagaaaattgttcctgtcccctggtggaacttttcaagtgacattgacaaataaacctctcaaaacctgtagaa

SEQ ID NO: 251708 - DNA, 461 bp, Homo sapiens
gcgaccgcactggagtacactcttaagtatagtttattgaatacaactataaatatccacatttggcagtctatacacagcagctccagcctggcttccctggacttttgcgctcttgcaaacaccaccctgacctcagcttggagacagcagtctccttccttcccctcgttcccccagccagctagttaccaagttctgtcaccacttctccctctccatgcaccctacttcaaaattagctttccctgctcacctgtgttcatcgttctgtctgaatgataaagagacagccatcttttttttttttttttttgagacagactcaccctgtcgcccaggctggagtgcagtggtgcgatcttggctcactgcaacctccacctcccgggttcaagcgattctcctgcctcagcctcctgagtagctgggaatacaggtgcacgccactacgcccagct

SEQ ID NO: 251709 - DNA, 553 bp, Homo sapiens
gtctcagtcgccctttttgtaaaatggacacggcttccctccgctcctagagcccctcaccaggagggcagtggcccgtgcctcagtctccccatccccattctcctgccctcacgcccaggcacggccaactccctcccagaagggtagggacaccgggcagttcccctggttctgtcccagggtccagcgcagggaaaggagagactctcaagggtgtgctccagcctcctcacaacggtcatcgtctctgcatgtgcttcattcacatggaaagttttactcattttatagatgtggacattgacgattagggaggccaaggcctgcaagacctgcagcccaaccatctctctcctcatggcaggacccgggagccggaggtgactcgccacctgacacaggctgtgaaacgccgggccggcctagtcggcaaaattggtcataaatgtgaccaaatttatttagaagccaggcgcccgcctcccctcctgggctgtgggccgagtgctgcaagaaggaagcccgggacccctcttggctcccgcggccg

SEQ ID NO: 251710 - DNA, 294 bp, Homo sapiens
ttggggtgaaggctgcagccctccaggctgctgggggtgcagatggctgtgccgtgctgagattggctctgtctggaggggtccagtgtggggtgcctgagggcactagggagaggtgctcctgctgcaggaggacctgagggtcagggcttggagaggacagggaacctgcggccgtctcttctgctttggggcaggggctctggcccgggagagggaacggggacaggagcagaggacggtcatccaggcgcagcggggagctgctccccaggccacagcagacagcactgc

SEQ ID NO: 251711 - DNA, 346 bp, Homo sapiens
aggggcgcgtcacgtgacctgtgcagccaactgttccgagacgtggcctttgcctgagctgctgttaggagaggtgctcaggtctggggagtagctcctaccatcgcctggactcgacttctggactggcctccaaaagtcgacacagcccctgcgtctttcctattccccaaaccggcgctgacctcatatttgcatacactgaaacttgtggctctccttgacttgggttggtaggctctataggacctcaccatgttctcttacccatggtttctgcagcagccaaaatgatccattccatgtgctttagagccttagggaataaaccattaatcaagtcatt

SEQ ID NO: 251712 - DNA, 468 bp, Homo sapiens
aaggagggtccttcatagccaagagaagcctggggagacgtgacaactaaatgcagtgtggggtcctggtgggatcctggcacagagggatgtctggaaaacactatggaaatctgactaaggtaggcactttggctaataatggcaataccgggtcattaattaaaacaaaagtacctaccttagtaagatttccattgtgaattacttggacagttacctcgtgcgagatgagctagtgggttgtaatggaatactatggctggaggctccttgacagatgtggtagacagaaacttgcatcgctgcaggccaaattgcagctgtgtgccgtgagtgtctgcaggctctggcagtacttgcctccgaaccaggtcattcacagagacatcaacagtgacaatatactgccgggcatggctggctctgccaaagccaactgacttcggatactgtgcacacataacc

SEQ ID NO: 251713 - DNA, 276 bp, Homo sapiens
aaggagggtccttcatagccaagagaagcctggggagacgtgacaactaaatgcagtgtggggtcctggtgggatcctggcacagagggatgtctggaaaacactatggaaatctgactaaggtaggcactttggctaataatggcaataccgggtcattaattaaaacaaaagtaccatattgctgtaagatgttagtttttggttttttttgggtttgtttttttttgtttgttttgagacggagtctcgctctgtcgcccaggctggagtgca

SEQ ID NO: 251714 - DNA, 330 bp, Homo sapiens
ttgtcccagagagaaaacatgggcccccaaggccctgtttcccctttgcaaggtgttagctgcaaacatgccaccagcagactgtgggttagactaagcataaagcattcctcaggcttttcaaggaacacaatagcacatgatccctttgagatttgaagtccatcttcaagcatccatccattcttcttctacctacatacatcatcagatcaaaatgtgccccatactgagagctgaaaaatgttttgtaaggaaactgcagcggtattgagtcagaatgtcgaggcagcacatgcagctttaatttggattaggatgacccagata

SEQ ID NO: 251715 - DNA, 313 bp, Homo sapiens
gtccgggaggtgaggggcgcctctgcccggccgcccctactgggaggggacatttggacacagacacagacatgctcagagggaagactgcatgaagagactaggaaaatgccatttggaggtagaggattgagtgatacatctacaagccaagtgttgccaagattgccagcaaaccaccagaagccaggcaaggggcatggaacagatatcctccttcacagccctcacaaagaaccaaccccgctgacacctggattttggacatctagcctcccaaactgtgagacaataaatgtctgctattttaagc

SEQ ID NO: 251716 - DNA, 690 bp, Homo sapiens
gtgatttgccttaacaattttttattctttggttttcacatccacaaaacctaaatgaatggctaggctgaaatgaagctgttgttacagaattgtgctcacagatcgtgaaatgatctggctggaagcattagcgttgatgacatttgtgtttgttctactttttcctgactgcctgagaagggcagccacaaagagcagcatagcatgcagtgactgccagcaagtctttgtggccaacagtctgcctctttgtagataatacctagatataatatgtagataaaataatatttttaaagagacaaagcaggtcttataagacttgtatggatgtatttgcaaaatgtgaagctgccttctagtatatttttaactagctttatagaggcaatgaggaagccaatttaaatgttgaaatttagattaaataaatatttcattaaacttacaaaccagttcttgtcagcctcttatctatatgtaaaactggtgtactgctgattcctcattacctttggcctggtagagagtttgtacaaggcagcacggttaatagttgaggtttattcaaagaataccagaagtaacagactaatcccagaggtctgaccattctgttctctcctcttacagcaaaggatttgattcaaagctactgagagcaagagaataactcatttctgctta

SEQ ID NO: 251717 - DNA, 378 bp, Homo sapiens
aggaaagaaatttaattgactcacagttccacatggctggggaggcctcacaatcatgatggaagagcaagggacatcttacatggcagcaggcaagagagagcttgtgcaggggaactctcctttatgaaaccatgagatattgtgagacttattcactatcatgagaacagcacgggaaaggtctgctcctataattcaattacctcccactgggtcccttccatgacacatgggaattgtgggagctacaattcaagatgagatttgggtgaagacacagccaaatcatatcactttacttggagaagctactgcattgaagcataatgtataagagacatatgataaagtatatttattttaagtgtacatttg

SEQ ID NO: 251718 - DNA, 433 bp, Homo sapiens
ccaaaccccaaagcctttgcatatccagtttcattaaatggagatggcttggggtttccagtgtacaaattgaaagtatataaggaaagcatgtgttgtatgagggcctgaatttcataatttatggatgttcatttttccccctaaatgtgtcattctttttgtgatagacatgatgagaaagaaactgggaaacatatagcagatgtgaggaaaataagataatgattcccccactaacttgtatgccgcgggaagattgggactgtctcttactactccctccgcccactatctatctatctgctgtttatagtgtagtgtctacactcagtaacttatttgttgaataaatgaatgggttcccctgtttatagtatagtgtctacactcagtaaccatttgttaaataaatgaatgaattcctcatagc

SEQ ID NO: 251719 - DNA, 527 bp, Homo sapiens
ccacggtttgatggtaatcccccaccctggagtgcccaatccaaaccttatgcaaattcgtatgtcaattggggtcacccggattcttagttaccgtgtagatggtactcaagtcccatcctgggaaggtacagggcccctcccacattatgcatagtcctgtggcctaacagtttcctagtcattcctgcgatgatttcccactttggctgagttctttcccaccccattgtggaccaaatcaagggctccttctccttggtttcctcctaaagcatcactcacggcatttagcagcatgttgtagaactttaactgctggtgggagctacagatcagtactggacaatggatgatgtagagttaatatcagacagccctgttcttaaaagtcccctatatcatttctgccagctcccagactccagattcccactgtgtgaactctctctttcctaatctcctctctcctccatctccttcctctttcccactcctactctaagtccctttacattttctaagca

SEQ ID NO: 251720 - DNA, 412 bp, Homo sapiens
tttctgggatgctgatgttcagctgggatgggcctcttcagagggccctgccacccaccttctgctggagcacacagtgtgcaagggacagctgccctccttctggctatccgccacttagggcccccatggaatagcttgtgaacagcaggaggggtggcgtctctcccactctacttaccccgcactgccaggctccggaggtggggaggagggggacagatggccacggaatgaaggcaggaaggaagtgctaggagccaaggaagagaggagcaagaggctgccccagggaggaagcaggaggaatccagagggagaaaagacagcaggccccacagaggctgggctggacctggagagggacaaggagctggtcctggggtgggatgaggccagagctgtggagaag

SEQ ID NO: 251721 - DNA, 115 bp, Homo sapiens
gagacaacttgacattgtggacatcggatacccaaggagacgaagctgaagcaggagaaggaggggaaaattaaccggccttccaacttttgtctgcctcattctaaaatttaca

SEQ ID NO: 251722 - DNA, 405 bp, Homo sapiens
gcatagcgacctttacaatccttggtgcatattactgagcagtatgttactcactgcaaggtcatctaggctctttctttcaagaatgtgagccaaaggtttgtgtagtaaactcagtgatacagaaaagacactgtaagagcatgtaaacagtaatagtctttcataagaattactctcttaccagtctggttggatcggaaaccaaaaatggcaatatagatagcatagtacgatggttaaggacattgactcaggtaagacagtcctgtgttttaaccgtgcccagcctagacctagttttttaaaaagtacatttaattatgtaaatataaagaaaacttgacaaattttcaatattgatagaaatatatagatctttttttctgatacaaatatcaaaca

SEQ ID NO: 251723 - DNA, 449 bp, Homo sapiens
ctcccctcttatctcccctggcttcccctcctctcgggcgctgcgaaaagcagccgcacttagtcaacaaatggcacgtgggagaagttggtgagtgtttggtgaggactcttcagggcttttcacaagaaccctctgtacacaaagtaagtggcgtgtttactcgggcctctccagccagagctgtgcctctgctccgctgcgcaccgcggcttccgaaaggagaaaggagagaagaaagggcggggagagcggggtggaggatttggacaggccctggaggcttgggctggggaggcctctggcctcgtttagttctcggcccggcaacctcctctcggcctaggcttcgccgcggcctccgcagctggaatggagctgccaggacccagtgacgctcccgcccctttcctcttcttccaaggggccaggtgggctggggtgcggcc

SEQ ID NO: 251724 - DNA, 469 bp, Homo sapiens
aaatcaggaagtgtgagtccttaaatgttgttctttttccagattgttttggctctttgggctccttaaagatcgatataaatcttatgatagatttctctgtttctgcaaacaatgtcattgggattttttttttcttttcttttttttttttgacaggtcttgttctgtcatctaggctggaatgcaatggtgtgatcctagcttactgcggccttgaacccctgggttcaagcagttctttagcctcagcctctgactagctaggattacagatacatgctactatgcctggctgtcattgggattttaataggaattgcactgaatctgtagatccctttcagtagtatcgtcattgtgacagtggtaaatcttcccagccatgaacatgggatatctttccactgatttaggtctttttaaatttttcttggtaatgttttatagttttcagtgtacagatctt

SEQ ID NO: 251725 - DNA, 359 bp, Homo sapiens
ccgcctcctgggttcacgccattctcctgcctcagcctcccgagtagctgggactacaggcacccaccaccacgcctggctaatttttttgtattttcagtagagatggggtttcaccgtgttagccaggatggtctcgatctcctgacctcatgatcttggcctcccaaagtgctggcattacaggcgtgagccaccgcgccctgccaatagttcttatttttaatggaaactttaaaatttatctgtctgtgtgtctattagagtcttgctgtgtcacccaggctggagtgcagttgcgtaatcgtagctcaccgtaacattgaactgggctcgagcttcccagagtgctgggatta

SEQ ID NO: 251726 - DNA, 631 bp, Homo sapiens
ggagaattgcttgaacctgggaggcagaggttgcagtgagccgagatggcgcccctgcactccagcctgggtgacagagcgagactcctgtctcaaaaaaaaaaaaaaaaaaaaaagaaccaagtttgaacatcattcatgtctgggcttgaagaatagacagaaaggacaatagctagagatgccacagagataatgtcaccaagcaatgattacctaggctaagtcagctaagcctagagagtatgattgaaaggggtatgaggaaagttaagtgtgaaagtatgtatgtaaatgaatcacttcccttcaaagtagaatttcagatccatttagtattcatgacattattggtcttatgtgtgttgttttcttgacaataggagtttccctcctaagtgtaagtagtaatacttaaatattaataaaagaacatagtatttccttgtcccccactacccatccttacgccgtgttgtataatttattgtaaataaattgttaatgatacattcttgcactagaagtgcacaatttttgggttcagtatgtttcttaaataagaggtcacagtaaaccaaatacttactatgaaacaaataactggtactccacagttacaatcttaatg

SEQ ID NO: 251727 - DNA, 367 bp, Homo sapiens
gacttctctagtgacatgaccctaatttagctttaaccttgactcaaatcagctctcaatccattgtgttctgatttagaatcaatttggattcttagattccttaataagtaaatgaccaaacaaaatcaaaataccttaataatatccagattaagacacaacatgatataaagttgtttctgaagaaatatttaattttaggaaagtgagattttatagctttactatagaacattccacagccttaaagttactgatttaactttcatttttcactttttgtcttaaacatctcttatcccataaagtagtaccaggcaggaactacagacttccaaattgcttttctattttttttcctgtc

SEQ ID NO: 251728 - DNA, 360 bp, Homo sapiens
agcacctgctgtgtgcatgcagtcactctgtggaggtcacaaggccaagcagacctaaaagagggcagattggtccaagccttatgagcacagtgccttatgggggatcattatcctggggcaggggaagccttgaactgggtcaaaggatgggcccccccaggcaacgggacagtgctggtgaaggcacagcagtctggaagaactctgtggccaagacagcctggtttcatctttctccatcattaatgctgtgtgaccttgggcaagttactcaacctctctgtgcctgaggttcctcactcgtaaagcaggattttaataaaaatatctatgccttagggctattgtgagcattaa

SEQ ID NO: 251729 - DNA, 345 bp, Homo sapiens
tgtatgatttttcaaaaatttgattttttcttttgatatggtagggtggaatagggatttattcttgatctgaagtctaacgctctacctctgagctatcccgcctcctgggatttattcttgaatgttgtagaagcttagtctgattttgtttaactttaaatatgctttggaataaggattggcaagtaaaaattctggtaattttaggaggaattgacctttcttactagttgttttttctttggctgctgacgatggggaactaagggaaaacgtctgttgtatccctgaagttttttgttttgtttttaaacgggtctgaataaaaatgccaaagtttta

SEQ ID NO: 251730 - DNA, 462 bp, Homo sapiens
ttggtatctttcaatattggtttcccaaacaaaaaacattgtatgtctttctctttttccagtcttcttttatgtctcagtaaaattttgtagcttgcctactacttattttcaggttaaatcctagatattttcaattcttactgccattatgaatgaatgtttttccccatgaaatgtttaactacagctgatttagggactcactgagttttgatttgttgatttgaaaaactaccaccctgttgagctcatgtatttattctaagacattttttgagattttccaggtaaaaaaattatacctagatgaatttatagaacaacctaatagcataaaagcaatagattattgttcaccacattaatgggaatgcctttcctcttaaaattatgatatcttgggctttgtgtttgtgacagcatttctttatgatggaaagagactatccttccagttct

SEQ ID NO: 251731 - DNA, 462 bp, Homo sapiens
catctcaaaaaaaaaaaaaaaaaaagaaagtcagagagcttttgcataactggcccagagggtgtggtagatggagctacactcagactttggagcctgactaataacacaattagagcatgagcaagaggaaggccaggggcagctttgacatgggaagagagctacttacatactgaccggtaattgataatgggaacaaacgacctgcccaaattactttccaaaaagtctctgttgggagacatttcaagtttagaaatgaacaattttgagatgatctgggcagatttgaaatcttgtgaaatcccttcaaaatccgaaaatgagtgtgtgagagcccagcgtgtgttttgtgaagacttctcttgtgtgtcttgtattgcttagagggcatgatttgatgacatggtcagaacattctgggcagaatcgttacatcatcagttcttgtcatattgg

SEQ ID NO: 251732 - DNA, 510 bp, Homo sapiens
atgaatacgacctaatcaccctggtgcttgtaaaaacatgttatctaggaggaacaaaaagtgtttttagggactggacacgatggctcacgcctgtaatgccaacattttagaaggctgagacaagaggactgcttgagttagagaacagtgtgggcaacataggaagacctcatctctacaaaaacaaaacaaaaaaaatattagccgggcatggtgacgtgcacctgcagccccagccactggagaggctgaggcggaaggactgcttaagcccatgaagtccaggctgcagttcactatgacagcacaattgaactccagcctgggcaacagagcaaaaccccatctcaaaaaataaataaaataaaagtttttaggaactaaaaatttcaatgaaaaccaaaattagtattctgatcttactgtactatttttctgatttatttcaactgaaggctaaataactatataaaaggtgtcaaaagctttgctaaaaatttcacaatt

SEQ ID NO: 251733 - DNA, 377 bp, Homo sapiens
gcctcaaactcctgggctcaagtgatcctcccatctctgcctcccaaagtgctggatttagaggtgtgagccactttgtccagcccaaggtccttacaagtgaaagacagagacaggagagtcagagtcagagaacaagatgtgatgacaggagcaatgatgagagtgatgcagagtttgtctttgaagatggaggaaggggccacaagcaaaggaatccatgcaggctttagagcccagaaaaggcaagaaaatgggccttccccggagcctccagaaggaacatccctgccaacacttctacttcagccaagtgagactcttgttagactgctgatttccagaaccatgaggtaataaatctgtgttgttttaag

SEQ ID NO: 251734 - DNA, 397 bp, Homo sapiens
ctcctttgtgttctcagttgttagcaaagggatcagactagtcattccccagaggtccttctaactttgaaattttgtctctgacatcacaaataatttcatgctttcattaaacatttgtgtttctacctctggcctgtagtccttggactcttgttccataggcgtagggttgtgaatggcaaaagaggatcttggtgttcttttatgaagtgataccaacatatttcacttctaggataatgacaatattggcaatatgaatcttaacatgagagttaactgattaactttttgtgtttttatggaattgctcaattggttatcataaatagattttgttaaattccagcctttatgtaatttctaagcacatttcatttgtatgtcttattta

SEQ ID NO: 251735 - DNA, 458 bp, Homo sapiens
agggtaaggcacggtggctcacacctgtaatcccagcactttgggagggcaaggtgggcagatcacttgagttcaagagttcaagtccagcctgggcaacatggtgagatcctgtcccttaaaagcgtatctgctgctctgaatttggtattttaacaccacttactgatacctttcctgtaaacctgtagatggtttaattcttagtcaagagaccagtctcatctaaaactatcctgttgtggtctgacggcaagtaactcatcttgagtaatttttgtttctccttaagtggcattttgactgtccattgcagcattctgatcttaaaagacatccactttgctaatgcacacgagattctcttagttgaagtaggagaatcaaatggagcagttgtcctccccccaccccatgttcttagaagcacctctgatggagttattctgaccttgagt

SEQ ID NO: 251736 - DNA, 383 bp, Homo sapiens
ctgggaatgaacctggaaaaattcaaaatatggtctagtcttaggcaagtttccttgtccggctcagctgctgagaccacatatctggaccctcagtgccctggcaacagctctgtgcaggcaggatgaagcacaggcttaggtcaagcaatcagccgtcaaaatccacactctcacctactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctt

SEQ ID NO: 251737 - DNA, 446 bp, Homo sapiens
ctgtgataggcatctacactgaagaacctgatgattccagtaatgggtcatttttgtctgaaatcatctaatttctgacgtaaaattcagccatagtggtcaaatatgatgatagagaccatttgttagtcaaaagttggaacttcaatatggaaaacgcggccgggtgcggtggctcacgcctgtaatcccagcactttgcaaagccgaggcgggcagatcacctgaggtcaggcgtttgagaccagcctggctaacaaggagaaaccccatctctactgaaaataacaaaaattagccaggctcagtagcacacgcctgtaatcccaattacttgggagcctgaggctagagaatcatttgaacctggggagtggaggttgcggtgagcggagatcgcaccactgcaatccagcctgggccacagggtaagactccatctcaaa

SEQ ID NO: 251738 - DNA, 416 bp, Homo sapiens
aaaaacgatcaccacagtcattttgagaacattttcatcggctcaaacagaaaccccaggccatatgtggtatttcatgcccataatcccggcactttgggaggctgaggtaggtgggagcagcacttgagtccaggagttcgagaccagtctgggcagcatagcaagacttttttatttttatttttttgagacatagtctcactctgtttcccaggctggtgtgcagtggtgcgatctcagctcactgcaacctccgcctcaccctcccaagtagctgggactacaggtgtgtaccaccacgcccagcttatttttaaattcttgtatagataaggttttactacgttgcccaggctggagggtggtggtttttatattccttgtgtgaggggtgtctgtgactcgtggaaatg

SEQ ID NO: 251739 - DNA, 292 bp, Homo sapiens
gtttccaaaacccagatccccaaggtttatctcaagtccaggagcacctcaaagacctcatggcaaagccaggtagaattgctcagcaccctccaccacaacctcacccagtcctctgggtgaataatatgggcacgcctggttgctcccagagcctaaataggcacggaaggcaaggagggcggcagccatgtgtcctgggaccaggcccacttggcttccaacaactgcttagctctgtccacaagttaagtcagcctcagtttcctcttcagtaaaattttgagactga

SEQ ID NO: 251740 - DNA, 765 bp, Homo sapiens
tagtaggagcaggtttatgctgaaggaagtcagccacattatgcatgcataaaaattgccattattgatatagtaatcttgccaagaatatagaccagcctgatacaggatatgaaaataactgaatgatcttggaacttattttatccatgaactaatatgttaacacgtaaccctttgaatgtcaggttccaaataactaaggccatatcaaatgtgaaattaacacagcatgtggaagtaaacttaaaaactaagaagttctttacaaacataatcatttcttaacttttacagttaatgatgtagaacttctaaggtagtgtgaaattaaaactactcattaattttatagtattttagaattgaaaaggtgacagatctttaaaaaaaaaaaacctcgtcaaacgaaaactgttcattttggtcagtcatattcaaaaaacttagtctgggccaggcacggtggctcacgcctgtaatcccagcactttgggaggccaaggcgggtggatcacggggttaggagttcgagaccagcctgaccaacatggggaaaccccgactctactaaaaatacaaaaattagccgggtatggtggcgcgcgcctgtaattccaactactcgggaggctgaggcaggagaatatcttgaacccagcaggtggaggttgcagtgagcggagatcgcaccatcgcactgcagcgtggtgacagagcgagactccgtctcaaaaacaaacaaaaacaacaacaacaaaaaaa

SEQ ID NO: 251741 - DNA, 1094 bp, Homo sapiens
caagggaaccgttgtacaacagaccaggaaaaacaggttcatagttctcttaccaactggacttgagatgaagtttaggtcatattgaagaaatagaactaatcttttttatataggtgtgtgttgaagaccaaatattttctccaaaatactgtttagctaagtgctgtgccacacatggacatatggtgcataataaattcacttcccttctttccaaagatacaccaacattgccagagtagttgactcactagtttaaaatcaacatttacttactgttgtccaaccaaaggatcaacccatagattcttttttaattgaaattttaaaatctttatatgtggaagtggaattagatggagactgatgcttgcaatgaaagccttactacgctttgtgttttggggctggagagggtggggggagcctgtattttctagatttctgtaaaattgagttacagatgaaatgccacttgagacaatctcgttaagtggggggccagaccctggcttttaaacatgaagaatttgataaacagggtcctagggaagagtcactctgactgtttagggcaagtgcatcctctgctggccaaaataagtatagcacctgctattcctgacttctgcatcctttttccatcaagctcaacgtcagagagaacttcatgtggaagtgcagcatggttttcaggaaagcagtattttaaaaatattatttaaaaggaaggactgtaaggaacaggtaaatgttaggaaatgagaagcagagcagggaagagaagagaaaaaataagatactgtgatttcagacaacctggcatcacggcccagagctcacttctggggtgggtagggctgacgctctcagtcattgctttgctatccagaggccccccaatctgagctgtaactcaccttctagccccactggtttttacattttttcctttttctccttgatgatctaaggtagctgtcaaaatgaagtctggtgaacttttctgaagtgataggtgaaacatctgctttctgcacagcactggaatcatagcactcaatggatttagctctaaagagaaatttagc

SEQ ID NO: 251742 - DNA, 467 bp, Homo sapiens
atgtgacttagagattttggaggagtttggagatgatgatgggatccaaggtagaaggtagactctggtaatattgaaagcgtacccttggctggggaagaaggcaggagaaggtgtcttggtataatgtactcagtgacatttttagaaaatgtggtgtaagatctgttgtcccaatttagctagtgttgtaaaaggaccatatgtggctaaatcattttcgtttccctttaggaacctagaagaatgtggcatctgaagtttcttagggccagtgcccatgttttctgtatccctaaagcattgggcagagcagtgagcagctgctggacactccacacgtgtttgcatgagtgttttctcatgtgactttgctctcatttgatttggcttctctgtcagtctgcatgcatatgagaaggcttcacagtaaagttttaagaaaataaatacaaaaaattgaaatg

SEQ ID NO: 251743 - DNA, 503 bp, Homo sapiens
atgtgacttagagattttggaggagtttggagatgatgatgggatccaaggtagaaggtagactctggtaatattgaaagcgtacccttggctggggaagaaggcaggagaaggtgtcttggtataatgtactcagtgacatttttagaaaatgtggtgtaagatctgttgtcccaatttagctagtgttgtaaaaggaccatatgtggctaaatcattttcgtttccctttaggaacctagaagaatgtggcatctgaagtttcttagggccagtgcccatgttttctgtatccctaaagcattgggcagttctagctggcaatgctgatcacatcttaattatcagtaaaggtcacagtcatattactaagatagaatttaattctcaaataatgtccttgttcctcgtattcgctaaaggcctttgctcccaagaagtcaaagtagaatatattttgtagctgatagaacagatgtctgacagacagcacaagcttcggg

SEQ ID NO: 251744 - DNA, 663 bp, Homo sapiens
agcgaaagtagctacaactctgagaagctgagacagaggtactcaatagagccattcctatgagaaacgtaagtatctgctgttttacaccgctaaggttttagctaatgtattatgccataatagataagttatatacaacctttatcaaataataaaagtaaccatcatcagtaatgagacaaatcaaaaaccatggcccacccaacagaacataatgaggagagtacagaattgcttctgggatatttctgacaaagatgtatatgcttcattcatacatgaggaaacatcacacatactcaagatgggagagccattctaaaaaataactaggcagaaaccttcaaaaatattaaagtcacggaaaccaagaaaaaatatgaacctgtttcagattaaaggaaactaaacagacctaacattttaatacaatgtttgattttgaacttgaactttttgttatataagacactattgagacaagtgctaatgcttgaatagggctgaaggattagattataataatacattaatgcaaatttcctgattttaaacattgtagtttgattgcacaaggagaatgtctttatgtgtggaaaataaatagtcaacattctgtcttcaagcttctgagaaaactctgcttttagggcatagata

SEQ ID NO: 251745 - DNA, 491 bp, Homo sapiens
  misc_feature (356)..(356): n is a, c, g, or t
gggggcagtttccctcatactgtcctcgtggtagtgaataagtctcacaagatctaatggttttatcagggatttccgcttttgtcagggtcttttcccctcaaattgttaaggcagcacttgttacaaagccaatcttcaaacttaggtctgggattgctataatgcattgcaatgtgctttccttgaatcaccaactttttctgtaagaaaagaagtaattagttattcccattgtgaggaacatgtgtccattttcccagggcagagcacacttcggaaaaatcagtgttctggaattcaattgaccacatacggggaggaccaaccaccggcacctatactctgcccatccnatccttcagataggccgtaagagaatgggatgcggagtaaaggttaacggagtccgggagtgctgagaaagctgtctaaacactttacgctgacttgcaccaagccgtgtctcccgcggagacagaagtccttac

SEQ ID NO: 251746 - DNA, 741 bp, Homo sapiens
acgcctgtagtcccagctactcaggaggctgaggcaggagaatcacttgaaccgggaggtggaggttgtagtgagccgagttcacaccaccgcactccagcctaagcaacagagtgagactccatctcaaaacaaaaaacaaaaaaaaaaaacatgtccagaataggcaaatctgtagtaggcagcaaattagcagtcgtctagggatatgggcacacatggggaaatggcaagtggctgttaatgggcatggggtttctttttgggtgatgaaagtgttctaaaatcgattatggtgatcctcagttctgtgagcttgctaaaaaccattgaattacatattttaaattgtgagttatgtggtacatggactatcaagctgttacttaaatgcctggagttactgtaaaagatgtgaaccagcaggagttcatcagagctctggcagccttcctcagaaagtctgggaagctgaaagtccccgaatgggtggacaccgtcaagctgctggccaagcacaaagagcttgctccctacgatgagaactggttgtacacgcgagctgcttccacagcgtggcacctgtacctctggggtggcgctggggttggctccatgaccaagatctatgggggatgtcagagaagtggcggcatgcctggccactttagccgaggctccaagaatgtggcccaccgggtcttgcagcgcctttagggcttacaactgcggatatggcct

SEQ ID NO: 251747 - DNA, 428 bp, Homo sapiens
cagcaaaggacctatggccaagaaatgggaaaaaacctagaatggaggcagcgtgaaagaacagaagggcatctgtggcatattagcaaatgcacaacaattttttaaaagaaattaacagcccaccaaagggcaaagctgagcacgggaaggaagactgatctctagctaggcagctttcaggcatcctgcctcactgcccccaggccattctgtgagctcaatgcccaactccatcagctacattcctggttctcctgttcaagtttccagttgccacttaagctctgcacacacagcattttcaaagcttgtgagtgaagctgcagaataattccatttgtgaagcaattacaattcagtatcatgtcccacagatgcctctaaacccagatatgccctaatctcatcatttaaggttttgtgtt

SEQ ID NO: 251748 - DNA, 585 bp, Homo sapiens
accttcaggctgattgcaggccgcctactcatgcattattggaagcgccgccctagcaatatcaaccattaaccttccctctacacttatcatcttcacaattctaattctactgactatcctagaaatcgctgtcgccttaatccaagcctacgttttcacacttctagtaagcctctgcctgcaatcaagcctggaaactggcatagtatgagaaactggcccaggtggaagccgatggtgagggaagcgggaaggcagaccctgccatctggggctctaggaccccacacacttccagagtccaccttgagcaccgctgctcaggggacactgtaggggatggtttcaagtgggcctggcataaactctgccaggcagcagggggacttccactgccaatgtgaggaaccagggtttgactccaagggcgatggggcctcagcaggggggcatgtgatcatggagagcagaaggagctggggaggagacggccagggagaaccaacacttccaggccgcacacctggctctatagtcaggcctgggcttaatacctggctctgttgactgtgcgacttgggg

SEQ ID NO: 251749 - DNA, 203 bp, Homo sapiens
gggtgagaatctggctgttggtggcatggcgtaaataaaatgcttgtttttgaagctgtccaggatcatcatctgtacagttggccagaaagcagctgttgagcctgggctgacttatatcagaggttgcagtgagccgagatcatgccactgcactccaccctaggtgacagagtgagactccgtctcaacaaaaagaaaaa

SEQ ID NO: 251750 - DNA, 483 bp, Homo sapiens
acttttttggaggactcctgctcatgccaattatgagatacccaacagaaggtgcagctggaaataccatcttatgtcaatgaataacaaacactaacctctttgtgattattactaaaaggttaacctccttatgcaaatagtactcaaatgtatgattacagatttttatgtcaataaatattgtgaagggtaaaaataaggctattacaaaagcctctttggttattggatatcttactaacaacgtgacttctgtagcacttccactagcaggtaactgtgaaacctgtaagaaatcaggatatggacatatgctccttggtttttgaggcattactaagctaggaaaggtgacctgaaagatagctgcattgaacagtcttctccaggttaaaaaagaaaaaaaattccaaaggactaagattgcattcttttcatcaagaaaacaaatatattgcatttaagggcaagattgaaaaa

SEQ ID NO: 251751 - DNA, 391 bp, Homo sapiens
agcatgcgagacccctttgcagaggggcactgctgcgctgccaaggcaaagcctgaacaggaggaggagacgagggtcacagtgataataccccttggagggcaagctggggtgggccgaggaaggggccggggcagagcttgaggaatctgctgaaggaacagcctgttcaggctgactcaggtcggcccacaactcccttcaccaccccaggtcctttgaggtacagaggaggcaaaggagagagcagctttgcagcctgcaaaaggtctcctggcccaggcttgtctaatttgcagctctaggctcccgttcacagccccgcatgtctccatgctggttaggatgatgctagccctgtgataaacacatcccatcatttcactagctt

SEQ ID NO: 251752 - DNA, 454 bp, Homo sapiens
tttagttatagcctgataatgtttcttgagtcatcacacggagtgaatctataaccaggaaaacacataggaaccaacgctaatcttattcctgaagttgtccgtatgaattcatgagaagtcctgaaagtaagcatcttgcagggcaaatggcactgcctgatcctctaagctgaggttggtagttttcatcatgatggttttatttggatcagtgttggcatggatttaaaatttatgagtctagatcttcaataataataatatcaatgatatgattaacaagcaatttcttttcttgctgcgatccctgtttttctgttgtgaatttctcctatcttgaggatgatgtgatcacaaaatgggaaccttagactggttgatatttgtcttattctcatgtcgactacattttctgcttttttgtgccattggtcaaccatctaatcatagc

SEQ ID NO: 251753 - DNA, 391 bp, Homo sapiens
tatttttgctttctgcatattaatttatgatttttaaagtgtttaaatatcaggcaaccatttattttctgaacttttgagcaaacttggttgctaaaatagatttcagctaagtgaatacttttcagaaagtacagaaaaagacctttgtagaacagcgctttattattttagagttgtttgaaggttgtctaagtgaatgtgttttcaaggttgatgtatgaaatttccaggaaggttgatttagatttttttcttaaggtttttcatcaattaggaggcaatgttttgaaaacttggatgtcaaaaataatatttattagtctaacttttatattcacagtttaagttctaaagaagttaccaaataaatcttaagtgcgtgtgtttc

SEQ ID NO: 251754 - DNA, 397 bp, Homo sapiens
aatttatcttccagaagtttatctcatatgaataatcaggtaagtgtgcacagtagtagttgaaaggatatttagcatagcatttgtggaagattgccaaatgtcaaaaattccttcatgcttttatgttatatttcttgtaatgtgacgttgcagattctcaccaagcaatggagtctattcttcagcctttgactctgggttggacagatgacttgggttgggcaaaaagacattactaagtatattagaagctaaggcttaacaagcacttgcacattggagcttgctgtccaagcctctgagaccactggtgaagaagtccaggctggaccactatggatgagaaaccacatggagagaggacccctagttgcttcacagaataatgaactaa

SEQ ID NO: 251755 - DNA, 656 bp, Homo sapiens
tcaaaatttaatattacgaattgtgcaaagaagtatgttactttgatcagctttattttagagcttctttatcaagttatcatcagtcctcttgaattatttctgaaataaggggaaggaaggaagggaaaaaatatgaatgcatagatagatctaagcagatgccttcagagccctggaataatcctagctgggatatgggacatgaaaacaactctggcctactgctgctgggggctgttgcatggtgtgacataggaagtaaaatgttgctgtatgaataggaaggagggtcttcctgtcaatgagaattaatgttttcctaatgatttaacttttttactgaaaaaataatatgtgtacatggtaaaaatccaaattgtatcacagaaaatacagtgaataaaaccatcctcttaagagggtgtgtacatttataaatttgcctatgattgcctataaagtcaaagaagttgcaccagtatgcatgactgccaaaagtacataaactgagcatatccatttccctacattcttgcaaacattgtgccttcgaactttttggcctctgatagaggaaaaatggtaactccttgttttattttttatattcattattccttttgtaagattaaatatcatctcatgaataaaag

SEQ ID NO: 251756 - DNA, 271 bp, Homo sapiens
agtcataaaagacattgcaacttcctctttcctctgtcttgattgctcatggggaatccatgttgtgaagacactcaagcagtcctatggagaggctcgcatggggagtaactgagctgcctgccaacaaccagctccaacttgccagccatgtgtatgagccaagtggctccagcagtcctagtcaagctttcaaatgactgtggcctggccaaaatcttcagtgtaaactcaagagcaaccttgagccagaaataccttgcaatgccac

SEQ ID NO: 251757 - DNA, 488 bp, Homo sapiens
tcatttctcatatatggagtagcccacaaaggctgtatgcaaggtagtcttcagaaagcttacatcttcaccaaggcacatgaaactgcagaaagaagcaatgttaggcgttcctgataataattatctgcctggatgacagcagtcctgctttatggtcacagaccccagctttctgccagaacatggctcaggactcctgaaaatcatcccattcgggagcaagtgggtttaatttccttttcatgaaaggaaagattagctttcatgcaaacacttggtccatttggccatttaataagaagactgaagtctcatgttccataactttatcagcctaaaagtccctttgttgtatcataaacacataggctgaaacccctgtccttccaactcagagcaaattctgttgtattaaataaccatgccatgtactgaatatttttacacttatttattggacttgactcctacctccttcccgcaaa

SEQ ID NO: 251758 - DNA, 491 bp, Homo sapiens
tgctggaattacgggtgtgatccactgtgcccagcctgcttgccgttttattttgctccctttttccttccaccaggtcacgattgttataaaccataaaggtggtatcaagaagctgattttgattagtttgtggccccatctgtagtttttggagcttatgtctaacggctggggcagattggctaatgaaatgctgtgccattcctattttgcctttgggagaagaagggtccagattagtgtatttgttaaaagcttcctccagcctgccatgaaacatggctgaattttcctcctttccctgtgtaacctcccttactttatcataatttactgctttagttattccctttctcattcctccaaggagagcctaaagaaatttagcccagttgttcattcccatgggtgtgttatagtcccagttaggatcagtagtagggactgtgtctggtcctgggtgattgccctgagggtttcgggcaaat

SEQ ID NO: 251759 - DNA, 443 bp, Homo sapiens
attccagatttaacctttcagctaaatgataagcatctgaaaacacttagtaagactgtcttttccgaaacctggttgaaaggcagcacagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatggtaagagatgagtatttgctttttccacaagcaacaaggtaacgggcttttgtaaaactttatctcttccagacattaagatccaatatctttagagtcctgaaatatttacgataatatagcctttaaaatataaatgatattattaatacttacat

SEQ ID NO: 251760 - DNA, 441 bp, Homo sapiens
aaaacacgaaaccctcacaggacccttttctgcttgtggtccctgtgcctggctgcccagatgtctcggggagcactgttcccccaatatcttcagtgcctactcccttaccttcttcaggtctttcctcaaatattacctcttccattaagcctctctgattatgctatttaaaattgcaatccggctgggcgtggtggtcacgcctgtgatccgaaaacttagggaggccgaggcgggcagatcgcttgaggccaggagttcaagaccagtctgaccaacatggtgaaatactgtccctactaaaaatgcaaaaatcagccaggcttggtggtgtgcacctgtagtcccagctcctcgggagactgaggcaggagaatggcttgagcccgggaggcggaggttgcagtgagccaagattgcgccactgcactccaccct

SEQ ID NO: 251761 - DNA, 481 bp, Homo sapiens
tatgacctctacactctcccctacctgatgaagtgcctccattcgacccgcaatctgctcagagggcccccactcttgctgggagccttgggtaatagcagaggaagcctcttctcttcttgaagatgacacacctcttttcatccagtctaactgagagcaggctgaagagttacatggattacacggaataacatacccttctaccacagcacttcccggtccttgggcttgtcttccctgggtggagaaatcagccagacaagctactatccaagagggtaacagaaatcttaccagtacttggatgtgtttgtacctctcagcggtcaatctgggcattagatttgtggtcagaagacttgaattatatcctgactctaccggtttgagttgtatgctctttggcatatatccccctttgtaaataacaataataataataattaaagaaagataacaaaaaaggttatacctcact

SEQ ID NO: 251762 - DNA, 443 bp, Homo sapiens
gagaattctggctataaagcaaaattgctctatatagactgatcctagaatagccacacagctatttttttctctagactacactgtccaatttggtagccattagcccacatgtggctaagtttaaatatattagtgacaattaaaatttgctcagtggccaggtgtggtggctcacgcctataatcccagcactttgggaggccaaggcagatggatcacaaggtcaggagttcaagaccagcctggccaagatggtgaaaccccatctctactaaaaatacaaaaattagccaggcgtggtgatgggtgcctgtaatcccagccactcagaaggctgaggcaggagaatcacttgaaccagagcggcagaggttgcagtgagccaagatcgcgctactgcgctactgcactccagcctgggcaacagagactccatctca

SEQ ID NO: 251763 - DNA, 419 bp, Homo sapiens
ggcttgagctcctatgagaacctaaggccaccgccgccgctaatctgacaggaggcggagctcaggtggtaatgctcgctcacgcgccactcacctcctgatgtgcacccagcaggtgcgcaaagcagacgggatgaacgtctgggtaggtggaagggttgggagcagtcaggactcagggaaatgtggcaggagtcccagggagagggcaagaggaacccgagagccccctttgtcctccccccataaagtgtcaacagagccaccttcgtcactgagcacaaagctggcagatagaaagaaagtgctcgataaaatagccactaaataaaatgaatgcacagctttgaaaatcagttgattcttctagttcatagtcttcttacagcaaataaatgatgaagacacatcatttgtgt

SEQ ID NO: 251764 - DNA, 493 bp, Homo sapiens
tcactagattaagggatgccgagatggctggtattttttctgggtgtctgtaagggtgttgccagaggagagtgacatgactcggtggactgagaaaggaagacccaccctcaatgtgggtgggtaccatccaatcagctgccagcacggccagaacaacaggtggaagaagggggatgagcaccttgctgagtcttctccagccctctccctcttccgtgccagatgcttgcttcctcttctctgctgttggacatcagactccaggttcttcggcatttggactctgggacttgcaccagcagcttcctggagccttctgccacagactgaaggctgcactgtgggctttctggttttgaggcttttggacttggactcagctatgctaccggcttctttccacagcttgtagatggcctattctgggacttcaccttgtaatcctgtgagccacttctccctaattaactcgctttctatatattacata

SEQ ID NO: 251765 - DNA, 199 bp, Homo sapiens
aaaaaaaaaaaaagccctacaagaacttataacaagtttagcaagattgcaatatacaatcttgcaatcttcctaaagattatatacaaacctaacagaattgtatttatatatactgtcaataagcaattcaaaatgaaattaagaccacgattccatttaaaattgcatctaaaaataaacaaaataggaatagact

SEQ ID NO: 251766 - DNA, 438 bp, Homo sapiens
ggaaagaggagggagatgaggcctaggcgagtggaggacctttcctgaggctgcaggtgccaagcggtggacccttaacttggacccagactgcctgatgtggagcctgtgtgctttgccataaggctaggctactttctcccaaaagaggtgtttttgccttcctgccgcttagtctgctctcgcccactgctgtgacacactaggaagtgctctgtcctgggcaacagagcaagactccatctcaaaaacaaacaaacaaacaaacaaacaaacaaacaaacatatgtggaaccaagcaacccaggggttgcttggttgatctataaagtccttttcattgtaagattatatgattttcggtaaactgtatattttttaaaaacagtccagaatatccgcaagtgttttaccacgtgcttcttattggtggagaag

SEQ ID NO: 251767 - DNA, 601 bp, Homo sapiens
ctgtgcaaagcagtttggggacttctcaaagaactagaaatagaattgccatttgaccaatcaagccgattactggatatctgcccccaaaaagaataaataattttgccaaagagacaccagcactcacatgttcattgcagcactattcacaatagcaaaaacagaatttaaccagttacccatgaatcttttattggataagaaaaatgatgtacttatacaacctccaatactatgcagcaacagaagagaatgaagtaacgtcttttgcagcaacatgaatgcagctctgcttcaggccattctaagcaaattattgcatcagaaaaacaaatgccacatgttctcactcatacatggatgctaaaaattgggcgcacatggaaacaaagatgaaaacaataaacactgagaattctaaaaagaaggaggaaggatgggagacaagcattgaaaatctgcttaggtatgatgtacactacttgggcaatggaattattaagtatccaaacctcaacatcatgtagtctacctgttttacaaatctgcacatgtaccttaaatataaaataaaaataataaaatgttttttggtata

SEQ ID NO: 251768 - DNA, 843 bp, Homo sapiens
ctgtgcaaagcagtttggggacttctcaaagaactagaaatagaattgccatttgaccaatcaagccgattactggatatctgcccccaaaaagaataaataattttgccaaagagacaccagcactcacatgttcattgcagcactattcacaatagcaaaaacagaatttaaccagttacccatgaatcttttattggataagaaaaatgatgtacttatacaacctccaatactatgcagcaacagaagagaatgaagtaacgtcttttgcagcaacatgaatgcagctctgcttcaggccattctaagcaaattattgcatcagaaaaacaaatgccacatgttctcactcatacatggatgctaaaaattgggcgcacatggaaacaaagatgaaaacaataaacactgagaattctaaaaagaaggaggaaggatgggagacaagcattgaaaatctgcttaggtatgatgtacactacttgggcaatggaattattaagtatccaaacctcaacatcatgtagtctacctgttttacaaatctgcacatgtaccttaaatataaaataaaaataataaaatgttttttggtataatgacatgttctatttttccagtgctgggttaatagttgaaattaggggtgaaagacaaatttttcaccccttaaggcatggtggtgaatgtttctataccaggtctcctcacattttataagctaacctgaaatttcttagtctatagcccaaaaagtgttttattttcaagtgtgcaagtaaaacaaattacacctttattatttatgtattaactgtacactacactatagacttaatt

SEQ ID NO: 251769 - DNA, 147 bp, Homo sapiens
tgggggtgaattttttaaaaaaggaaaaaaaaggaaaaggtagatatcaaaagaaataaatgacatccaaattggaaagtaaaaggtaaaactatattcacaggttacatggtcctatgcataaaaagcatcctaaagaatccacca

SEQ ID NO: 251770 - DNA, 633 bp, Homo sapiens
attgcatatctgtttatctccctgtgcatccatggatccaattcatctttaggatgcatttcaaagcaagttgctgacgtcagtacacttccctctcaatactttagtatgtggatcaataaccctagcttaagatttgttgattgtttttctttccttttgaagtaaaatttacacacaaggaaatgcacacatcttaagtggaccatttgatgagttttgagtaatgcccacattgtgtaactcaaacgtctatcaagaaagaacattaccatacctgagagtatcctcatgctcctcccctggggtactccctgcctctccacaccaatccccccaggtaacaactgttctgatatccccctcaccatatatacctgctctagaacatcatataaatggaatgatacaatatgtcttttgtataagctttattccactcagcataatgtttttgccattcacccatattattgatcatattagtaccttgctccttcttattactgagtagtattagatagtataaacatagcgtagtctattttcctattttgatggatatgtgggcttgttctgatttttgcttattatgaataaaacttctgagtattcttgtacaagtattttttg

SEQ ID NO: 251771 - DNA, 515 bp, Homo sapiens
ccttccccttttcagcaatcatgtatcccattagcctgtttgattgccgctgctcacaaaggggcgccttcgctgaaccgtcttcaatggcctctggatctctcccctgagagaagccggctaatttggaatgtggtcgtgtgtatgaatccgacacagcctcagtcacaatcgggtgtccttttctgtagctgctgtttatgatcactttgccttgcctctctgggagccataattcaccacatactggagataggctgggtgttcttttctccgtgaatcctggacaggatgtacacaaatgtgctagccccttcttggtgaccaggctaattcctcagtggcttggtgctgctgcctctcattagagggattccctaagcactatttgcttgacaaattttcaaggtttttaaaagcagaagcctttgctaattttcccaagttggcctaagagtccactgtgaactgcagcagaaattggggaaatttaataaatgttgatcaatgactct

SEQ ID NO: 251772 - DNA, 346 bp, Homo sapiens
ttgtgagaagagagagcaacaccagcaatgcacatgcaaagaggaaaggccctgcaaggatgctaagaacgaggacggccatccgcccaccaaggagagaagtatcaggaggaacaaaccggccaacaccttgatcttggacttccagcctccagaactgtccgcagcttgggctaccttccagcataaagtcactaaagatgtgccgggcatgatgaaggaagaaagcgactacatgctgaaggagatggtgcggggactcgctagtacctattggcaggacctggggaactttggtgggtgcttgataatggggactggaataaaaactggctaagcaaaaatt

SEQ ID NO: 251773 - DNA, 489 bp, Homo sapiens
tgccttcttctctctcctctccttgccctttgttctctatttctaagccttcctgattggtgtggtttaattaccagtctgcccttgcctccttgaagtcatctggaatgtctctgagacatcactgctgactcaaacccataagggaaattcaggagtatatgctccgaggatccaattcccttaagtaacagcctctttctgtttcatgtctagttaatttgtttaaatccgagacagaaggaagtgtagagggatcaccgtggttctctgtccccaggtggtgttttttgtaagcttggggaaaaattgccaccgatatacacttttcctcatgactttttatttttacgaggttccttctcctcagtttcttttggctttgactggatgctgctaacctttttatttaggaatcttttcagtattgctttcaaggctcaggaagtttagtatagctgagactttattcccccaggtcctgggtat

SEQ ID NO: 251774 - DNA, 480 bp, Homo sapiens
acctcatctccctttaatttcattttttctccttaggcctggaacaagatggctgttttttggagagtgaaactgagtgcaagtcatgtaatgtttctgtatgatgtttttggcagtgatgatgaaaattctagactgaaatgatattgcgtgaagtctggaccaattgctgtgttaaagtagaatgaatttcctccctttctgctgtctggatcaattttgggggcagttagagaatttagcctttcagttgaagcaacatattgtactgataacatgcaaaagtacagtcagtctgattggactcactgggcttttccaacttgctgctaatgtgatcattaggagagcttctgcaaaataaatataactcacagaggtttgttaagaagggttccagattccattgaccaacagaggaatgtttaatactctactataaataacaacaacaaaaagatgctatcccctcccctgaaa

SEQ ID NO: 251775 - DNA, 280 bp, Homo sapiens
aaaaagcagtcaccaaatgtgcctcctctcctgtctgggagttgtgtctgttcagtatccactgtgtcgatagcaaataaaaggactctaatcatttgttgactgccttgctgaaaccttgtccggaagagtgcaagtgtttaaaaataccatttttgtgagaaaagtagcgacatatccggaaatgcattctatttactgtgatgctcttacattcatcgtagcctagaaggtgggggaatttcttagtggggaccctcagacttttattgtttttttt

SEQ ID NO: 251776 - DNA, 569 bp, Homo sapiens
cccttaaagaagaaatctccccagaaggcatcatcatgttgcttaattgtcttctgcagcttcctttccctagagctttccctgtgttgctaagagctgaagatggcatcttcgtgatcaccacagtgagctcggctcgcctcggacggcccgggatgcactcttacaacatgtgtgactcttgaacctggagttcatcacattgcaacacggtctctcagagagaccgtgttgtaatggaaaatgtaaaacataaaaatacagaataatagaagtgcctaagtcaatctgcttggctcagtaaggaaaagcttcagagaacaggttgttggctctcacctgagaccagaaagatgagtaaaattttgccatgaacaagcagacagatggcattccaagaaatgaaaagaacatatgcataatcatgttattatgtggcagatattgttttaagagctttacgtgtaccacttccttaaaacataaatctaagacaggataaaatatttggagatttgatctgacccacagctcacttttcaaatagccttaaacacaagacatttgtc

SEQ ID NO: 251777 - DNA, 395 bp, Homo sapiens
tgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgtt

SEQ ID NO: 251778 - DNA, 310 bp, Homo sapiens
aaaagagggcattctctggctgttctgagagcctacctattgtctgagtgcattctggtatatatcataaacagaatccaactcaatgcaaagcaagaatgagaatctctatgtgttgggaaatgtggcctggccaaggtggccattgtatagaaatggctcaaaaagtaacaaacaagaatcacaatatctggaaatgggaattatgtaactgaaaatgcatttgctccagcgcattgcctttcatgagacattgctcaagtatgttgtttgcacatacagcagagtgtgctctgtgggggggaaaaag

SEQ ID NO: 251779 - DNA, 556 bp, Homo sapiens
ggtttttagtaagtttcatgcaatataactgacatgcatcactcattaatgtcaaaaatgcctggtctaggtgggtacagatattttcataacaggtattcagaaaaattagctatttttaacagtgttttattagtttttgtctcgttttctcagtgctattactgttttgcaattcagaattatcatttatgtatcttacttattccgtaagtttgttgtggcttagttaccattatgatatattgtgtagtacttttttcatttatatgggcacagtaaatatgctgtggctaggtaaaatgtaatatttatttcaataatgagacagccatgtattttctgccaattggtgtgtactttgctgtcaaggtgaaaaaatactcctttcagggctaacgtaggtttgtacaatgtgttttggtcataggatgtttgaatctgtccttccctagaatttatttgaatgccatgtaatcaccctttttttactaaagaatgtgattcctttgtgttcgtaaaaattaaagatcatgattgggaagttttataactc

SEQ ID NO: 251780 - DNA, 981 bp, Homo sapiens
  misc_feature (629)..(629): n is a, c, g, or t
  misc_feature (632)..(632): n is a, c, g, or t
  misc_feature (637)..(637): n is a, c, g, or t
  misc_feature (644)..(644): n is a, c, g, or t
cttccaggcaggctgcagtagcctggagcgccttatggatattaactccctcaaccctgacggcagcccagtggggagggtgcacttcccttcaagtcttacaggtggagtctcgctctgtctcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccacctcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaacactgtggaaanaanaaaanatatggnctcgttggcctcacggggggagtctggggccgttccctttaaggaggggtattcgggatcctgggtcatggcttcgtgcgcttcgcgttccggctggggagcgggattagctcgtcagggcgggattccgttttcccagactagggggtacccccggaagaaatggaggcgagggccggatagggccggaacgtagaagggcgcgggggggggtgttcatgggtcccgccgctgtgagcgtaccgaaggggccttaatccgggggggggcccggatcgagtttaaataccgcgggtgcccctggagcacttagggctgttgtagcagcgtgtgtgac

SEQ ID NO: 251781 - DNA, 676 bp, Homo sapiens
cttccaggcaggctgcagtagcctggagcgccttatggatattaactccctcaaccctgacggcagcccagtggggagggtgcacttcccttcaagtcttacaggtggagtctcgctctgtctcccaggctggagtgcagtggcgcgatctcggctcactgcaagctctgcctcccgggttcacaccattctcctgcctcagcctccggagtagctgggactacaggcgcccgccaccacgcccggctattttgtatttttagtagagacaggggtttcaccgtgtttgccaggacggtcttgatctcctgacctcgtgatccgcccacctcggcctcccaaagtgctgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaacactgtggatgcggccgaatgccgcattctcgctccctcctcttctcatacattcgtaa

SEQ ID NO: 251782 - DNA, 355 bp, Homo sapiens
ttccagaagcaaaaacaaaaaaagttcgggattacaggcgtgagccaccctgccaggcctcatgtttgcttatcttaaccaaaatgagccctcgtttcactttcctgttctaccctaaggaagataaaatatcattccaacttggggtagaggcaggtgccagtacccaagaccctgggctgtgcagcaggggctactgtaaacccaagaccctaaacttcctccctctgccagagccagggagcagctctgacgccctctagccccttctccgttagcctcgatttcaaataaaacactgtggatgcggccgaatgccgcattctcgctccctcctcttctcatacattcgtaa

SEQ ID NO: 251783 - DNA, 453 bp, Homo sapiens
cactgtgttttgagtgtaacctgtcacatgagctctggtgtggaattttctacttgtggcatcctgttggccctcaaaaagttttaaattttggagcaatttggatttttggattagggctgctcaacctgtattagcatagcattagtcagctacctgtatgattaccaagagaactgtcaactgcagaatacgggaaagtaaaaaaatgagaggcagggtgggtgaagctggaggtgggggatgtagatagagcagtttacctagtaaagcaatacttatttcaataggaagcaccaggttcagacataagatgtaataaaaagtactttttttcaataaaaggaaaagcctgtacaaaatagaggcagggcagtatcaccttgatatgtcagaataagcactgaaatactacataaaaaataaaccatatcaaaattatcccctaacccc

SEQ ID NO: 251784 - DNA, 474 bp, Homo sapiens
tcaaatgctcactgctggtcttgtcctgctctaaaatgttcagatatgtaatgggttatttttgtcggtatttgggtggtatttttgctctatgacctcccatttctctgacgtctctagattcctttgttatttgtgatttctgcttctggtggtgacaacaaaatctgccattgctgtgcagccgcctcacccatggagcaggcttatcctctacaactattctacagaaaagacaagcaaggtctgcgtggagtgaaagcgccttctttccatatcggatgctggaagctgtgatgttggcaaacggctctttgcatgaagtactgtgtactgaaccaggaaagtgaggtgcagacgcggaagtcaggtgcagatgtgttgggcagatgagctatggtgatggcgggtggccattccctataagagagtggctcctctattattaacaaaataaaaattaaagaaggtttc

SEQ ID NO: 251785 - DNA, 404 bp, Homo sapiens
gtgtagaggggaaggcatacctgtgaaaaattcaaccatgagtttcaacactctgccaggtactggggatggagctttgagaaagatgggcacaacccatgccctctagtggtttacaagcagttttgaatctaggtgtacagtacagtattacagttaccactggagccaggctgctctgtttgtcttagcagtgtctttttgggcagacttgggcaactcacttaacctccctatgcctcagttttgtcatttgtaagtaggcataagaaatattacctacttcatagagttgttcaaggctgtacatgagttagtgcctctgaagcacttggaacaattcctggtaaacagcgatgattatgattatgtttgctgttatgagaaaagagcaagggaagctt

SEQ ID NO: 251786 - DNA, 311 bp, Homo sapiens
actcacagatagcaagggcctactgaatttgtttaacaaaaaaaccttgggtcctacttagtctctctgtcaggtacttttctgaatgttctacaaatattcactgatttattcctcttagcaaccctgagaggtaggttttgttatccttcctattttgcagatgacactaaagcactcatttaattaatagttggtccaagattgctcagctaattggtgttggagctgggattcaaacccaggcagtctggctctacagtttatatgctttaacactattctctgctgagtaattctttcacaagaaa

SEQ ID NO: 251787 - DNA, 311 bp, Homo sapiens
atatatgttcctcattcagcatttatgtaaaacatatattattgagcacttatgtgatagaaaccgaggcaaaacagaaaataaaacagagttttattttgagagttttttttacagcttatcggctctgagaggacagacatgagaacaaataagtgcccaattctgcatttattttggaaggcagttttatgtgagtttaaatcagtaaagacatagatgtatatttttagttttgattaaaactaaaacaattggtagcccttattcatatttttctatcattaaaacttatctttaaaaaatgtctt

SEQ ID NO: 251788 - DNA, 669 bp, Homo sapiens
  misc_feature (667)..(667): n is a, c, g, or t
gccaatatttaggacaccacgtgtacatctgtagaccaccagctgcacccatctccacaaagccaagtgaaggtgtattggggattctctgccagcctgtgtcacccacccacctccttcattatcagcaatagctaccatcatttgtcaagcacctactagatgccagacaccctacacacattgcctcctattctcatccattcctgcaaagaagatgcaatgagcatccttggaacagactgggagcctgatcccaagaggctgctgaactggccccagtcacccacctatgtgccagagtcaggcctggccgacacaaggatctatgctttttctgtggtgtgtcactgcctttttaacaaaagggctgtcaaagtcaccattctttttgatgagggcagcgtaattacattgccttttgtcaggactgtgggtatgtgatttgtcttccacagtctctctggggctgtgtcctacatagcttctgactctcaatttttggtgccatgagctgagctcagtgagtggagctggcttttctgtcgctgagtggtactgcctagtccagatgtcgtggctcagggtgtaaatattcctaagaatggcagcatctatttcctcttttgtttgaattaaagactctgaatttctgctgtaaaaaaanaa

SEQ ID NO: 251789 - DNA, 655 bp, Homo sapiens
aacatggcaagaccctgcctctacaaaaaataaaaatcggctggatgtggtggtgcatgcctgtggtcccagctactcaagaggctgaggcaggaggattgcttgagccctgaaggtcaaggctgcaatgagctgtgtcgtgccactccactccagcctgggcaacagagtgagaccctgtcccagaaaaaagaaaaatccatactggtgtaaacccgtatccagattgactcttctcttaacaaggacacacttggcgttagtatggatctagcctcaaagaccctcgtcacagatgaagcagcccatcgtgaccagtcgaggccttaggaccgcaggaggaatgtctcaggatgagggtcaagcacactgagggtgtgggctggaaaaaagggatctagttgtttcttcctagtctcaggaagccagtgccccaagggttcacacctggtaagtgtaggcgtccttggatatgggctgtagaggaacagtttgaatccaggtgccgccatctaatagctatgtgacagcaaatttcttaatctgagccctggtagcctcatttaaattggacataatgccacctacctgaggatttgtaaaaggaaaagagaataaatgtctgttacatcataaacattatgatgcctgtaat

SEQ ID NO: 251790 - DNA, 498 bp, Homo sapiens
cccctttgagcatctgttttcagatattgtgcctcaaaagaggctattctgattgtgatttttgttgttgctgtagttgactgtcccagtacactgtagattggataagatccctgacaatcaaaacaccctcagacatttacagctattgccagttgataagcactgcaaaagtccattatttctgactaggaaacatattagctattgagtgttatttaatgcataaattcatttatcatacatttttgaactaggattttaaaacctagttaattcaaatgaagagggtatgtggagaagtgtactttgaagattttgtgaaacaagtttcctcttagcagattctcagcataccagtatgagatgaaataatgtaactgtttttgtatcggtatgtttggacatgcttctggctgctggatgaaggtgctagaaaactgtcctgtctttacttaccctcatggtgaatatgaatagaatgatagtttggtggat

SEQ ID NO: 251791 - DNA, 525 bp, Homo sapiens
ccgtgattctgatcccctggccaaatctttcttcctctggacagagggtccagtcgggaaaccttcccgaaagacggcggtcgggtcgggaaaccttcctgaaagacggcgcgccagcccgtcttgcttgctcgccgcctgctgacttccttactttgcacacggaaggggcaggaaccgcaagcgtgcaactagcctggagctacccgtctggactcgcaggccctgtggctgtttcccacagctgctacggcctctcttgctccttgacaccgaggaggaccccactaggatccgagcgtcgtgaactcacctgaactttggaaggttggcactggggggccgcatccccctgggaaatgactgaacgcggggtttcagtgggtcccgcctgggtctaaggacccagtttcttctgtgagcacgggcagtgggaggccggtggaaaggcgcaggggcccacctacgcgtctcacatcttcaggggcgcatttctacaataaaaactcacccaattagacctag

SEQ ID NO: 251792 - DNA, 345 bp, Homo sapiens
gagtctatgggtccctttgggtcccctatgggtccactggggaaagaagagagaagattcaatatgcaacactagagcaagctacatcgatttcatgtgtaaagaaaattaacctcttatgagaataaaaagtgactcaatttaagaaagccatttcaagccttcagacaagttcgctcggaacaaaattcttctgcattgccacagaatctgcagcagaggctgatgaactcctgggggtgagactggaggaaggaagaagcattggctgggagagaatgaggaggagaggggccagagacatccggatagcttccaaatgtttgagtcttggagtctgttaga

SEQ ID NO: 251793 - DNA, 510 bp, Homo sapiens
ctctccactccccaaaagggaccagcacccataccaaggagaaagccttctcaagtgaaatagaagatatgaaaatatgaaagacaggttggcagccatggaagagagagtgaaaaggtctaacatatatgtaactggggttccagaaagagcagctactctacggaaagagagaatgaggataggaagtatacaaaaatataatatctaagaatttttcagaaccgataaaagatagtaatcctcagattcaggtagacatcgggagtactctgaagatgcgcttgtatcggcagcaccaagatttctatctcataatccactgggtaccaaaatagtagggacagagaaaaatgggcctctcgatttgcccttagaatacagatctgagacttgacccgcatatgcttctcatatggaagcagtaataataacagcaataacaacaataacagcaaacacatgatgtgcactgtttcttcaattgcaaaattaggaaggagaaggacg

SEQ ID NO: 251794 - DNA, 500 bp, Homo sapiens
cactccaacctggggaacagagtaagactctgtctaaaaaaaacaaaacaaaacgaaacaaaaaactctaacagtttttttcttccagtggaagttaatgaagacttaatgaaccagaaagaaaaatacagaggaaaggtatttccagctttttacttcaagtttcctgatttggggtacttagggaaaagatgtgcatttcaagactaagaatacatgaaaactattcagttaataaataaaatgaaaccatttattttgttatgctgtcattttggaatagcacaccaagtgtttcatttgctgaacaaattccttttactcgcaggatatcactactatcattgcatacattcaaaacacacgaggcccagtaaggtggctcatgccagtaatcccagcactgtgggaggctgaggcagacggatcacctgaggtcacctgatgtcaggagtttgagaccagcctggccaacatggtgacaccctgtctctactaaa

SEQ ID NO: 251795 - DNA, 499 bp, Homo sapiens
gtttttatttcacatttgactttttgttacctttgtgtcttcagagtacagtgtacgttaagacatatatcgattttcttctcagtagttgaccaattgcctcaatactcttttctttccaacaacagttctttattaagatggaaactaccctggttagtcctatggtgaaatattctgcatacaaaggatactaatggaatgatgagtaacatatttaccaagttgtcaggccccaagagcaagggaagggtgaagtcagtgtggtgtacatgaggcagatccctacctgggaaggtgaagaggggattgggcagggaggtgagtacagcaggcgctcacaaagcggtcagctgtgggatgggaatggtcaactctgaagctacgggacttggagagagcctcagctgttggatgaaagagcgaaaacagatgcagtagttttcaaaccaagttccatggaggcattttaggggctttcctgggaaagcatgaagag

SEQ ID NO: 251796 - DNA, 425 bp, Homo sapiens
agggcgggaaatggagccggagaagcttgagcctctctcttggacaggacaagctgaactctgaaatgggagccggtccaggtggccttcagccccacctttccgatagtctgttagaattttattagcgcagattcctgggccatgccgggtaccgtgaccttgtgtaaatttatttatatttattgtggcccatccaccccacttctgcaaacccatcccgaggcctctggaatgggactccttctccctccctacctcccagccatcctaactcctacaggccagagaatgacatctctaactggctcataatcccttggcagcctggggctactttttagaaccagcaagcactgttgatactgtgaaacatcccattttttccgtattagagaccagatatttttctacctgttcatgat

SEQ ID NO: 251797 - DNA, 467 bp, Homo sapiens
tcccggatacatacatactgctagaaacaaatgactggagaatgtgttcctctgtttacagccttaaacactgaataccttcttcccaaagcagagtatgatttatcttgttctcatctaggaagggaaccaaagacagcaccaccatctctgaattatttgcatgtagatttctatgttgttactaattttaaaagccatcctggctttcttctgtcaaatggtttgattgtggatcacattctttcaccgacagctggtgtattctaaatcaattaatcaacatgcatttatcaagcacctgctgtgtgatcagtgtcattcttggagaattcgtgctgattaaattctctgtaaaacaattagaaagctgtatcttgtttttgctctgcccccatccccaaccccaattcacacaaatgcgtttcaagaccaaataaatgctctttttgtatcagtttactctt

SEQ ID NO: 251798 - DNA, 414 bp, Homo sapiens
aacctctgcctcttgagttcgagcaattcttgtgcctcagcctcccgagcagctgggactacaggtgttagccaccatgctcagctaatttttgtatttttagtacagacagggattcaccatgttggtcatgttggtcaggctggtctcgaactcctgaactcaggtgatccacccgactccgcctctcaaagttctgggattataggcatgggccactacacctggcctccacttgttctttaaagtatttttaaaacaatttttccttgctttgcttttgctttggcaatagataaccaggtcatttctctgccattcctcccccaaatcctactcattttttttttttttaagacaaagtctcactctgtcgcccgggctggagtgcagtggcacaatctcggctcacta

SEQ ID NO: 251799 - DNA, 1054 bp, Homo sapiens
ccaagttcacaaaatggataaatctcagaacacaggctcccaacgactgcaccatgttgcctccacagtccttggacagttctcccgaatgaacaaatattgaaaattcattgttacttctgtgactaatggactttcacagcaaatatgcttggccaggaccttgtaccctgacatttttcttttatttccaggaatggaaacccacactgctgttgtgaagacacctgatgaaactccagcaacttctacatctggcctgctgcttagtcctgggacctgaggtcaaaatcttagaaaagagccatgtgagatgcattccctggcctcatctctgttcttggatgctgtcagcaacactccttgagtttttacccacataataacactttcctcagcatggatgtggaggtgggggtgaggaatgttctatttttccttcgatggttacgccctcaccctaccaactcagtaaaaggggagtggtcagggagcgtactgagaatgtgtcctagcatcttttcttccctagcacagccttcatatgacccagctgccatgagaagcttgcctcccttctaagggaattacccctgccttccactccatcctcaccttgccctgcccagattagaggcacggaggcatgtaccacaggcctgaaaaactgtccagccaaaaagcctgactgccttgagtactatcagggtgtagttatggacgtgcctgtttctgctcttccctctgcattagtgctctgcaaagggtggctcttaccctcagatggtccagaggtagtttggggtgtgcatggatcaccttcactcttcagaggcgaacagacaatgctgctcttctccaacagcctctgaaggacaccacctactgactggttctgagatgtttgctgccccagagtctcccacctgcttcttcctccccctcagtccttttttgtagcctctcagcctcccttctcttaatgctcttagcaccctttcctgggtctctatttaccctgccctccctttcagcaactccttcccaaaccact

SEQ ID NO: 251800 - DNA, 519 bp, Homo sapiens
aagaacactgagaaatgaaaagggtcagtggacccagatggctccatttatccttatttactgagagttaattagaagagaaagcagggttttgccttttttttttgctaaagacacttagctcttgtttttcaaaagatacttactttgagagaactgggcagttcatgcctgcttgttttcattataaatagttacttaggaatagggtggtggtggtagcttttcagagctcacagatgagaattgagtttgtctgtgagaaggctaagggcaggctctggagacagacagactcaaatcctggctcctccacttgggagccattgcgtcctgagcaagttgcactctacctttaagcctcagcttatttatccaaatgtgggaatactggtaacttctacctcagtgcgttatatgtattaaatggaataatctatataaaatgctcaacatgtgcatgatacttgttaaacaataaatgtgagcaattaaaaaaaagtaaagcctggttgaaat

SEQ ID NO: 251801 - DNA, 417 bp, Homo sapiens
gcctctgcgcccacagcatgtgaaagcattgaaagaaaataagaatcttaaactcataaacatacctgcttactatctggcaggcgtcccagcagtctggtgatctccttagttatccagcagatagtagaaaaacaagagtcctgtgaagatttcacatgttgccatatccctgccagatggtgatttgtaaaacatggacaaattgcactggctccacttccctccgacaatcacaacagaaacactgcagcaatggtgtttaatttgaaagcaacttcagctgagtaacttttaaggtataaacatctaaagattattgggataaatgtgacattatctccagagaactggtccttcataaatctgctattctgtgctctggtatttctgggattctccccctacctccaaaaa

SEQ ID NO: 251802 - DNA, 462 bp, Homo sapiens
agcagtatagcctgagcaggtctggctagtagccagctagacgccatagtgggggtcgcaagatgagtctttgtgagactcctttgaactaagcagataatgaccatctgggcagcatagtaaggagtatactaaacttgagttataagcctgtcttagtttgtttaacggcctttgtcttgcctctgtacattcgcgtttgcaccacttaggagtaggtatataagcaaaaccttgtctttgttcggggcccagttttttggacgttgagtccactgagacagagtgcactcaataaaggatcctcctgctataccctgaggtctcccttgccctcctaaatttctgcaacaatgtcacacctcaagaaaacttgccttatcatgaagaacaaagttgtagtgatgacttctattaaaatttcatacataggaggcatcaaaggcagggtatgagatggga

SEQ ID NO: 251803 - DNA, 702 bp, Homo sapiens
atcatttctgaagcagtgaaaagggttgtcatcacagtaaacggtggaaaaacactgaatggtgcgttagaatcaccagatctaatttttgtgtaccttattaatacatcaaaatttttgcatatcttattaatgtatcgaataattaggctaaatttttgcataacttattgatacatcagaaggtcaacaacatgaattcaaggatgcctatgttctgttgagtgaaacagaaatgtctagtgcccagtctattgtacctactcttgaaattgccagtgctcagtatacacctttggttgtcattgctgaagatgttgatggagaagctctatgaaccttccttttgaataggctaaaagctggtcctcaggttatagcagtaaaagctccaggtttgttgacaatagaaagaaccagcttaaagatatggctcttgctgttggtggtgcagtgtttggagaagggggtaggcctcataacacaggaaaagttggagaggtcattgggaccaaaggtgatgctatgctctttaaaggaaatggtgacaagtcttgaattgaaaattgtattcaagaaatcattgagcagttagatatcacagctagtgaatatgaaaagggaaaagtgaatgaatggcaaaactttaaaatggagtagctgtgctgaaggttggtgtaacaagtgatgtcaaaactaatg

SEQ ID NO: 251804 - DNA, 493 bp, Homo sapiens
aacatcaaatataaaaacttgaggactggctctgccgttctatttcaagggactacattagtagcagaagacttgcagagattggccgagctgtttgaaaaatgcattttcttatgaaatacccgaaggtgcggcagattgatggtaggtttgggagatggccccacgatgtgaggtgcagtggatatgtcttatggattatgactacattttcagttgttttaacagctccaaaggctgactaacgacactgctgactaacgacaccactctgagaaggtggctcttctgaagttcaaagaggggcctgaagtcggagctttctttaaactgtcttccagtttacatgcttgtttgctgtgtgaaaacatctcatcccattatgcgtgatgagctggaagtatggcagagagggctggaatcgagggaaaaaggtgagcttcggcttgcctggcattgctaaattataaaacactggtgtttttctctctct

SEQ ID NO: 251805 - DNA, 421 bp, Homo sapiens
gttcacatccaccaactatcttcccagggttggactgagaaggggagcagagggtcccagggactctcctgagatcctggctctcctgccaaggaatttacatttccttgtcacagcaccatgtaagatatccaactactctgaaactaccacactgtgaagagtctaaccaagccacctggagagaccaaacggaagaaaactaaggcccctggccaacagccctagctgtgctcctactggccagtcagcaccagcctgccaggcatgtgactgagacagtcttggaagtggattttccagccctactcaagctgccgcagctgacaccacatggaacagagatgagcttttctccccagtgcccaaatagcagaattgtggaaaaataaataaaacagttgtattaagccactaaaat

SEQ ID NO: 251806 - DNA, 322 bp, Homo sapiens
aaccatagcagaggccaaggtgaattcaaggtcacaaaactcctaagaaagccagtaagtaccgaacccaagcttctgtctctaagattattctacccctcatttttcacaatgcctctgtcccatcacgcagagggcaagcaggatggagcttatttcctgtccccagccagtagtagttgttagatggtgccacgctggcaccatctgcaaaaaatagaaacgggttagcagaatgtctcctagtctctgttttctccagagacttttcttggttcagcatactgagactttcaggaagaataatgggttttcaattaaa

SEQ ID NO: 251807 - DNA, 403 bp, Homo sapiens
tcccagctgtgtctacagttactttgctttccatggtccccatttcaattctaatttttgacatatatacatgctacatattattgaacaatttcaatttccccccagtttgttatagatttaaaaaatattccctttgaaatgaaaaattgatatatggcctttaaaatgttttaatgtgagatgctaaaaattattcaagataaatcaaacactttggcatataggagggctggaaataattttttattttccttatacagcgtcacccccaggctttatgtgcttagaacacataaggtccttggaaagttgaaagagggatgatggttctggccttcagaagtgttcgtctgtagttacaattcaccccgaaactagaggtcaagaaaggaagaggaaa

SEQ ID NO: 251808 - DNA, 380 bp, Homo sapiens
cccttatttttgctgtgtcttgggcaggaggagaaagatctgcatttacttttgttggggtcactagttcatcatctctggttcctgcacttattttttctatttctggtgaggaactgagaaacacagttaagggttggagatgtctttgataatagatatcccgaaagaaattcacttgtttatttgcgtgatagggtcacctcttacacaaaaactcacctgccgtcctctctttcccctcctgccctccctccagtcccccagggaggaaaatgaacagtggcataatgattttggtaaatagaattctttttaaagccatctgatcacggggagacattctgagaagaccctagggtttagtcagtgctgatgtg

SEQ ID NO: 251809 - DNA, 96 bp, Homo sapiens
gtgctgatgacctgcaactcttagggggaggaggagggaaatagggaattctggaaacctgtgtgggacttttgcataaattagaaaaaggtggcc

SEQ ID NO: 251810 - DNA, 1030 bp, Homo sapiens
acacatccaagtttgtggccagatataattagcaaatgtgcgaaggtaaccttcacttatacagagttctgccctactcctgacaattggttttccattgagccatggcttaaagtgtccaatgaaaatctagattatgccattttaaaactaaaagaaaatggaaatgcgtttcctccaggactatggcgacagatttctcctcaaccatctactggtttgatttatttaattggtcatcctgaaggccagatcaagaaaatagatggttgtactgtgattcctctaaacgaacgattgaaaaaatatccaaacgattgtcaagatgggttggtagatctctatgataccaccagtaatgtatactgtatgtttacccaaagaagtttcctatcagaggtttggaacacacacacgcttagttatgatacttgtttctctgatgggtcctcaggctccccagtgtttaatgcatctggcaaattggttgctttgcatacctttgggcttttttatcaacgaggatttaatgtgcatgcccttattgaatttggttattctatggattctattctttgtgatattaaaaagacaaatgagagcttgtataaatcattaaatgatgagaaacttgagacctacgatgaagagaaaggtaaacaagagtcatcacttcaagatcatcagattgaacccatggaatgttagaaaagagatgctgtcttcaagaaaatatgccaataattcctggcaaagatttcatgacaaagacacttaaagcaattgcaacaaaagtgaaaattggcaaatgagacctaattaaatcttctgcacagcaaaagaaactatcaacagggtaaacacacaacctacggaatgggagaaaatatttgcaaactatgcatacagcaaagatctaatattcagaatccattaggaacttaaacagattaacaagcaaaaaaaacaagcaaccccattaaaaagtgggcaaaggacatgaacaaacacttttcaaaagaagatatac

SEQ ID NO: 251811 - DNA, 534 bp, Homo sapiens
tttttgtatttttagtagagacagggtttcaccatgttggccaggctggttttgaactcctgacctcaggtgattgggcaagggcttttcaatacaaggggacaagcactgagaggctcctcatgtcgcatgtctgtctcactatttctctggaatgtgcactgtggacctgggatggaattctgaccagcctctggggaggccgcgcagctggggcctagcgagtcttcagagttgcactgggggcaggggacattccttttgtccccgaggcaggtggagggaagcttcatgtagctcacgaggaagagacctcctccccacgctgccgggctggcctctcgagcatccaggctgcgcagcctcctattgtgatgtagcgccagttgcttcgagctggcggctttatcatatgtgggttttgattgacatactgttgttcatgctgaagtttgagtgtcgttataaaaacacaaagtcattgtagaaaacttgaaaaatttagaaaataaaatgaaaaacagcagttaaaca

SEQ ID NO: 251812 - DNA, 362 bp, Homo sapiens
tttttgtatttttagtagagacagggtttcaccatgttggccaggctggttttgaactcctgacctcaggtgattgggcaagggcttttcaatacaaggggacaagcactgagaggctcctcatgtcgcatgtctgtctcactatttctctggaatgtgcactgtggacctgggatggaattctgaccagcctcctattgtgatgtagcgccagttgcttcgagctggcggctttatcatatgtgggttttgattgacatactgttgttcatgctgaagtttgagtgtcgttataaaaacacaaagtcattgtagaaaacttgaaaaatttagaaaataaaatgaaaaacagcagttaaaca

SEQ ID NO: 251813 - DNA, 471 bp, Homo sapiens
cactaacactggatgttgtccaaagtttttatttttgcacaactaatcaaggaaaaggctttctccatatttacgtgcttgtaactctggcatgacctttgctccagtctctaccagagggcggcgcctggattgaagtggaaaagccctgttttccagccatgacccagggagcaagcactgactcctcaggggaacaggagacctgccaactaggaccctgggagcccccatgctggcagtgccctgggtcatctcaggctcatcagcaaatcctggggggagagcggggctggagggcgaagaagcccaggagagttcctggctcagaacccctctctgaggctcccaatacagagcccaggccccacacccagagcctctgagtatttttgtttattgtatgtaaaatactagtgtatttttgtttaagtctcacaagtaaacaggttctctcatactttgccaagg

SEQ ID NO: 251814 - DNA, 662 bp, Homo sapiens
ctcctcccctcaaaggatgtgcagtctctcagtttacctataatgcttgcagaaattctcacaacaaaagtcctgaagccggtagtggagttactgagtaatccagattacattaaccaaatgctgcttgcccagctggagtacagagagcagatgaatgaacatcacaagagagcctacacctatagcccctcttatgaggacttcatcaagctcattaacagcaactctgatgtggagttcttgaagcaactaaggtctgttgaaggaacggtagagaagagtggtagaagatgtgtgctggtcgttttcaacaactgacttttgggcaaggtatcaaattgtagtggaaataatccaagcgactacaattagcagctttccccaactgaagaggcacaaaggtaaagaaactgcggcaatgagggctaggaacatgaagaggtacatcaaccaactgactgtggcaaagaagcagtgtgagaagagaatccgaatcctgggaggccctgcctatgaccagcaagaggttggggccgtggatgagggggaagggcctcaaagccagaaggtagaactttatagtttcttgttctgaccctaccaagtttattataaatgctgatagaactacatataaagactttcaacttaaaaaaaaa

SEQ ID NO: 251815 - DNA, 604 bp, Homo sapiens
aggtttgtcaccccctttgtgtctagcaaagggccagacacattaggtaattaaaaaaaagaaagaaattaaaatagtgaatgaataaattgtggctatgtaaagatcttaagctagttagaatgatatagtttatgttttaaatttaaaaacttaattatataaaaccatgggcttttaagaaaaataataaaattaataggaaagtttgaaaatcagatcttgcatacaccactattaattattaacattgcattaagaatttagtaagcttagttttctttatatgttatctcttttaatctgcacaataagctatgctatagacattagtatttgttttcattttacagaagggaaaaattaacattaaaaaagttaaataccttatccaatatcataaaactagcatgggaataatgtcagattttaaaacagctctatctgactccaaaatccaaactcttaaacagtgaatataaccaacctcatatttcatcattctgtacatgcttgacaagaaacattcatttattcaatagcagagattaaaccgactgagtttctgcctttatagagtttacctttgggtgatggagacaga

SEQ ID NO: 251816 - DNA, 255 bp, Homo sapiens
agtgttagctgttacttggaatgttggttgaattgagtattgcatttggcagtagtctactagtggccttttaggaactgtagagtaacttaatataagagacattatttggtgggcagaattaagatcttgggagccattgctggtgcaatcctcacttgggaaaatttaacaaaatatagttagaccttttccaggtctcacccattccattccccagctgagcggacaggggaagtgctacagcacagcgag

SEQ ID NO: 251817 - DNA, 397 bp, Homo sapiens
tgttattaacaacaaatactgccatatcttttaattgacagtcttgcttcattttttaagaaaatctgctgtggccttgtacagtggctcactcatgtaatcacagcattttgggaagctgaggcaggaagatcgttcgagcccaggagtttgagataagcatggaaaacatagtgaaacctagtctctacaaaaagacaaacccacctcaaaaccaaaaaacaaaaaccaaaaaacttagctgggcgtggtggtgtgtgctagtgttcccacctacttgggagcttgggcaactgagttgggaggatcacttgagcctgggagatagaagctgtgttgagcagtgatggcaccaccactgcactgcagcctgggtgacagagcaagacctgtctca

SEQ ID NO: 251818 - DNA, 212 bp, Homo sapiens
agtgtgtttggggggtggctggggaggagttggattcaagcattctgtattgagtgtattaagtatgaaatacatattcaacatccaagtcaagagatgacatataagcaggtagacatacaggtttggatctcagaagagagaggcaaatttgaaggtatagttttgggagtcccgacgccataaaactagatggcacaggggaaggaatg

SEQ ID NO: 251819 - DNA, 714 bp, Homo sapiens
tgctataataaactataagtactggactttcttgagttttgtgagtcatcctaactgaattatcaaacttgagtgtgatggaaacctccacatttgtacttggtcagaaataaaagtaacatgggagcccccgaagtttgcagctggtatccaaagtgagggcagtcttgtgaaaacctattaactttgatctaagtcgaactgtatcgaaatcatacatccacaatgctcactaaagttccccatcaacaattatttgttgatgaatatataaaaggaggtaagccaaagaccaccccacaattgatttttattaaacatcaaaaccttaattttggcccggcacagtggctcacacctgtagagtgtgagaccttgggaggccaacatgttaggaggccaaggcaggctgattgcttgaggtcaggagtctgagaccagcctggccaaaatggtgaaaccctgtctctactaaaaaaaattagccaggtgtggtggtgcgcacctgtagtcccagctactcaggaggctgaggcagaagaatcacttgaacctgggaggctgaggttgcagtaagccaaaatcgcaccactgcactccagcctgggcgatacagggagactgccttaaaaataaaaaaaacagaacaaaaacaccttggccagggaagtggctcacacctgtaatcccaacactttaggaggccaacacttt

SEQ ID NO: 251820 - DNA, 564 bp, Homo sapiens
tgctataataaactataagtactggactttcttgagttttgtgagtcatcctaactgaattatcaaacttgagtgtgatggaaacctccacatttgtacttggtcagaaataaaagtaacatgggagcccccgaagtttgcagctggtatccaaagtgagggcagtcttgtgaaaacctattaactttgatctaagtcgaactgtatcgaaatcatacatccacaatgctcactaaagttccccatcaacaattatttgttgatgaatatataaaaggagtctgagaccagcctggccaaaatggtgaaaccctgtctctactaaaaaaaattagccaggtgtggtggtgcgcacctgtagtcccagctactcaggaggctgaggcagaagaatcacttgaacctgggaggctgaggttgcagtaagccaaaatcgcaccactgcactccagcctgggcgatacagggagactgccttaaaaataaaaaaaacagaacaaaaacaccttggccagggaagtggctcacacctgtaatcccaacactttaggaggccaacacttt

SEQ ID NO: 251821 - DNA, 2872 bp, Homo sapiens
taacttcattttatgattcacccttcacaatatttatttttgaggataaaagaaaataatgttagtcttatgtgttaatcataaaaaatacatgcttaatgacaggaaaacagcaagtcattttttctagttctttaaaaatattttaatcgtgcaaaatcaccataatgtactctagcacaatgctaaaatgttatctaagatggagtggcttttattagttttacaggatgtatatttggcaatagttcttaaaaataattactcaaaaggaactctaactctattattttagaaacaatattttaaaatacagcagtaagcaacaaaaactattgctctttatacatttttggcataacactgccatacggttacagaattataaaataagtattttatagtaccatacagatccagaaactggttacaacttctaccacatacacatggtattggtactaacgaacatgcacagcattctgtaattcatactgcagttgaatacagagcacagagaaggcccagtggccactggagaatcagagcttatgttataagtaaaacacacatctttgtaacaatcgtaggcattttcctgaaatatttaaaatacaagggacacaatagtttccaaaatgacataatctaccatccttcttagataatactaaaaaagaaagattaccttacataggaaacaacttaaagccctttttaaaaacaggaggaaaatgcttgtcaaaggacctaacattttgctctcatttgtttctcacaattataatgccacacaattaatatgctgtcaactcttgacagtgtggaagttacttcactcacaaaccacctatcactgagtctttctcttatctgcagccagaccatcaacttaacttgtaaaactaccaactgttgctacacacaggcaaaggaattaaacttggtagctgatcatttgattacatctatcagtctactggagggcttcaacgcagagtaggtggaattcatggttcaaatcagagtattaatgggatctgtttgcacaccaatacctgatctccttggcacaaatacagagctgattcttaaagcatgtccccacaataaagcttttcttaatcattcgtcacctgcttccaataattctggcacttacacaaacttatcaagggttatgtctttatttctgtggtgagtttcctgttgctgtttctagacttttatttcatttgtattttatttttcttcacatgaaacaaaatctgttagcactgggaaagaaaagttcatttgactaatgagtgtagaatgtaaatgtttcttagtaccaaaacttattatatatctaatttttcctagttaacgtaaattgttacacaaagtataatttaaaaagtaaaactatgacaaaccctaaagcttaaatatttttagagaaaaaggtattttagcacagtaagtgaccactactgccttttctctgaatcattttataaagagattttatattaatatacagctgtgaatgaacaacttccctaattttttaattaaataaataggagtgagggaaaaaaactcatatttcaatgattcccaagatcgttaagatataactacaatttactaatgcccaactgctcacagttttctaaacaactacaaaataaataaattgtagcaggtattttatgagaactgatacccatcaaaattgtgtatggagtccatgatggcctatcctccccagaagtcagagctcacagtgcccaacaccctcattatccagaggagaatctgaggacccatcatgccagtggagaaggctggagcccagcactggcgccactttcctgagatgcccacactgattcttgtcccttctccctctctgaactctacttccagccagtttgggtcataacacaaaacatttaattgtattctctacatgaaaactttagttcaggaaaataaacatattaagaggttatttccctcaaataactgaaacaataaacttcacaacagaataggaaaaaaaatgacaaagaacactctctgtagtctaggaaaaatgcaagaacagtgcttttaaaatgattctaatgagactacagcataaaagtttttcaaattagtttcagatttctccaactgcctactggaattaaacttttaataatttctctaacataattctatttctgcatccgcctacatctaagaagaagcaaaacataaatattatttgtagtaactaaggaacgtttaaaatgaaaattatagtatgtagctaaactacaaaaagcataaataaatataacagacagtatagttagtctttcttactctaaacacgttttgtcaaatgtaacacattgttgaatatcatggtgagtacacttcttgataaactgatgctattgtcccaaacagcaacttctccaaaatgataaagcaccacctaaatttcattaaaagaactgatattcatggtttagaaagttcccaatgatgagattttataatgtaataaaaatgtaaacttctgaatgaaaaccatttacatttgttaaggcacatctggatacctccagacattcatatttatagctatattattattcatttcaataataagggatttctaaaaacacattctgtccctgaacacaatctgctgggtgtgttggataactagaatgcagaaggagcagggtagtactcactgtcaccctagagattagccacacaaatatgttcctgtaataaacagtacaaaactcaaaaagaagccagcaaatgtacactcctaattttctagatcctacattgacccaggccatttttctctacaacttca

SEQ ID NO: 251822 - DNA, 2271 bp, Homo sapiens
cagcaaacctttccctgctgtgaggtgggcaagttagttgctccaaaaacaagataaaatgattgagttcttttctcaagcgggagtcggagtttatctgctctgagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaagccagaccatcaacttaacttgtaaaactaccaactgttgctacacacaggcaaaggaattaaacttggtagctgatcatttgattacatctatcagtctactggagggcttcaacgcagagtaggtggaattcatggttcaaatcagagtattaatgggatctgtttgcacaccaatacctgatctccttggcacaaatacagagctgattcttaaagcatgtccccacaataaagcttttcttaatcattcgtcacctgcttccaataattctggcacttacacaaacttatcaagggttatgtctttatttctgtggtgagtttcctgttgctgtttctagacttttatttcatttgtattttatttttcttcacatgaaacaaaatctgttagcactgggaaagaaaagttcatttgactaatgagtgtagaatgtaaatgtttcttagtaccaaaacttattatatatctaatttttcctagttaacgtaaattgttacacaaagtataatttaaaaagtaaaactatgacaaaccctaaagcttaaatatttttagagaaaaaggtattttagcacagtaagtgaccactactgccttttctctgaatcattttataaagagattttatattaatatacagctgtgaatgaacaacttccctaattttttaattaaataaataggagtgagggaaaaaaactcatatttcaatgattcccaagatcgttaagatataactacaatttactaatgcccaactgctcacagttttctaaacaactacaaaataaataaattgtagcaggtattttatgagaactgatacccatcaaaattgtgtatggagtccatgatggcctatcctccccagaagtcagagctcacagtgcccaacaccctcattatccagaggagaatctgaggacccatcatgccagtggagaaggctggagcccagcactggcgccactttcctgagatgcccacactgattcttgtcccttctccctctctgaactctacttccagccagtttgggtcataacacaaaacatttaattgtattctctacatgaaaactttagttcaggaaaataaacatattaagaggttatttccctcaaataactgaaacaataaacttcacaacagaataggaaaaaaaatgacaaagaacactctctgtagtctaggaaaaatgcaagaacagtgcttttaaaatgattctaatgagactacagcataaaagtttttcaaattagtttcagatttctccaactgcctactggaattaaacttttaataatttctctaacataattctatttctgcatccgcctacatctaagaagaagcaaaacataaatattatttgtagtaactaaggaacgtttaaaatgaaaattatagtatgtagctaaactacaaaaagcataaataaatataacagacagtatagttagtctttcttactctaaacacgttttgtcaaatgtaacacattgttgaatatcatggtgagtacacttcttgataaactgatgctattgtcccaaacagcaacttctccaaaatgataaagcaccacctaaatttcattaaaagaactgatattcatggtttagaaagttcccaatgatgagattttataatgtaataaaaatgtaaacttctgaatgaaaaccatttacatttgttaaggcacatctggatacctccagacattcatatttatagctatattattattcatttcaataataagggatttctaaaaacacattctgtccctgaacacaatctgctgggtgtgttggataactagaatgcagaaggagcagggtagtactcactgtcaccctagagattagccacacaaatatgttcctgtaataaacagtacaaaactcaaaaagaagccagcaaatgtacactcctaattttctagatcctacattgacccaggccatttttctctacaacttca

SEQ ID NO: 251823 - DNA, 1141 bp, Homo sapiens
cagcaaacctttccctgctgtgaggtgggcaagttagttgctccaaaaacaagataaaatgattgagttcttttctcaagcgggagtcggagtttatctgctctgagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaagaactatttactgagctctacggagacacagctacaagcaccacatgctggacccctgaatatggagggccaactacactagaaacacacacgctagctgagaaagatggtggcttaagggtaagcatggaaagaggcaaggaggtgaggacagcaggactgatagataagctggggaggccagagctccacaaggacatccatttcacttatcagaatctaaaaataaacacgttgagatactagaatcaaagaatccaaattagtttctgaacacatttgaaaagatcaaactcttacagttaaaaaaaaaattaatcagccagacatggtggctcatgcctgtaatcccagcactttgggaggccgaggcgggtggatcatgaggtcaggagtttgagaccagcctgaccaacatggtgaaaccccgtctctactaaaaatacaaaaattagccaggcgtggtggcacacgcctgtaatcccagctactcaggaggctgaggcaggagaatcgtttgagtccaggaggcagaggttgcagtgagccgagatcatgccactgcactccagcctgggcaacagagactccgtctcaaaaaataataataaaataaaataaagtaaaataaagccataaatcaggtaaaagtgtagcaatccaatgaaattatcctcttgatttccttcatgtagactataatgtctcaaaagaatgtattttgtataccaaatactacatggtaatttctagatactctgaaaatattctcaaagtaattattatatacaaaatttgaaaattcacatcctaaaagcattacagaatacattcatttattgggtcttatcttaaatctcctta

SEQ ID NO: 251824 - DNA, 481 bp, Homo sapiens
  misc_feature (481)..(481): n is a, c, g, or t
taacttcattttatgattcacccttcacaatatttatttttgaggataaaagaaaataatgttagtcttatgtgttaatcataaaaaatacatgcttaatgacaggaaaacagcaagtcattttttctagttctttaaaaatattttaatcgtgcaaaatcaccataatgtactctagcacaatgctaaaatgttatctaagatggagtggcttttattagttttacaggatgtatatttggcaatagttcttaaaaataattactcaaaaggaactctaactctattattttagaaacaatattttaaaatacagcagtaagcaacaaaaactattgctctttatacatttttggcataacactgccatacgattgttaccaagatgtgtgttttacttataacataagctctgattctccagtggccactgggccttctctgtgctctgtattcaactgcagtatgaattacagatacn

SEQ ID NO: 251825 - DNA, 3487 bp, Homo sapiens
agtataaaactagaagcagggtaggtgattttatatgacaaaatatgaaacaatgactatgacaggcattatggcattttcatatgtttatatttttactacttagcaaaaaaatacttagaacttctctagtaactcctgagttgtagattttattttctcattgaagctggaaaaaagtagtcccaaaacctaaattcaaaataaaactatgcaacataatttttgagttgacaactaggcttgatttagagaaagtaaacatattttcacctctatcattattcttttgaatttcttatgagatcgagaatgaaaatgtataatggtacaatattcttcatgttataaactctttctctactgtacagaaatatatcttataactatatgtcactttacagtatttaaaaatagtttcacataatctcctttgatatatgaaagcacaaaatattagaaatgttctagactaatcaagcgatataacatctatttgccatgaaatgcaagttagtattttatcaatagccaatatttagtatccttgcactccacagtacaacaataaagattatatatttgtaaagattcagtaatatttttagctatttggtcatgcttcactgcattttttataacagcttctcaatgaatttctgcaagcatatcgtagtttttaaaattacaaaacataggagtcaaacccagagcactgtttcatatataagacacacataaatacatatctatagatcttatttaaaaaactaatatacaaagcattaatagaaaaaaattctagacactcaatgtttatctccaaaaggaatgatatccttttacttgttctccactgaatgattatctaagttatttagggattaaatgtaagaaacatactattatatatgaatatgcatttaaaaacaccatagtgggaaaaggccactatttaagatggatgccaggaagtgtttctcttgagactaaatattctcgaatttaatgttacaatctaatcaaaatccctaagtaggaagaatattctaaaagttaagttgctaaatgaaatgtttttactcataagggctctaatatacaatttctaagtaattcaaattacattcattgattttagtatctggtaactttattaatatcataatatctggtcacaatcttttactattatgcatttagaaagttgtctgaatactttatcatgtatataaaattggtaagttattttgaattaaattatttgtgttctacaattcagcctaatttgacaatcgcttctcatcctctaaaccctgtagaactatttactgagctctacggagacacagctacaagcaccacgtaagagtgtccatgtttttcttgcatgtaaaacagaaattgaaatgcaaaagcagattgccaaatcctaatactcacagaacactaggaaagcaaaaactggcatattatgggaactaaaaatgagaaagtgttccatactatacttattggaacacaatgtacaacaaaagtgctactgagattcatataaaaaattagagttaagcaactggcatgtttcatgtaaacttcaaagcagtaaaatcatatttctagaggcatactataagtgtgattcttttcaagaaatccactgcagaaaatgtggatcaatagaggcaacagaagatgatatgaagtaggacatattacaaattccctaggggattaaaatgaatagaacttttcttaaaagcctaacaaaaaagttaattcctttctaaatgaaataaagtagacatgtttcatctattcattgctttaactatatttgtatatatgctttgaagttcttatcacagtgttttttgatttgtaataataattagtaataatatagaaacaaaattaattgttcttaaccagtgctatgtaacctattaagtgcttactagagttgcatatatggacttttaaatttgttctcaattttgaagtttgataacttagagatgtacaaaactatactttttaaaaaacacgtttgggctaagcaacattactaatttcgtaatccatagaacactgacatattcatggtttaagggactactgtcttgttcacagtgcaagaggcatgccttttaaaaaggaatttcttattttttaattcttcagtcatttacattcagaatcaaccatcaaatttatatggaacagccatagagagcaaaattcttgtcttgaacttttcaatcaaatttgtttttaagcacttaattctgaaaacagttattaatttaaacaaagcaaaatcttgaagtcatacaattagaagtcccactctgttccatgtagatttcaatatagatcatcctaatgtgtatagtggtcccttgatatctgtagggggttggttccaggaccctctgcagttaccaaaatctaggaatgctcaagtcccttatgtaaaatactttaaatcatctctaaattacttacaatacctaatacatacaatataaatgctatgtcaatagttgttatactgtattgtttagagaataatgacaaataaaaggactgcacatatttagtagagatgtaaccatccattttttccaacaaatattttcaatctgcggttggttgaatccacagatgctggacccctgaatatggagggccaactacactagaaacacacacgctagctgagaaagatggtggcttaagggtaagcatggaaagaggcaaggaggtgaggacagcaggactgatagataagctggggaggccagagctccacaaggacatccatttcacttatcagaatctaaaaataaacacgttgagatactagaatcaaagaatccaaattagtttctgaacacatttgaaaagatcaaactcttacagttaaaaaaaaaattaatcagccagacatggtggctcatgcctgtaatcccagcactttgggaggccgaggcgggtggatcatgaggtcaggagtttgagaccagcctgaccaacatggtgaaaccccgtctctactaaaaatacaaaaattagccaggcgtggtggcacacgcctgtaatcccagctactcaggaggctgaggcaggagaatcgtttgagtccaggaggcagaggttgcagtgagccgagatcatgccactgcactccagcctgggcaacagagactccgtctcaaaaaataataataaaataaaataaagtaaaataaagccataaatcaggtaaaagtgtagcaatccaatgaaattatcctcttgatttccttcatgtagactataatgtctcaaaagaatgtattttgtataccaaatactacatggtaatttctagatactctgaaaatattctcaaagtaattattatatacaaaatttgaaaattcacatcctaaaagcattacagaatacattcatttattgggtcttatcttaaatctcctta

SEQ ID NO: 251826 - DNA, 2764 bp, Homo sapiens
gctcgacaataaaagccactccatcttagataacattttagcattgtgctagagtacattatggtgattttgcacgattaaaatgttatctaagatggagtggcttttattagttttacaggatgtatatttggcaatagttcttaaaaataattactcaaaaggaactctaactctattattttagaaacaatattttaaaatacagcagtaagcaacaaaaactattgctctttatacatttttggcataacactgccatacggttacagaattataaaataagtattttatagtaccatacagatccagaaactggttacaacttctaccacatacacatggtattggtactaacgaacatgcacagcattctgtaattcatactgcagttgaatacagagcacagagaaggcccagtggccactggagaatcagagcttatgttataagtaaaacacacatctttgtaacaatcgtaggcattttcctgaaatatttaaaatacaagggacacaatagtttccaaaatgacataatctaccatccttcttagataatactaaaaaagaaagattaccttacataggaaacaacttaaagccctttttaaaaacaggaggaaaatgcttgtcaaaggacctaacattttgctctcatttgtttctcacaattataatgccacacaattaatatgctgtcaactcttgacagtgtggaagttacttcactcacaaaccacctatcactgagtctttctcttatctgcagccagaccatcaacttaacttgtaaaactaccaactgttgctacacacaggcaaaggaattaaacttggtagctgatcatttgattacatctatcagtctactggagggcttcaacgcagagtaggtggaattcatggttcaaatcagagtattaatgggatctgtttgcacaccaatacctgatctccttggcacaaatacagagctgattcttaaagcatgtccccacaataaagcttttcttaatcattcgtcacctgcttccaataattctggcacttacacaaacttatcaagggttatgtctttatttctgtggtgagtttcctgttgctgtttctagacttttatttcatttgtattttatttttcttcacatgaaacaaaatctgttagcactgggaaagaaaagttcatttgactaatgagtgtagaatgtaaatgtttcttagtaccaaaacttattatatatctaatttttcctagttaacgtaaattgttacacaaagtataatttaaaaagtaaaactatgacaaaccctaaagcttaaatatttttagagaaaaaggtattttagcacagtaagtgaccactactgccttttctctgaatcattttataaagagattttatattaatatacagctgtgaatgaacaacttccctaattttttaattaaataaataggagtgagggaaaaaaactcatatttcaatgattcccaagatcgttaagatataactacaatttactaatgcccaactgctcacagttttctaaacaactacaaaataaataaattgtagcaggtattttatgagaactgatacccatcaaaattgtgtatggagtccatgatggcctatcctccccagaagtcagagctcacagtgcccaacaccctcattatccagaggagaatctgaggacccatcatgccagtggagaaggctggagcccagcactggcgccactttcctgagatgcccacactgattcttgtcccttctccctctctgaactctacttccagccagtttgggtcataacacaaaacatttaattgtattctctacatgaaaactttagttcaggaaaataaacatattaagaggttatttccctcaaataactgaaacaataaacttcacaacagaataggaaaaaaaatgacaaagaacactctctgtagtctaggaaaaatgcaagaacagtgcttttaaaatgattctaatgagactacagcataaaagtttttcaaattagtttcagatttctccaactgcctactggaattaaacttttaataatttctctaacataattctatttctgcatccgcctacatctaagaagaagcaaaacataaatattatttgtagtaactaaggaacgtttaaaatgaaaattatagtatgtagctaaactacaaaaagcataaataaatataacagacagtatagttagtctttcttactctaaacacgttttgtcaaatgtaacacattgttgaatatcatggtgagtacacttcttgataaactgatgctattgtcccaaacagcaacttctccaaaatgataaagcaccacctaaatttcattaaaagaactgatattcatggtttagaaagttcccaatgatgagattttataatgtaataaaaatgtaaacttctgaatgaaaaccatttacatttgttaaggcacatctggatacctccagacattcatatttatagctatattattattcatttcaataataagggatttctaaaaacacattctgtccctgaacacaatctgctgggtgtgttggataactagaatgcagaaggagcagggtagtactcactgtcaccctagagattagccacacaaatatgttcctgtaataaacagtacaaaactcaaaaagaagccagcaaatgtacactcctaattttctagatcctacattgacccaggccatttttctctacaacttca

SEQ ID NO: 251827 - DNA, 2924 bp, Homo sapiens
agtataaaactagaagcagggtaggtgattttatatgacaaaatatgaaacaatgactatgacaggcattatggcattttcatatgtttatatttttactacttagcaaaaaaatacttagaacttctctagtaactcctgagttgtagattttattttctcattgaagctggaaaaaagtagtcccaaaacctaaattcaaaataaaactatgcaacataatttttgagttgacaactaggcttgatttagagaaagtaaacatattttcacctctatcattattcttttgaatttcttatgagatcgagaatgaaaatgtataatggtacaatattcttcatgttataaactctttctctactgtacagaaatatatcttataactatatgtcactttacagtatttaaaaatagtttcacataatctcctttgatatatgaaagcacaaaatattagaaatgttctagactaatcaagcgatataacatctatttgccatgaaatgcaagttagtattttatcaatagccaatatttagtatccttgcactccacagtacaacaataaagattatatatttgtaaagattcagtaatatttttagctatttggtcatgcttcactgcattttttataacagcttctcaatgaatttctgcaagcatatcgtagtttttaaaattacaaaacataggagtcaaacccagagcactgtttcatatataagacacacataaatacatatctatagatcttatttaaaaaactaatatacaaagcattaatagaaaaaaattctagacactcaatgtttatctccaaaaggaatgatatccttttacttgttctccactgaatgattatctaagttatttagggattaaatgtaagaaacatactattatatatgaatatgcatttaaaaacaccatagtgggaaaaggccactatttaagatggatgccaggaagtgtttctcttgagactaaatattctcgaatttaatgttacaatctaatcaaaatccctaagtaggaagaatattctaaaagttaagttgctaaatgaaatgtttttactcataagggctctaatatacaatttctaagtaattcaaattacattcattgattttagtatctggtaactttattaatatcataatatctggtcacaatcttttactattatgcatttagaaagttgtctgaatactttatcatgtatataaaattggtaagttattttgaattaaattatttgtgttctacaattcagcctaatttgacaatcgcttctcatcctctaaaccctgtagaactatttactgagctctacggagacacagctacaagcaccacgtaagagtgtccatgtttttcttgcatgtaaaacagaaattgaaatgcaaaagcagattgccaaatcctaatactcacagaacactaggaaagcaaaaactggcatattatgggaactaaaaatgagaaagtgttccatactatacttattggaacacaatgtacaacaaaagtgctactgagattcatataaaaaattagagttaagcaactggcatgtttcatgtaaacttcaaagcagtaaaatcatatttctagaggcatactataagtgtgattcttttcaagaaatccactgcagaaaatgtggatcaatagaggcaacagaagatgatatgaagtaggacatattacaaattccctaggggattaaaatgaatagaacttttcttaaaagcctaacaaaaaagttaattcctttctaaatgaaataaagtagacatgtttcatctattcattgctttaactatatttgtatatatgctttgaagttcttatcacagtgttttttgatttgtaataataattagtaataatatagaaacaaaattaattgttcttaaccagtgctatgtaacctattaagtgcttactagagttgcatatatggacttttaaatttgttctcaattttgaagtttgataacttagagatgtacaaaactatactttttaaaaaacacgtttgggctaagcaacattactaatttcgtaatccatagaacactgacatattcatggtttaagggactactgtcttgttcacagtgcaagaggcatgccttttaaaaaggaatttcttattttttaattcttcagtcatttacattcagaatcaaccatcaaatttatatggaacagccatagagagcaaaattcttgtcttgaacttttcaatcaaatttgtttttaagcacttaattctgaaaacagttattaatttaaacaaagcaaaatcttgaagtcatacaattagaagtcccactctgttccatgtagatttcaatatagatcatcctaatgtgtatagtggtcccttgatatctgtagggggttggttccaggaccctctgcagttaccaaaatctaggaatgctcaagtcccttatgtaaaatactttaaatcatctctaaattacttacaatacctaatacatacaatataaatgctatgtcaatagttgttatactgtattgtttagagaataatgacaaataaaaggactgcacatatttagtagagatgtaaccatccattttttccaacaaatattttcaatctgcggttggttgaatccacagatgctggacccctgaatatggagggccaactacactagaaacacacacgctagctgagaaagatggtggcttaaggagatcaccagtttgtagtagaggcccactctcggaaggtttggtaaaaagttgttttgaatcataatgttggctttattggcatgttgaaaccatttacctctgtaattttccatttgttttcctttccaactaccactcctcctgcctgataaataaataccattgcaagattatgctta

SEQ ID NO: 251828 - DNA, 641 bp, Homo sapiens
cagcaaacctttccctgctgtgaggtgggcaagttagttgctccaaaaacaagataaaatgattgagttcttttctcaagcgggagtcggagtttatctgctctgagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaagatgtctctgtgttaggaaaacttggataagcaggtccatagaaattcctctgctagccctgtctcctggaatttctacataatggcatatcctcagtttgaagctgaaaaggttaaattctacctgaaggatgaaaacaaccaacattctgtgccaagacagtcaggagggcaaccatgtttcctggtggagcctctggaaccactcaagccaagatgaccgggggtttggctgggaggagatggggaaactacagaccctacagatggtttcctgtaccatgaggttaagcctgggggcaggagaggctgtaccttagttccttcatctgtaaaataaagtaacatagtacctacctcataa

SEQ ID NO: 251829 - DNA, 649 bp, Homo sapiens
cagcaaacctttccctgctgtgaggtgggcaagttagttgctccaaaaacaagataaaatgattgagttcttttctcaagcgggagtcggagtttatctgctctgagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaaggacacagcatgtacaacctcacatagagttcctgaccagacaagacttgctggaaatttcccaggatcttccttccttaagtttgaatagctctctggttccagtttgaagctgaaaaggttaaattctacctgaaggatgaaaacaaccaacattctgtgccaagacagtcaggagggcaaccatgtttcctggtggagcctctggaaccactcaagccaagatgaccgggggtttggctgggaggagatggggaaactacagaccctacagatggtttcctgtaccatgaggttaagcctgggggcaggagaggctgtaccttagttccttcatctgtaaaataaagtaacatagtacctacctcataa

SEQ ID NO: 251830 - DNA, 578 bp, Homo sapiens
cagcaaacctttccctgctgtgaggtgggcaagttagttgctccaaaaacaagataaaatgattgagttcttttctcaagcgggagtcggagtttatctgctctgagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaagaactatttactgagctctacggagacacagctacaagcaccacatgctggacccctgaatatggagggccaactacactagaaacacacacgctagctgagaaagatggtggcttaaggagatcaccagtttgtagtagaggcccactctcggaaggtttggtaaaaagttgttttgaatcataatgttggctttattggcatgttgaaaccatttacctctgtaattttccatttgttttcctttccaactaccactcctcctgcctgataaataaataccattgcaagattatgctta

SEQ ID NO: 251831 - DNA, 805 bp, Homo sapiens
aaattgttttaatgaatgtaagctaaagacatctgaaaagtattatccaccccctcctagctgatgaaacctaaataacaaaaggtcaagcatcagagctggcagccaagcctctgaaacagggaacactgtacctgagacatagaacatagtggctaaatactgattgtctcagtcaaacagacctgcattagaattcttgttcagccacttaccattttcataaatgcaaactatggctaacaaaaacatgtatcccataggctgttgtgaatgtgagtagaacactgtgtgggaggtaaacacacttcatatgtgttagtgccaaatttttattccagagacttgacaaagttatccatttttgtttcaggcagaagagcacaagaaccactcccaatgacagctttctagtttctcctttaaactttagaggagtttctgcactgagagactggaatggccatcgtccggaaacatctgggaagaaatccatctcattaagactttcagcaaccattgcctcagggtactgtggaagtgatgctatgtgccttgtaaggctaggtgacaaaaatgccatgcatttccaccttgttctcttatggcacgcactcttggaatccagcctcccataaagctactgtgaggaaacccataggagcccatgcggaaagatcacatggagaggtaaccagcttagccaaggccccagtcatcatagaacagggacaagcctttcccagtgtgccttgtttgaattccttactcacacaattgtgagcataataaaatgatttcttca

SEQ ID NO: 251832 - DNA, 642 bp, Homo sapiens
aaattgttttaatgaatgtaagctaaagacatctgaaaagtattatccaccccctcctagctgatgaaacctaaataacaaaaggtcaagcatcagagctggcagccaagcctctgaaacagggaacactgtacctgagacatagaacatagtggctaaatactgattgtctcagtcaaacagacctgcattagaattcttgttcagccacttaccattttcataaatgcaaactatggctaacaaaaacatgtatcccataggctgttgtgaatgtgagtagaacactgtgtgggaggtaaacacacttcatatgtgttagtgccaaatttttattccagagacttgacaaagttatccatttttgtttcaggcagaagagcacaagaaccactcccaatgacagctttctagtttctcctttaaactttagaggagtttctgcactgagagactggaatggtatgctggttaagggcactggctctgggatttgtattccagctagtccactggactcctttgcctcatttgaggttttttcatctgttaagtgggaataatgataaaaacattgtccatctcatagggttattatgaggcttagtcaatacatgaaaaatgcacacaacagcacctgga

SEQ ID NO: 251833 - DNA, 684 bp, Homo sapiens
ccctgtgatccgcctgccttggcctcccaaagtgctggaattataggcatgagccactgtgcccagctgatagggaactaagttctttggtgcattggttatcttttgctgcattaactgactatggaaaaaattagtggcctaaaataataattctgtcattcgagttgggctcagctgagcagttcttctgctgatactgcctgaagtcactcatgcatctgtatctgggagctatactggggctggagggtctaggaaggtctctcactcaaatgtctggtgccagctcatctgggcctttcttttcacgttttcaccattcatctgtttagtccaggcttccttaggtgttgctgggaacattccaaaagggggaaggtggaagctttaaggcctcctgaggccattgtacaatttcacttctaccacattctgttgtagattagtttaggcatgaactgaaatggaaaatttagcagaaatggatcctggattttctggtacccgtgtttcgtttaattactttgttgctttctctccctccctgagttcaattaagttgagaaaagtgttcattgttattactgatggattagactttatttgctcttcattgaatgtttcagttaatttacagactagtaaattatctgagtcatcaagttatgtacgtgtatgtgg

SEQ ID NO: 251834 - DNA, 442 bp, Homo sapiens
ttgtataaagtagacaatgagtgaccttttattgaaaagaggaggagtcaaagatcctgaaagggttgggactgcctgcagtcagtccctagggaacttcctgttgtcaccacacctctgagtcgtctgagctcactgtgagcaaaatcccacagtggaaactcttaagcctctgcgaagtaaatcattcttgtgaatgtgacacacgatctctccagtttccatatgttgagattctacttattcatcagtttgttgtgcttgtcaagatcaggtaggttatttacaaactggttttcttaactgcttaaaaaatagaattagttgtgttgtcattttgcatgtcatcattccacttccttcggtgaacttaagtccatagagtcgtttttaaggaaaaagatataggaagcctgtatcatttccttaacatttccttaaa

SEQ ID NO: 251835 - DNA, 649 bp, Homo sapiens
ttgtataaagtagacaatgagtgaccttttattgaaaagaggaggagtcaaagatcctgaaagggttgggactgcctgcagtcagtccctagggaacttcctgttgtcaccacacctctgagtcgtctgagctcactgtgagcaaaatcccacagtggaaactcttaagcctctgcgaagtaaatcattcttgtgaatgtgacacacgatctctccagtttccatatgttgagattctacttattcatcagtttgttgtgcttgtcaagatcagacgcagaagaaacatgtccttcattcaccaggctgagctttcacagtgcagtggttggtacgggactaaatgtgaggctgatgctctacacaaggaaaaacctgacctgcgcacaaaccatcaactcctcagcttttgggaacttgaatgtgaccaagaaaaccaccttcattgtccatggattcaggccaacaggctcccctcctgtttggatggatgacttagtaaagggtttgctctctgttgaagacatgaacgtagttgttgttgattggaatcgaggagctacaactttaatatatacccatgcctctagtaagaccagaaaagtagccatggtcttgaaggaatttattgaccagatgttggtaagag

SEQ ID NO: 251836 - DNA, 540 bp, Homo sapiens
tactagtcaatgatgagatttgggtagggatacagccaaaccatattaatatggaaggtcatcattgcctaggaagtgcctgcataaatagatataagttgagcttttaatttgctttcagttcaggttaaatttggaatattggtaatgatttttaaactcaagcaagcgtattgtcactttttggcgatttcctaggcccaactgaaccataaacagaggattcctttgctcttgatcttttgagacctaataagaatgcacaaaccactttcagtgctctctttgcatgacaactatgtagatgtgatggagtctggcaatgtcaaaagaaaggaagcatcctctacccagggttgagattgcatcagatcatgggaactgacaccaaagccagtgtgaagtttaagagtggaggcattgctgagagtcccattttgaagaggtcctttttattcctgtgcacattcttgcccaatatcctccttactgatatatgcttctctattaatttttaatttctaccaaaatctcagaaag

SEQ ID NO: 251837 - DNA, 732 bp, Homo sapiens
cggatgaatacattgtaatgtaatgcactaatgggatgtagtcagatctcagcaggacactggaggctgctcctaagggagtgtcctgaagccaagtcatatcatagagagatgaatttggatattctgggttagaaaaatctgaggttatgagacagatccagaataagggtcactgatctgagaagcagaatgactaaggagcaaaaaccaaaaggcacttgaggagggtctggtggcatgagggggagattaggaacaaatggtagattgaagctagacccagattgaggtgaggcaagggtgtgaaacaatttggtccaagccagtcttatagactattccttttcttccttttccttcttttcagagatgggggtgtcgcaaagttgcccaggctggctttgaactcctagactcaaagcaatcctcctgcctcagcctcctgagtagctgggatagactatgcttttatctatcatgttgattatttatgcggagagctgggagaggagatttcaaaatgctggaaaataaactccttaaaaataatttttaaaatatatttaaaaggcttatggaaaaatacctcattattaaaacactatgaaaatgacctcacgaaaagaatcttcttattgcattgtcagaaggatgatgtaatgtttttattttaaaagaacattttagccacaggaataaaactgccacaggatatttatcatttagagg

SEQ ID NO: 251838 - DNA, 384 bp, Homo sapiens
aaaggaattgatgaacagtatcattctcttaactctgggatagggattctgtgaaggttaatgtatgctcttttttctagggagaagatccctttatatttgattgtcatggggatctgtggcccagagtaaaatcagcagtcccagctgtatagactttcaggttcattatggttgtgatctgaaaaccttggtcacctctgtggtatgtgtcattggattctagctacttgagtgaagtggctcctgtgcattcttagaagcgagtatgagagaggatggggtggagttccagttttactagagaaagctctcaaaagagaattttgatacccaacttgaaacctggaaaattaccaagtacagcttcgtgttaaaaaaaaa

SEQ ID NO: 251839 - DNA, 412 bp, Homo sapiens
ttataggaaggtagctgcatgttaccttcatgtggaatcagagttgttttgatacttcaaatatagagggtgtgtatggaagccaagtagccaaaggggtggactgtgccaattatttattgttgctcagttcccagtttatgtaaatccacatccatttatgccctgcttttgatacaggagatgggcactgtagacatttccctttggtgagctggcttcactttaggctttgccaatggaagcactggagacacaatgtaaggaggaatagaggagaaaagggtcttcccagccaggcacggtggctcacgcctgtaatcccagcattttgggaaaccgaggcaggattgcttgagcccaggagtttgaggccagactgggcaacatagcaagacctcatcaatactta

SEQ ID NO: 251840 - DNA, 527 bp, Homo sapiens
tagtacacttgatagtaccttgaatatgtacagtacatgtaggcccattttatggacctctgaggcacagttttttcccttttaagttattagatatttctgtgatttatttgatgcactcagatacaaattcatgctataataagttaaattgtaacataatatctaccttaatcaaatatttatagtttaggccaggagcctggcaaagtaaagatgacacagatgtaatgcttgataagtaaataaatatgagaagagatatatattaaaacacctgtgaagtgaatcccctgtgaagaaaagaaggtctctaacaatataaacctgtatcaggaaaccctgtgattctgattctgtgcacagaaggatacatggaattctcagaccttttctagttgcaaccttttaattgtttgactttatattctgtcctctcaaattctccttagactgtgacgtgttaatgctctcttttatattttctaattaaattccatacacattaatttgagaactgttggaga

SEQ ID NO: 251841 - DNA, 410 bp, Homo sapiens
gccgttcagaaaccacttaacgcctctgatggcgattggctccgccgctctctgcttacctggaaagcacgcttcttctaaacacaaggctttcgggcccccagcaactcggtttgcagaatgataaaaatgacagcacgccttcctggctcagccctttcagcttaaaggtctgagagagagggaacgtgatgaattctatgttccctatttttttcctcccaacaattgcatgggtgtaggcacaccttcagctcacaggtgctggaactgcctctcagagagatagacttccttgccattccaagaatgtcttattcctaagccttcgccttcgagtcaactgtatcatttttaattacctcattttcgaatattacttttgtaattaaaattctttccattatact

SEQ ID NO: 251842 - DNA, 654 bp, Homo sapiens
  misc_feature (499)..(499): n is a, c, g, or t
  misc_feature (502)..(502): n is a, c, g, or t
agtattaaaagagaagcactaacaatgccagtgaccatgtaacatggatttaagctataagtcatagaaatgtgatgagaaacctcagcgctgtaaaacagagggtggaggaaagcttttcctctctcaaatgagctttgcgaggtatacttcttgaaggataggaagttgaagtgttaggacttttatgtctattctactttggcttagtttacatgattcttagtttattagcctataaatggccaagaaaacttaaggttcaataattagttataaatatgaaatatccccaatttttaagataaaaacaacttataaatgtatttgtctgtaaaaattgtgtatatttttacagaacatctatttatttttttatttttttattttttttattatactttaaattctagctaacctgcacaatgtgcacatgtaccctaaaacttaaagtataataataataaaaataataatcatagaaaataaaataaaattncanaaaaaataaaaaatatagtaaatttaaaagagaaaaagatgaggtaaaggtaaatgtacagaatttaattactttttcttctataaaacccgagtcagtaccaagaagagtcaatttattagttttctaaaataaaaaaaaaatcaaaatca

SEQ ID NO: 251843 - DNA, 533 bp, Homo sapiens
cagggaggatcttttgcccctattgttttcttgggtgttctcactctgggggcctgacattcctcgcgtgtctaaggcaatgagggagcagtgaagcgcggggaagccgcacaaaagacatccaaaggctatcaatggaaaaagatcaattaggtgcacacaagaaacacccaatatgccagggaagagaaaaatacccttttccagagggtgggaaattgattgagcttctgtgagggtccacaaagaactggacggatgcagtggtggatggcgatctctctggaccactccggacgcgcccagcagacgcagcctacgcctttaggtcctaggaggctgagaagggtggggagaggggggcagcacgatcttgtgtctttcctccccgtgccgcctctaccgaatcgcggatgcttcattaatcttgcaggcgccgcagctcgggtcagtatggaggcggatcggtggcagagcccgggcctctgggctgcgcccgcccgttcagcctggcccgggaggggagcggccgc

SEQ ID NO: 251844 - DNA, 425 bp, Homo sapiens
tgctgatttttttttttaatttgcagggtttttacataacaaattatcagaaaccaaagcacccagatatcagactatgaatagaaaacatctttcctgaacaagtacaggctttattacttaattgtatttacactgatgagtgcgcacaaagaaaaatcaatttgtgggagtttatttcattggtattgaaattgtatcttccttgaaaaacttggcacaaagtgcctagtttgtatcccagttcattatattattattttactatattctgtgctgttatgtagttttatatgggctcactagttgagtgttcaaaattgcttttctaaactatagaatattaacttccagtatttaccaaaaaaacttatttattaaaaaaatcccaataaaagggcataaaataaatataaatactcaac

SEQ ID NO: 251845 - DNA, 373 bp, Homo sapiens
tcttggtattcaattgatttttattctgcttgggttagcagttttattaaccagttagtctcttcattaaagttctgggaattcttacccagttcaaataatatcattctaaagttctcaaaaacctgtattcaagagtgcttctgagggccttctccatcctttcatgaacctccttaaagatacaatattccaggattttgcaagcttgtaaagttttcagaaactgcctcagaattaagcaatttactgtggaaatgactttaagttgtcatagtcagacacaattgacaagaaaattttatttatttataggcatgagccacagcgcctggcctctaaagctaatttaataaaactttataaatgcatt

SEQ ID NO: 251846 - DNA, 417 bp, Homo sapiens
tagatatgagttctaaatttctcttcaaagaatcaatatgtcagtatgttccattctttgccttttacttgtaaacttcctcgtaacgcaaacattttcgattacctgctccatcctgactcattccgattacctgctctgccctgaattctgatttcctgctctgccataacaatttttcccgccaaatcactcaccctgtcactctctttaaattaaccaattggcattagtttagcctgtgcggtctaaccctaaccaataggggaacaacacagcagcagaggccacgtgcatcagggataagaaccccttctcccttgtccaagtgtgcgctcgccattgctccatctataagggcgcacccttctatagaagtacattgccttgctgagaattaaaaagaaaattttatat

SEQ ID NO: 251847 - DNA, 409 bp, Homo sapiens
gcattagacaaagttaactgaattggctggatttccttggtcaatggtattgcagattgattacaattagatccactttcaatggaaaatataagttgaccccttatgaaatagtcactgaaaggtttgtgcccctaataataggacctcatgtatcctctgctcctaaactctgaaatgactaaatgctgcaaatctttaatgcattatgccaaagtgcactttttttttttcgagatgaaggaagcttttcatgatgcactaactgaagacaatgaaacccattatgatctagaacctggagactgagccttctaaaaacatcagaaccagcatggcacatgtatacatatgtaactaacctgcacattgtgcacatgtaccctaaaacttaaagtataataataaa

SEQ ID NO: 251848 - DNA, 639 bp, Homo sapiens
cgacatctaagctgagatctgaatgttgatgcagttgtaggcataggaacattattgtgtccagcgatttcagggcacagtctgcagctggtggcacaactctcagggctatataatgatgtatggcttgttcttcgtggccctctgcaaaaaaaaatatgaatttcagaacgtgaacaactagcagacatctgctgcattaagagggaaaagtcagagctaactagtttatcttggaaacatttccatttctattaagtttccaggcaaagtggattctgctggtcagggcaccacacttcgggaaccatgaccctctgataaccttccctttggcatgcagagtagctcctgtgtccaaggcagtaggcaggaaccaggtgaagatgataccaagaagtctctgaagagggtcctgttctcagggagataacagaccagtgagcctaggtggagaatgacattgaaatatgaaccaagcaaagactggaaaggtgaaggtcatcattggccaacgtcttccttctcagttactaaaacaagtcatgggattaagtcatgatcatcaccccatgtgacactgaaaggaatgaagagactatattggatattcagttaattatatgtctcatgcttcat

SEQ ID NO: 251849 - DNA, 305 bp, Homo sapiens
aaaagtagaaaccatcagctaactttagaaactttccctgtagggttagatttccttacaaggtaaggtactttctaacacgttctcagccctccattagcaatacagaaatccccaccaaccccaccctcacttccttccctcacccctaggaatactcaacaattccaaggtccaagaaaggaatttattcctgtcacctaaatccctacagaaacattctcactcttctcataaaagcaataaaatctgcaggtttaaggcttagaactttgatccaataaaagttatattactataccaaa

SEQ ID NO: 251850 - DNA, 277 bp, Homo sapiens
tcctaaggtagtatctgaagtcccaatcctactcctcccaattcctgcacttttttttattaaacattatctctctaggaagtgcctcttaaaatacaattacattatgggcttggtggtgtgcaccttagtcccagctactcaggaggctgaggtgggaggattgcctgagctcaggaagtcaagactgcagtgaactaagaccataccactgcattccagccttgtggagcaagaaaagaaaagaaaaaagaaagaaatcaaaatttaaaaaaaa

SEQ ID NO: 251851 - DNA, 423 bp, Homo sapiens
ctcagccggcttccttagccaggatctggagtccaggccagccttggctgaagctctagactccctgagcctccatcctcccctgcagcttctgtctgaagccacaaagaagtctgagaatctaagctactgaaagaaaagatcagccgggcgtggtggctcactcctgtaatcccagcactttgggaggccaaggcaggtggatcacaaggtcaggagttcaagaccagcctggccaacatggtgaaaccccgcctctactaaaaatacaaaaattagccaggtgtggtgacgggcccctgtagtcccagctactcggtaggctgaggcagagaattgcttgaacccaggaggcggaggttgcagtgagccaagatcgcgccactgcactccagcctgggcaacagagtgaaactccatctc

SEQ ID NO: 251852 - DNA, 595 bp, Homo sapiens
accgtctggcccgtggtacgaaaacacacgaggtcatttttacagcttggacaaagattccaggctccagggaccaacagcaggtgggcgcgaggatagtttctaagctaactgtgcttgagttagccttttgtttcctatttctctacacttagataccctgtttgcactatctatggttgctctgaagtaactgtgagagttatgaagagtaaagacatttaaaagtcgtactaacctcaactcccaggcaaaatgtgccagaattcccctaagaactcccgtaagaagtggagatacacctaatgttaaatgacgagttaatgggtgcagcacaccaacatggcacatgtatacatatgtaactaacctgcacgttgtgcacatgtaccctaaaacttaaagtataataataaaaaaaaaagaagtggacattatttgatgaaagggaaacttgtggcctccagggtcatgattccatagagacagtttctctgcaaaagccagcctccctaccacccgcccccatctctgatggcttgcaagaagaggaccctccggtggtggcactgtccccactgttttaggatggtgc

SEQ ID NO: 251853 - DNA, 460 bp, Homo sapiens
aataataacagcccttcccaaaaactaaactttctttgtaaaactaatgaaaggccaccaagttaggaggatgaaaggggtctgaattctgctagatgtaggcatagttaaatacttactagtcattattctggaggtcccaagatttgcaacttccccaattactcctgcagatagcatcactcttgtagaacctaagattgaccttttgagatgtcttttaaggcttttgcatttctgacaaccagatgattccacttggacctggacattggacctggactcctctagtagcccccactcagaaacagcctcagcacacaaggatcattttccacacccctatgattgcatcctcaactaatcaggatgtccccttctggatacccttgcccaacaaattctccttggaaaaccctagtctacaaatttctggagagattaatttgagtaataactg

SEQ ID NO: 251854 - DNA, 503 bp, Homo sapiens
tgatgtatcatagtatattttatagaaatttatttaatccttccccagtgatgaaagtgttatttggatgtaaaaacttttgctacaaattgagcatcagtttatactggctgttttatttgcttataatgtttttcattgggagtcttattaattaagatcttaagtcacttgttaagtatttaaagtgatttaggccttgaatgactgaaaaggacctggtctcacaaataaataaattttgatatactttatttcataagaaagagtagtaattctcaattcaggggcatcaggaaagatttgtcatttatagacatacattaaaaatactgattttatatgacttaatttgtgctagaaggagtgtttttttttttttctttaaatatggcttgcccttggaaattgattaacagagtcctttcttgtcctaagttatttttatggcagtgtttttaatactttaggatgtatatgtctaattattatatggacatatt

SEQ ID NO: 251855 - DNA, 278 bp, Homo sapiens
ctgctccagagagcattctattcctgggtgtcctccccagccttcccacaggcagccctcctgtttgccctggagatagctccagaggctgaagtctggaggggaacaaaaaacaaactgagaagaggaagtttgcctcctggcagtggggacctggaggaacaggtatgtcttggagggaagggggaagtcaaggagacacacacgctctttcaacagaatcagctcttaatatatttttgaagtgcaaaattgagtattaaacatcttaaaatctt

SEQ ID NO: 251856 - DNA, 333 bp, Homo sapiens
ctccatcacagattggtagcacagtctatgatgagaagatgctacgggctgaactgtgtccccccaagatcatatgttgaagccctacccccaatataactgtatttggagatagggcctaaacagagataataaatttaagtacagtcataagggtggggacctaatccgatgggactggcatccttacaaaagagggagaaacaccctcgaaatggccatgtgagggtgtagcaagaaagcaactgtccacaagtcaggaatagagtcctcaccaaaaaccaaatcagctagaatcttcatcttggacttctagcctctagaactgtgaca

SEQ ID NO: 251857 - DNA, 421 bp, Homo sapiens
aaaaatgaatgtgctgatctacctgctggagctgggatacactcttcctctcccgtccttggacaataactccagacttctcggcctttggattccaggacttacatcagtggctcccctccctgagttctcaggcctctgggctcggcctgagagttacacccttggcctccctggttctgaggccttcagacttggattgagccatgctaccagcatcccagggtctccagcttgcatatggctcattgtgggactttttgcctaccataatcacatgagccaattcctctaataaatcccctctcagccaggtgcactggctcacatttttttgtttcccagtgcatgtaaaagttatgtttacactatactgtaatctattacatgtgcaatagcattcattatgcctaaaaaaaaa

SEQ ID NO: 251858 - DNA, 378 bp, Homo sapiens
aggtttatgtttttcctttaagtccgtgatccactgtgagttaattttcatgtaagatgtgagacttagattgaggttcttttgttgttgtcattgttgttgacaaagccatcctacttccattgaattgcttttccgtctttgtcaaaaatcagttggacgtatttgtgtgggtctgtttctgttgtctctgttttggtccatttttccatgtgtctgtccctctgcaaataccatagaatcttgccaactctagctatattgtaagtcttgaaatctggtagcctgattcctctactttattcttatttttcaaagtgttttagctattctattatctttacctttcaatacaaattttagaataatcttgtttat

SEQ ID NO: 251859 - DNA, 1033 bp, Homo sapiens
tctacccctaggtgctactgtggggcgggagcccaaaagggctcacccgggctcctgcacctgcccgtctgcacgctcccctgcacgctccccttccagcaaatgagccacagcccctgttgcaagtacccagagcgggtcagggaactctcctgtttcaatgataattagcaacaatgttactggtttacatattcactacattctacttcccatcactgtttcagaaatatactgcatctacttattaaaacttacagttaactgtaaagcagcctcaggcaggtccttcaggaagagtccagaagaaggtactgatatcatagggatgacggctccatgtgtgttactgcccctgaagactgcagggagacgggacttggaggtggagggcagtgatgtggatgatcctgactctgtaggcctaggctaacgtgtgcttgtgtcttgtttctaacaagtaagtttaaaaagtaataaataattttaaaaatggaaaaaagctcgctgggcgtggtggcacacgtctgtaaacccagcatttctggaggctaagacaggcagatcgctagagcccaggagtccaagaccagtctgggcaacacggtgaaacctacaaaaaaatacaaaaattagcccggcatggtggccacgcctgcctgtagttccagctatccgggagcctgaggtgggaggatctcctgagcccaggaggtcaaggctgcagtaagccatgattgcgtcactgcactccagcctgggtgacagagtgagactccgtctcaaaaaaccaaaaaaaaaacaacaaaaaaatggcttttaaaaatagtgactttatagctcttccccaagcggcctgagatgatctgtgaaaatggttcattagtcacttgacccagaaatccccacaaaatcgtgcaaatccagaggtacaggtcttcttgatcactttaagaacgctcgtgaaactgcccaggccatcaagggtatgcatacgtgagaagtcaccaagtgtctgaaaaacgggaagcgg

SEQ ID NO: 251860 - DNA, 285 bp, Homo sapiens
tggaaagcgctggcagaggggagacatcactcagtccagccacgcaccaccagtgccagaggtggagcccaagctccagcaggagagacacctgggttctaatgtcaccttcgctgctggtgagcacaggaacctcaggcctgtcaccccacctcactcagcctctctcctcctctatagaaatcatccctgccctcgggctgatggcaaggttcaatgagatgatgcgtgtgatgtggttagcgtggaccttgtccagggtgggcctgaaaacatttagtggta

SEQ ID NO: 251861 - DNA, 817 bp, Homo sapiens
gggatctgagaagcaaatgatgtgtttgaaatgcctggcatggggtctagacacaatactgctcaacctttaagtttccttcctccttttttcccaggcttgtgggtcttatccagtcctgtcacctgtcacagtcttcgtcctcctcctgttaccacttatggcccttgggatcttcctttgagagccctgacttgttgggcttggcccacccacccagctgccctgtatgtcagtcacctcccctgtaagctgagaagggatgacatcagcctttccctcttcccccctcccaagcctctaggctgttttgagccataaatattttagctgggcctttctctggctgttgccaaggtgatgggctctcaggggactggggtgggagtgtggaggtagggctggcagcctggggcctggcagcagagctggccctggaggagtgggtatgaggcctggccaagagccaatgcttgcagcttgacaagcaggctgttgctctacctgcttgccttccctttcctcagcccctcagagccactcctattgcctacaggcccacttctgcccttggctgctgctcttcgacctcaggtaaattgttcaatgtccctaggctttcattttaacattcgtaacaaaaatccaagaaagcaaaggaggttttgtaaaaatgctgtaagatgccaggctagtgaatcatgattggagaagctaggtcccactgccctttctgatagacctaaaggctgaggtcttgatgccatgtggatgtcaccctaaagacagctcttagatatgccactctctccccttc

SEQ ID NO: 251862 - DNA, 901 bp, Homo sapiens
acctcacgtctttctcaagaaatacattaaatttgaagagtaaagacattacataatgaactaggaaataattaaaatttgccttaaatatttctttgggggagagaacaccacacttctactcaatgaagagaaacatttttacagtccagaggtctttcattttttaaacacctgtcacaccatgaattcatagggaataggttccagcagctcaggctgcttcccattggttctcaccaagtgtgcttctctgggtggagcaggctggcgcttcagttgaacccaggtacctttctcttttgcttctgtctttttctaatcatctttcttcacgtgtttcatgaagctttctcggctcttagagtgcttaatgtgctcaatacgcacactaattctcttggcaagaatcttgcccttgtttgtttacaacaatgccagcagcatgctaaactgtagacgcttccagtttagccatggtaacacttgaggggcattcctttttgaacagtacccattcccttgatgtctacgatatcacctttcttatagattcacatatatgtggccaaaggaacaactccatgttttctaaaaggtctagagaacatatattggatgactctcctctttccctttgtgtttgtcattttgatgaattactgcaagatggcagttctggccgaaagtgttctttcttaattcttaactgttatagttggggtaaagaggttttagaatttctggtagacaaaggaaattgcttattaagttgtatagtaactttcatgttgaggtaatccgttctcaaaacaacaacaacaacaacaacacaaaacacccacacatactcaactgtttcatttacttttattaaacatttgatgattagtatttgcac

SEQ ID NO: 251863 - DNA, 497 bp, Homo sapiens
gaagtgtactggttaaagaagcaatgaaaccatcaaaacttaaatatcatttaaatgcagaagttaaagaagtttaaaatcaaaattatttttctgaaaaactgaacaaataaagctaagaaagcatttttcattgaaacttgatgaatgtacatgttagtaattttgattagtattaaatcagtattttcctttgggactagtgacatgtgcattcatcaagtatatgtgtaatttgaacatgatggtgatatgaagaattacagcattttttagcctaattgccatcaaacataatgagctctgaaatgtataaaactatggagaattacatcatcaacgaatgtggtttggagttttaagttttgcatgggagtattttttgactgtgcagctgcaatgacagaaaaatattctgagtagttacttaagtatgaatttatatattatgtatgtatatattttttcaaacatggtgacatcacactatatctaca

SEQ ID NO: 251864 - DNA, 389 bp, Homo sapiens
gagccaagatcgcgccactgcactccagcctgggcgacagagcaagactccatctcaaaaaaaaaaaaaaaaaaaaaaaacagaaaaagaaaaaaacatattttagacacacacaaaaagcatcaaaaaataatataatgcactttgggaggccgaggcgggcagatcacgaggtcaggagatcaagaccatcctggctaacacagtgaaaccccatctctactaaaaatacaaaaaattagccgggtgtggtggtgggtgcctgtagtcccagctacttgggaggctgaggcaggagaatggtgtgaacccaggaggcggagcttgcagtgagctgacattgcgccactgcactccaggctgggcaacagagcaagactctgtctcaa

SEQ ID NO: 251865 - DNA, 457 bp, Homo sapiens
tggatcccccgggctgcaggtttgaattcactgaaatttgccctattacttttatactgttcttcctcttctagtgatagaatcagcctcacttcttaccatgaagataaatatgtctgttggaccagagagatgtacttaggtggtctttaaattctcttctacctctaaaattctgtagttctgtgttccatctgctgatactacctcagacacttaaaatcacaacttttcatcctggtgttagtcctttttattttattatttctatctttgactctgtcactcattttcttttaagaactcttagccctgggtatggtagcgagcacctgtaatcccagctactcaggaggctgaagtggcaggattgcttgaggccaggatttcaaggcagcagtgagctatgatcatgccacagcactccaccctgggcaacagagtaagaccccatctc

SEQ ID NO: 251866 - DNA, 403 bp, Homo sapiens
tggatcccccgggctgcaggtttgaattcactgaaatttgccctattacttttatactgttcttcctcttctagtgatagaatcagcctcacttcttaccatgaagataaatatgtctgttggaccagagagatgtacttaggtggtctttaaattctcttctacctctaaaattctgtagttctgtgttccatctgctgatactacctcagacactttttgactctgtcactcattttcttttaagaactcttagccctgggtatggtagcgagcacctgtaatcccagctactcaggaggctgaagtggcaggattgcttgaggccaggatttcaaggcagcagtgagctatgatcatgccacagcactccaccctgggcaacagagtaagaccccatctc

SEQ ID NO: 251867 - DNA, 373 bp, Homo sapiens
ctccatgattcaatcacctcccactgggttcctcccatgacatgtgggaattgtgggagttacaattcaagatgagattttggtgtggacacagccaaaccatatcaggtacttttactatccaaagtaatacacaaagcagtcaccactaagtgatatcctggttcctctgaataaaagaaacaaaatccaaacaagactgaaagctaggaagtgagcccacccagaccggcaaaaccaggaactgaaaaatcactccaggcccgtcacatttgtaaagtgcttttaaaagttctcctcccaaccccggctcactttgtacttaggaaaaaggaattcaaggtataaattgaataaatagatatgatagtga

SEQ ID NO: 251868 - DNA, 458 bp, Homo sapiens
ctgccagcttaaggaaatgccactcacacaacggggatgtctttctcccgagaggtctctccatctgactccatcctgagaagtggtctccttgagtgtggtataagagagccctttcccccatcacaggggcccaggaagcccaaggatggagggacccatgcctgctgctccttggggctaagtcacccaacctggttctcctttccaatgggtcacccatgtcagcaagccccaggactgactcgctccaagctcctccttctgggaatggaagcatggtgggacaaagctccttgcagaagctgataaaccttagatcacacaggtttagatgctctgatcagtagaggttctctccctctgctgaagtaatgtgaatttgcaaaaatcgcttcaaagtaaacaattaaattgaaatggtgatgggtgccacaggaatgcttaaatggcagcta

SEQ ID NO: 251869 - DNA, 581 bp, Homo sapiens
gacagagcaagactccgtctcaaaaaaaaaaacctcgctttctgctcctcgcttagcacacgttctctctagggaaggtactaggcctgggaagtcacagctgaccatgaacagtgacaagagtcagacgctcgaatcggacacatggatgagcagacgtcactggcaaacagccagttgtcactcatggggctgaagagatgtttgtgcaatatgtacagtctatacatccatatttatggatacgactttttcatctgggtttttaggtagtttttggtgttcataaaatatagagcaatcatttaaaagatattgtaaagcctttaaaaacactggccttagcagttcttgatgacctcgactaaattcagccatgaagctctgtggagttggattttaggaaactgattttacattgtaatgtcttccttttagagggatgtttatgccttagtatcactcaaaacacagtatctacctcaaaggatacatgcgtggttttttctgcaggtagctggagttttttactgctgtaagaaactgattgtataaattcactatcgttcgtttgttcattg

SEQ ID NO: 251870 - DNA, 433 bp, Homo sapiens
aggagtaaaagttattacttcagaatccaaagtccaaaataaaacatttttttttaatctttgaagcctcacacacaaaaaaagataataccacaagatgataaacagagatgaaaaagacagcactgtgtgtttaaaaagaccttcggccgggcgcggtggatcatgcctgtaatcccagcactttaggaggccgaggcgggtggatcacctgaggtcaggagttcgagatcagcctgaccaacatggtgaaaacccgtctctactaaaaatacaaaaattagccagatgtagtggcgcctgtaattccagctacttgggaggctgaggcaagagaatcgctagaacctgggaggtggtggttgcagtgacccgagatcgggccattgcactccagcttggggaacagagcgagactccatctcaccaaaaa

SEQ ID NO: 251871 - DNA, 241 bp, Homo sapiens
gcttttctacttagcattttattggttacagagtagttttctatacataatcttaaggaacagctgtgtacagttacctaagttttacaaacgattatactgagaccaagtttgaatatctgatgagtaactggcaaagctggaactcaaaagcagttccttctagtgactgtacccatatccaaggcttattgcaacttttagtcttgcccctgctacttacacagtccagaatcacttg

SEQ ID NO: 251872 - DNA, 744 bp, Homo sapiens
tgcgctgcacgcggactgggcggaacccgccaacccctatgctgactcgcactggagggcggccgagcgcttcctgcagttcgagatcgcctggttcgccgagccgctcttcaagaccggggactaccccgcggccatgagggaatacattgcctccaagcaccgacgggggctttccagctcggccctgccgcgcctcaccgaggccgaaaggaggctgctcaagggcacggtcgacttctgcgcgctcaaccacttcaccactaggttcgtgatgcacgagcagctggccggcagccgctacgactcggacagggacatccagtttctgcaggacatcacccgcctgagctcccccacgcgcctggctgtgattccctggggggtgcgcaagctgctgcggtgggtccggaggaactacggcgacatggacatttacatcaccgccagtggcatcgacgaccaggctctggaggatgaccggctccggaagtactacctagggaagtaccttcaggaggtgctgaaagcatacctgattgataaagtcagaatcaaaggctattatgcattcaaactggctgaagagaaatctaaacccagatttggattcttcacatctgattttaaagctaaatcctcaatacaattttacaacaaagtgatcagcagcaggggcttcccttttgagaacagtagttctagatgcagtcagacccaagaaaatacagagtgcactgtctg

SEQ ID NO: 251873 - DNA, 697 bp, Homo sapiens
tttaagacccagctatcagagactttctatgtcttagcagcctcctgataaaggaagtcaaatgaccaatcaagtttttagtgaagaaatccaatcaggccaggtgcagtggctcacgcctgtcatccaagtactttgagaggccaaggctgggggatcacttgaggtcaggagtttgagaccagcttgaccaacatggtgaaacaccttctctactaaaaatacaaaaattagctgggcatggtggtgcatgcctctagtcccagctacttgggaggttgaggcagaagaattgcttgaacccaggaggtggagattgcagtgtgctgagattgggccactgccctccaggctgggtgacagactgagactccatctcgaaaaaacaaacaaacaactattttagttttgatggcttaaccattcattccctatgtcttcatggttaattgaaggttactgacagtagacaaaaaatgtattctcatttgactctaatttttcccatattctacttgaacaaatttaaaatgttctgctgcctatacaccccgacatctaggagtattaagactagtcagtcatatctgttttcagaaatgtcagaataaatatatattggttactggacattctagaaggaagtcttcaagttttaatttttttccagtgtgagcatgcctcaacattttgcata

SEQ ID NO: 251874 - DNA, 406 bp, Homo sapiens
gatgtctgtccctgaagatattttctcatagaagcaaggaattacaggaacttctctgttgtgttttgggtaagtgtttccatgctgctactctgaataatagggtagatatttccaggtacaggctgttaaaatttgctatattacctccattctgtatgtagttccttctctacataacagtgttggttaggtagtggaaccttctaaatgacgcactatgtgattcctgtgtcatatagaatgttctatgattcttagccagataatcatattcccagaaaaggcctctcaactttcacctgcctttctaaggactgaaatactctgagtgttgcataaagggtgttccaaatatgggcattcacctgtttcctgattaaaaaaagataatttggtatgaata

SEQ ID NO: 251875 - DNA, 672 bp, Homo sapiens
tattctcttatttaagttttttcatagagaaaagtatattttctctccgtctcccctctcattttcaagcctgataccttaggaaattttaaattctctcttcttagctttcaaattaattgtttgtgtatcttcgctctgctgtacttttcagtttctcagagttcagacaaccaccatgagacctgcagcttttgtggccctgttggatctaatctaggtaggagagtccactatggttatctgtgtccagacagttgccagatggaaccagagtgaccatgactgggaatgctttcccaagtagtgacaaaatggcctttgtccttcttgtccatttgatccccatctttaatcattgtgctcagagctactgctcccattcagaaagtggctgctcaaggacagcatatttttcccaaaagtacacactttacatgccttagcagtgagtgctgaagataagtgttttaagagttcagagaggttttatatgcaagaaactaatgcttgaatgtggatcagtatacattatgagtttactgtctcctaaaatacctgtaaaatctagtctttgtaaaacagtatgtttgtcttttttctgatgataatatgttccagaaattttatatcttttttcataagaattttatagctgctattaattggttt

SEQ ID NO: 251876 - DNA, 788 bp, Homo sapiens
ggcgggagaattgcttgaacccagaaggcagaagttgcagtgagcagagatcacaccactccagccttggcagcagagtgagggagactctgtctcaaaaaaaaaaaaaaaaaaatttttggcctggtagttaccttactatttttgtcaggcgttcagtgcttttaggaatctgttttctatattttatatagaatttccaattgttggtctaaaaaacccagtctgccatagtcttagaaagggaagcgaacatcaccacttttctcagtactttaaatgagaggttcttttaacctaggattcatgcatggagttcaaggcatctatatacccccctgaaatttcatgcaatgttttgtgtttaaccaattttttctgggaacaaaatccatagatgttatcagattgttaaaggtgccagtgatagagacaccctcaaatttgataactattgctttagagttctatcagtacctagtaattttaattaaaaaatgattttagaatgatttcaaactcacagaaaagttccaagtagagtgcaagacaatctccacattgtcgtcacccagattcgccaatgttaactctgccctgaccccacacacaattagtctttttctgaaccatttgggaacaagcttcagacctgagtccacgttacccctaaatgctatagtgggtatttccccaaacaaggatcttccaaatcaagaagttaacatcgctacaagaccgttcacagaatctatataagtttcaatttttcaatttcaactgtccca

SEQ ID NO: 251877 - DNA, 665 bp, Homo sapiens
ctgggattacaggcgtgagccagtgcacctggccggtatgtcatattttttgtaactactataaatgggaatgctttcttgatttttcagattgtttgctgttggcatatgtaaatcctcctgattttcacatgctgattttatatccttcaactttacttaattcgtttatcagttctaacagttttttggtgaagtccttagatttttctaggtataagatacatgttgtctgtgaacaagactaattttgacttcttattttccaatttggatgctctttatttctttctctttcctaatggtttttgcttgattataactttgagacctcacaaacaagaggatatagttttaagtattacaaagtcatgtgcatttaggttatatgactatatcaaagattagagcaatggaaagagctgttgttttagatatatagttaagtgaaatttaatgctacctaaagaatactggagggcacagtactaagaacacaaaagatgttttacttttcctttgaggagaggagaaagtgaaatgagttcaatacaaatgaattttagaaacagatgggagattctaggatgcagttttatttctgagatttctaaagtgtatgagtatagccacagttgtcagtattaactatagagagttgaggt

SEQ ID NO: 251878 - DNA, 392 bp, Homo sapiens
gcgtctctccagtccttgaatgtgggctcatacattttgagtcaacacttgtaggttgaattcttctcacacttgtaatctctctaacttcccgtctgctgcatctctcttctgcctccaactagagaaagttctctgcctgtaaattctcgtgtcatgatatcggactttcctgaataacctagtgtaatatttttattttaagttcagttacataaccttaatgcttctgcaaagtgcctttggtcatataacaaagcatattcatttttcaaggataattgtataaagcatctttttggagcaattaattattcagcctactattgatgtagacaatgtgtctttggcagtgctttgataagaaaagaataaaataattcaccataatt

SEQ ID NO: 251879 - DNA, 285 bp, Homo sapiens
caacagggctcagggcgcccagagcccaaggaaaggggagatgcagctcggcaagggcctttggggagcgaacctgactccacgcattcatctgagagttcccgggctgggggctgcaggggaaaccctccccttccaggttcctgtaagtggcacccaaatggtacatgtctatgaatagactttaaaaggggaacatccacggcctttctccccacctaatttctcccacacatttatgtgattaatttcattttcttaaaatctaacaccttgaaactacag

SEQ ID NO: 251880 - DNA, 379 bp, Homo sapiens
agagagacaggcagttaagcagttgcaccttttccaggcaaaagatgatgatgccctgattagggcagtggcttcagagatggagaggaggagggagtaaagaaacaggagcattggccagacacggtggctcacgcctgtaatcctaggactttgggaggccaaggcaggtggatcgcctgaggtcaggagttcgagaccattctggccaacatggcgaaccccatctctcctaaaaatacaaaaattagccgggcttggtggcatgtgcctgtaatcccagccactctgcaggctgaggcaggagaattggcttgaacagtgagccaggatcacacgacttcactccagcctgggcaacagagcaaaactccatttc

SEQ ID NO: 251881 - DNA, 225 bp, Homo sapiens
gagtacaaagtggctgcctctttggggaggacccagggtgggcaaagcaaggcaagggactgccttttttcattgtaagccttgtagttctatttgtctgttaaaaatatgtacgtgttattaattttattgaaaagaaaagctaaagcaaaaaagaaaaaaggaagaaaatgaaggatcaaagaggtgaagtaattcgcccaaggtaatacaggattcagaact

SEQ ID NO: 251882 - DNA, 510 bp, Homo sapiens
agtaggtaagtgatgttccttcaaggcattcaaggaacccactctggaatagactaaagagactctgagtcagttagtgttgcccacgagggtcacagccggtcaatggcagacctggactgaggttcctgcccagtctggagggtcaacacagggtgtgttgtcctgctacctgtcagagcaggcacaaagcaagactcagtgaggcagaccccgatttgctctgaagcatccttctatctgggcattggcagaactcccaaatgagtgggtaaaggtaccaaaaaagttcagcctcaaatgagtgggtcagtaagacatgagacagtgaaacgttgttcaattgtgggacatgggattggcttggcagagtcactctgctccatgctcagcctgcagcctcctccctggtatcaaggccttcctacttccaggttcatcttttgaaatacatcatttattttcaaaatatactgatgttaataaaaataatgccaaagatatactaaa

SEQ ID NO: 251883 - DNA, 693 bp, Homo sapiens
tcagatggacagagtctctgtaacagaaaaaaaagggtgttttctcttgcatatctgaggtgaagtgtgtattctgtgtgctcttagcaattggcagtcctcttgcttaggtttacaggtgtatgtgaaaatagacctgagtcttttcaaagttagatcatttttctgatttcatcttttaacttttggcaatacatttgttttgatatccaccctacttggtagagtgtaagtacttccttacaatgttctaatgtaaaacagtgcataggagacctttctgtccttggttgcccaaaatctttttcatttctactaaattcagaaatacatatttttactagcttatgaaaatttggaaaatagcttgacatccttttggataatgaagtgattagttcatatattgaagtatataaaatcaactaggaagtaaattcaagactgaaggaatgggagagcttgtgtgagttttggttgtatcagtccagaatatgtaattttccatttccctgaaaaagacttcagaggaaatttattttccccactatacgctccagaatgtctttcggtgaaatgagagggcttgggctcttctgattctagacgtagctatcagagtttgcttaatgaaatatgggtctactcacaaataaagcaatttaatggtttcgaaagagtaggcaacttgtg

SEQ ID NO: 251884 - DNA, 939 bp, Homo sapiens
agtcccagtcatttctctggtgtgactgggggtgtcttatggctggctggtcctgctggtagacaagagcctgcttctccttttggcgcacttctgttgcccagatgtggcttttacaaaagcaagatccattttctactggaatcattgaagacttcatcatgaatctagaataacttcagcctcaatacatagagaatgggactgtcagggaatgcatccacacccagaatttatacatccagccaggtatacagtcaggttgtcctcctaggaggccacaggcctgctcccccacagttcccatggccaaaagatggctggaaatggccctctggggctactggcagagccacagcacactcgagaatcactttgacagcagtgattctgtggccttggaaagtagatacaatgtgtctgaaaacatcatgagtcactcctgtccagtcagggacccagggttgggtagggtgacgacaggttacttggagcccaaaatgataagggaggctttcttatagggctcagaaattcactcgagatagttctcaaagaaaagggcctagagtgttttacatcctgtttgcatattcattttttctttatcttgatatttactgtctggaatatccattttttactcttccccatccttgtgccttttctcatattgattattcctcctgaaatgcctcccatccctccccattctttgtatctctgctgatagaaatcttagccagcccctaaggcccagctgagatggcaggtcccttacaccttcgtgtgccctgcaagattggagcacagcgactcattgtggctgagtgaatggatgctggtgctggaatgctacctgcatagtatgaatacattttcccattttaaaaataagcagtattcactctagaaaaatttagaatgttctagaaagga

SEQ ID NO: 251885 - DNA, 390 bp, Homo sapiens
atagaaaagcggagctcgacggtcaaggcgtcagattgcaagtgtccatcaccctgcctgtcccaagggcttgggacaacgtcttaatggttccaccattgtgcaaagaggatgaccactcccagtgcgtgcacgttctctccgctaatgtcactgctcaaaacgttcagaaaattaacacttacgccagggtcggaggcctcaggaggttctgtatccttctcactgacaatctatacaaaagcagctcccaaatcctctgaaaccccgtttctttctcttccctctgcctttctctctgctctttctgggaatgtggcaaggtttgccccctaccccccactggccccatcccaggttggtccaccctccacacacacccctcacccc

SEQ ID NO: 251886 - DNA, 229 bp, Homo sapiens
agagacagggtttcaccatgttagccaggatgatctcgatctcctgacctcatgatccgcccgccttggcctcccagagtgttgggattacaggtgtgagccactgtacccagccgaccctgtctcaaaaaacaaccaccaaaaccatgcaagagctgcattctttgttctgtggtgtggacgtgctgggagagtacagaagcaaagtcagctgtccttgtttgtttat

SEQ ID NO: 251887 - DNA, 672 bp, Homo sapiens
tctagctgtgaggacaagtgatgactgcctagctctttccatgttgaaatagaaacccaaaagtttgtttaaagaattacttgttataaaagtcccccattgttaatgtacaactcaatgatgtaagttgatttatcgaattgtgcagccatcagcagagttctacttcagcatattttgtcacttcccaaattcccttgaacctgtttgtagtcatttcctaatccctggtccccatgactgggtctgaatagaataaacatttggaaagcagatttcattatatttacattttcctgtgtttgggactttatgtagtggactattgtgttcgttttgtgacaaatagagaagagattgcattctagggatggttttcgggggaacataatagtagtcctgtttatggctctccttgaattggttcttctgtgctggtgactggtatttgttaccaaaccttgtctggtgagcacaagaaaaggaattttttaaaatctcctattaaaattgagatgatacattttcacataataatatttggagttaagtagtgaaccgtctttattttattttatctttttttttggagatggagttatttctcttttccttgagctgagatatcgcaccactgcactctagcctgggtgacagagcgagactccatct

SEQ ID NO: 251888 - DNA, 605 bp, Homo sapiens
aaaagcaccggtgctcctctctaggcagcgggtgggcacagcccctcaccacggacacggacagaggaccacctccccatacagagagaggcttccctcccagcctcagtttacccgtaaatgcactagcgcgaggtcagaaatcacaagcctgggcatggcctgggtcgcaccccctccccacggccccacccacagggacctcaacttctgggcccgggattttttccctattcagcagcattttaatcacatgtcctccagctgactgggactcaggctgcgtgcctccgtctgcctgtgtgctggctgtcctagctccctggtaacagcatcctctgctggctctcctgtggtcatcttgtctctgcagctgggagagctgcttgtctgtccgtcacaggcagtgaggatgagagggggtgatgggcgcaaggccccaggggtcctccctcttaacccatgtaggtgccagagaaaccacccccactccatgagaagaggctcagacagcaggctccggggccacgcagcccagaccacacctgccacggtcttccaggaacggtgctcctgcttctgcaacacaaatcggaacaggagcg

SEQ ID NO: 251889 - DNA, 344 bp, Homo sapiens
agaagaagagaaagagaaaatcaagagaaggcaattattgtcatggtgcaattaaaatagaaaacaggaggggtgcagtggttgttacctgtgatcccagcacttggggaggccaagctggatggattgcttgagcccaggagattttgaacagccaggacaacatggcaaaacctgtctctacaacaaaaattagctgggcatggtggcgtgcacctgtagctccagctactcaggaggctgaggcaggagaatcgcttgagcttggaggtggaggctgcagtaagccatgatcatgccactgcactctagcctgggcaacagagtaagaccctgcctcagaa

SEQ ID NO: 251890 - DNA, 358 bp, Homo sapiens
atttatgccgcggaaccacaatctccccttaacagactttgagtataagtgacacatgccatgtggaatgaagtaggaatcagcattaatccacttaagttaaatatttgcaaagcttaaatttattcttcaattaaaaaatgatataaatagaagttagtcatattttctccaatggatcatcttgcacaattgccgggggtaccagaccccattttcagaagccctgccttagagtaagtccagctattcttacaggtgcaaatgatatttattagtctgttctgcagactgaaatgaactctgttttcctatctaaaatgaaaacttgcaatgtagttttttggcattttttttt

SEQ ID NO: 251891 - DNA, 361 bp, Homo sapiens
gctctttcagtggctctcagtgaactacctaaaggctctgaaagttccttttttcagccacagagtataaagaatgaagatttcccttcctcacatagctggaccttgtgatttccaaagaaatcattaaaaagactcaaaacaacccttggaccagagaggaagggtccccaggtggccactccccttctttcttctgccctgggaccctgaacaggccggcccagcctgctttattgcactagaacagacagatgactggaaatctagaagaaaaccacatttcttctaaaactgattgaaaatacacacacataatttctagttttcggggacctcatctcttgatttatacgtctca

SEQ ID NO: 251892 - DNA, 442 bp, Homo sapiens
taaagaccagcttaactgtatttatttttttataaaaagaacaccatataaaactaacaactgaaaatatggacataaaaataaatacaatagttttaagctttttcagttatataaaacatttaaaaattatcaaatatttataacatatcaattacatataacacacataagtatataaatatataactaagtatcttcatttgtggatagtgcacaaattgttaactagtacagaagccagatttactttagcttgtttctgaataattcagtaagtcatgttatttggagtatgatatatggtttagagcaggggtcagcaaactatggcccatgggccaaatcaggcctgccacctgtttttgtaaagttgtaaataaaactaaaaacttgaaaagaatcactgataggatgatttttacctaggatgatttttgac

SEQ ID NO: 251893 - DNA, 299 bp, Homo sapiens
tatttttgtagagatggggtttcaccatcttggccaggctggtcttgaattcctgacctcaggtaatccgcctgcctcggcctcccatagtgctgggattacaggcatgagccactgcgcctggccatccctctgtctttaggttggaacccagaagcaatgcaccctaggaacagaggtaaattaaaataagccagctgtccttgagtcatcccagtccttcacttaaatcaaattctctgtattaccaatgcccctaacctagtccttggccctaagcacatgtaaatcctttttgg

SEQ ID NO: 251894 - DNA, 664 bp, Homo sapiens
agaaagaatcgtgtgcctctcgctttaaatcaaaagctagaaatgattaagctgactgaggaaggcatgtttgaagctgaaacagactgaaagcaagtcctcttgcaccaaaaggccaagttgttaaagcaaaggaaaaattattgaagtaaattaagtgctactctagtaaacacaattgataagaaagcaaaacagccttattgctggtacagagaaagtttgagtcgtttgggtagaagatcaaaccagccacaacattcccttaagcaaaagcctaatccagagggccctaactctcttcaattctatgaagactaagagaggtgagaaagctgcagaagaaaagttggaagctagtagagtttggttcatgaggtttaaggaaaaaagccatcgctataacgtaacaggtcaagaaggaagtgttgatgtagaagctacagcaagttatctgaaagatctagctgactagaacccagacaggactctgactcagcctccacgcagacaacagcaaggccatagagatggtggagccatacaccgaaggaacctgagtcactctgtgactgcccagagaaaagctgtcccattcacctgaactggacaccttggactattatgtggaagggaaataaacttctttgctctttaggctgca

SEQ ID NO: 251895 - DNA, 1178 bp, Homo sapiens
gtaccttttcatgtgctgagtgttattctggagtttgtaatgggtatggagacatatcatataagtaatgctagggatattggttaaagcttttttatggttgagatttagtgtcagatggtattagtgaaaaataaatgggccacatcattttgaaaaaatgaaggaagttcctggggagtaaggtattatttaagtgttttctgtaggtgttcagagttttgttacaacatctaatgtgttaaaatatatttctgaggtgtcagaggatagcagtgatataaaaagtcagacttcttattttcaagaataaggcagtaaatatccatatacatatcttctaattcaacagttattcatgttttcctgtgttcatagatgtttttaggcatggactttttggggggatggcaaactactttaaagtaagtagcaggcttgatgttacttgtcccttaaatatttcaacacatgcctccaaaaacaacatttttaggttaatttcatactgatgaagattcatttcttgaaatcgaagagtccacctcttatgtagcccagcatggaaacatttcattctaagcaaatcatataattcaatgaattgggagtagtcttatactttacaagatcatttgtttccagcagctttcattactgaagtttaaaaattaaaatcatttttctctgttcactttacatgtttttctggtggtgtaaaatgaagtatgtctgccatttcctaagtgagtatccatcagttaatttatggactgttactctggggaaataatgaaaaaaaaatgcagaaaaaaatttatagtgtctaatgtttaaaatctggagttttttaaataccaaaagctgagatgagcctgggcagttgtagtgagacctcgtctctacaaaaaataaaaaaattttaaaaataaatatcaaaagtagtgtcttctatgtgttgtgagaatattttgaatttgtttttgtttccttgattatggaataaccaatattaatgattgaaatttgaagcttgtaagacagtgtttaaaggcttaccacaaaacttgttttctgattttatttgacctttttttctgtaaaaccgtttagaatataaatacctctaagggttcctctttgttgaaacttactatttgattacacttttttttacc

SEQ ID NO: 251896 - DNA, 301 bp, Homo sapiens
atgattatgggattataatcctacataagtgaattccttacacagtgtttggaacaaaataagactatgtttcccaaaaaaagaaaaaagaagaaaagactatatttcctattaccaacctgaccacagatttttgaacaacgtatatttttaaaaattaagattgtaattttaaaacagacaaatcagcatggcattttataaaaatggaaggaatacctctatctaccatgctgtgcctatacctgtaaaagcaagaagaatgtttaatattaaacaaacagaaaaacctgccattacg

SEQ ID NO: 251897 - DNA, 490 bp, Homo sapiens
acatacatttttgaagaccaaatggactaaggaagatcatgtattataacactttggaattattcctgatacatggatgtttcacttagtaacaggcatctacattctttactaatctgtcttctgtttaatagaggtttgattatggagttccatacaaatatctagtttttcattagcaactgcaatattgattgctaatacgtttagcaaatcattccccaacttgtagcagttaaagtggataaagccggccagggcaaagagatcatttaggggtgtctacaacacttcttccagtcagatcttttgttgccaaagatcataatttggacatggcagaaaccaggtgatcagtggctgactgaagggtgttcagaagtagttacaggtattttgcaaaaacactgcctcatagctgatcttacctcatcaactcaaagcaatgttatgcacaatattaaatacatgttaccagttttagcttatt

SEQ ID NO: 251898 - DNA, 698 bp, Homo sapiens
gctttccaaatcccgcaaaccagaacggctagtcacccaaacagcaaaggtggtggcctgcccctctctctgggagctctgtcccgtgaacacttcaaatttctattggccaaggaatgctggtggtggtagctggaggccccatttgggaggtcctgtacagtgatgtgcaacaaggtcgggggcctgcttacagaagcattctggccatgatttggtaaagcagctagctgtgctgtgggatctcttctgccccttgtcggtttatactctccaaagccctcaggctggaatgactaagttgcctgaacaggaaagatggcggcctgccccatctattctctcagagttcatcttgtttgatggagcttaatttttagcctgttaattttactgtctacattagacttgttcggaaagaatctgctatattttaggttagatatatgagaattcattgttttctgtaaataaacctgttcatgtcttgttctctggaaagaaatctctttcaactatctgactttggtcacagtcatatagagcagtagccagtctataatgacataattgaatttccatttccagtgttttgtttttgtgtcttacattgtacagttcagaaatgagcattttattcccaattgtcaaaaagctaagctgtccactgtactgaaatactgtttttgttaatgctt

SEQ ID NO: 251899 - DNA, 481 bp, Homo sapiens
gatagatcgagccggtaccggtcaatgaccatctgccccttgtcggtttatactctccaaagccctcaggctggaatgactaagttgcctgaacaggaaagatggcggcctgccccatctattctctcagagttcatcttgtttgatggagcttaatttttagcctgttaattttactgtctacattagacttgttcggaaagaatctgctatattttaggttagatatatgagaattcattgttttctgtaaataaacctgttcatgtcttgttctctggaaagaaatctctttcaactatctgactttggtcacagtcatatagagcagtagccagtctataatgacataattgaatttccatttccagtgttttgtttttgtgtcttacattgtacagttcagaaatgagcattttattcccaattgtcaaaaagctaagctgtccactgtactgaaatactgtttttgttaatgctt

SEQ ID NO: 251900 - DNA, 373 bp, Homo sapiens
attctaagcccccctcctgcctcacgccacaccccaccccaaccttagggcctacggggatgccaaattccaggggccagaaagagcttgggataaaaagaaacttcaaggggacggctttgacctgggctgagtctgcctgtgccatccaactggagtctcaagtcctgaggcaggacgtccagatgccccagtgcagggtcctcctgatcaacacctgctcccctgtactcattagcaacctcacccaccctactctcaaagcacacttggctctcgtatccaggagctctgcatctgtagattcagcaacagcagatggaaaatattcagaaaataaattggacggttatgtttctattgaacatgtgca

SEQ ID NO: 251901 - DNA, 382 bp, Homo sapiens
ataattatattgttactatcataacacccacatcagcaaaagaaaatacaaccctagggcctacggggatgccaaattccaggggccagaaagagcttgggataaaaagaaacttcaaggggacggctttgacctgggctgagtctgcctgtgccatccaactggagtctcaagtcctgaggcaggacgtccagatgccccagtgcagggtcctcctgatcaacacctgctcccctgtactcattagcaacctcacccaccctactctcaaagcacacttggctctcgtatccaggagctctgcatctgtagattcagcaacagcagatggaaaatattcagaaaataaattggacggttatgtttctattgaacatgtgca

SEQ ID NO: 251902 - DNA, 367 bp, Homo sapiens
  misc_feature (34)..(34): n is a, c, g, or t
atcaaaccccccatcccccccaccacaaaccacnacttcaagggcctacggggatgccaaattccaggggccagaaagagcttgggataaaaagaaacttcaaggggacggctttgacctgggctgagtctgcctgtgccatccaactggagtctcaagtcctgaggcaggacgtccagatgccccagtgcagggtcctcctgatcaacacctgctcccctgtactcattagcaacctcacccaccctactctcaaagcacacttggctctcgtatccaggagctctgcatctgtagattcagcaacagcagatggaaaatattcagaaaataaattggacggttatgtttctattgaacatgtgca

SEQ ID NO: 251903 - DNA, 373 bp, Homo sapiens
ccaccccccccccactcccctcccaccccaatcccaacacccactcagggcctacggggatgccaaattccaggggccagaaagagcttgggataaaaagaaacttcaaggggacggctttgacctgggctgagtctgcctgtgccatccaactggagtctcaagtcctgaggcaggacgtccagatgccccagtgcagggtcctcctgatcaacacctgctcccctgtactcattagcaacctcacccaccctactctcaaagcacacttggctctcgtatccaggagctctgcatctgtagattcagcaacagcagatggaaaatattcagaaaataaattggacggttatgtttctattgaacatgtgca

SEQ ID NO: 251904 - DNA, 262 bp, Homo sapiens
ttatctaaaacctggttcatctgtccttccacacagggcctacggggatgccaaattccaggggccagaaagagcttgggataaaaagaaacttcaaggggacggctttgacctgggctgagtctgcctgtgccatccaactggagtctcaagtcctgaggcaggacgtccagatgccccagtgcagggtcctcctgatcaacacctgctcccctgtactcattagcaacctcacccaccctactctcaaagcacacttggc

SEQ ID NO: 251905 - DNA, 333 bp, Homo sapiens
ccccaaacactaaggatttagctaaagaaagcacacgcctagctgagcatggtagctcaaacctgtaatcttagtgctttgggaaactgaggcagtagtatcactcgagggcaggagtttgagaccaacctgggcaatatagtgagaccctgtttctacaaaaagaaaaaaaaggctaacatttgccaggcatggtgccatatgcctgtagtactagctactcaggaggttgaagtgggaaaatcctttgagcccaggaattccaggctgcagtgagccaggtttgtatcactgcactccagactgggtgatagagcaagaccctgtcttaaa

SEQ ID NO: 251906 - DNA, 609 bp, Homo sapiens
tctaatcaaatggcaaatgacagcaggctttaatgagactggagtgatttcatgaagacctggagcacattatattataatctactttacaaataaggctggttgattaatttggtgtggtcatagtacttaagataggagcccttagttttggaagcaattggtttcagaaaagccatcgcggtgggtctgcaacagtagaaggtcgaagtgacacccagagatgaaatgttactattgtcaaggtgtattgctgatttgctgtgtgttatacattaagaaatataagctcactgaaccctagctcctcatggacaaacccatcagggacagtcctcaaaagtgtatttctgagttggtacagtattcatattcatttatgatttcatttttgtttcatagaccaccaataaatttgggaaataacgcatctacatatcccttcttggacagtcacaatgtatatggcacattgatgactttgagaagtcctgcactaaaggttattcacctcgtttgaccactaatacttcttattcataaaaaaacttatttgtcaataaagatagtctcagcaaagctgatgtattaaaaaacttctaagcttca

SEQ ID NO: 251907 - DNA, 460 bp, Homo sapiens
tactttttctctccacatttagatttgatctatctactttaattgctaatagtgtcttagtcatagaatagattagttagaaaaaagtgtttttgacattataaatgattctttcaatttgtgtctaaaagtggaaaatactagaaagcttaacatttattattgtattcagaccagtatttcctccagatgacctttattacaacaaagataatttaatgaagatctctctaatggtaaagctgatggctttgtgctattacaatatccttcaaataaagtgacgatctggtggaaagaacaactaaagcaaggattaggaagaaaacagttaataccttcattttggtctcactctgcattaagagttttcattgtgttaaggatttattatacattaagtaatttaatgttcatttaataataaatggatcctattaaatatgatttttaaaattat

SEQ ID NO: 251908 - DNA, 565 bp, Homo sapiens
cacatacacaccacagatatatgtatatagaactgggatcaaactacctatacagttttgtatcctgctttttttacttgaaatccagtgagaatattactttgtcattaaaatttctttgaaaatgtggtttttaaatggctatatagtatccattgcatggacttaccatacattaaatattttttaaaaatccacttgttgcctacatcattttcaacattaagaggggaggaatttcccaacaacacatagtacactttcctcactgtgtcttaaaagctactgagattaatttgacacgtaatacagtaaaggccacatctctgtctgaccagccagctttgggtggttgaagaagtgctggaatgcaccctaacagccaacaaactgcatgggaaactgagggcattgtacacctctctattttgaagtccctatgtgccctgtaatgtctcgttttaagaagacaaaacagttataagtgggttccttaaaagtcatatttttgaagtaccaaattataaatctgaagtagttttatagcatgtaacattttagcaaa

SEQ ID NO: 251909 - DNA, 374 bp, Homo sapiens
gacttaacttgaaataattgaagaaagatttggtttgtgaaagaattggagtaatacagacttctcaatttttaaaaatattatagtacatgctagctgatttctccaggatctttcgggactttgagtcttaattgtacccattttttgcttcaagaaataaatgttttggctgggcacaatggctcatgcctgtaatcccaacacttccggaggccaggatgggaggattacttggagtcagaagttcaggaccagccagagcaacaaagtgagaccctgtctctacacttccggaggccaggatgggaggattacttggagtcagaagttcaggaccagccagagcaacaaagtgagaccctgtctctaca

SEQ ID NO: 251910 - DNA, 327 bp, Homo sapiens
aaaagactttttaattgctaatggagcatatggtgcataatggttaatgatatgcagtttccggagctttctgcctgggttctagtgccagtcccaccactgaacctgctgttgaccttgtgcaagttacttcacccctgggtgagtcagtgtcttcattataggagagaaaaacggaaaaggtcccacctcatagggttatgaggcttaaatgagcttagcatttgcctggcgtgtacaaaacgacgtatgtttttgttaaataaaataagttcttcggttttattctgcaattcacacttaatagtatatcattattaaattaaa

SEQ ID NO: 251911 - DNA, 633 bp, Homo sapiens
  misc_feature (613)..(613): n is a, c, g, or t
attcctaaggagatgtccataagcagcagggcccaaacgtggctgaatatcagggtaacctgcagatcctgtcccaaaccaacacaaacatctggattcaggaggcccacggtggggcccccaaatctgtatttgaaacaaggaaccactctcctggagcacggagtgtcccctgaatgtgttatgaccgagaacttacggtgactatctagactgttagtgttccagaccataagactgctgtgatttatgaagcaattagcatatattctgtctggagcctcccctgggtggctcacacgtcacttgtgtcttcctagtgtttgcaacaactgtgacaatgtcactgagttgagccactgcaggcttaacactctggaagtttaatttgcccaagcttctattttctggctaagaaccagcattttcttagatggttcactttcccttcacctgtatttccctgtctgactagaggctttcagggactctttttcctgaataaatcaagtttctaccatgctttgagtgggtactgtgcatgtgacgtggcgaggacatgggcggctagctgttcccactcacttactcagcaactcaccccacaaccaanctaacaggaccccttttttt

SEQ ID NO: 251912 - DNA, 645 bp, Homo sapiens
tcttaggcgtttcagaccacactgttcgtgatatttcgtgtgttttagctacaaacacttatctaagatgctgtcttcgcagtgccatgcctacaatggcaagcgtgaagctgtctacacttcatcccattgtgaatcatccacattacgaagatgcagacttgaggcctggttgcagtatgcttgaaatctgggatgtggaagacccttccaatgcagctaaccctcccttacgtagcatcctgctcgaagatgccaggctcgaagatgccagtatttcagaatagtgtgtacagagtattgaaggttaactgagaaggaaactacccattacactatggcacaatgccgtgtgtcaaaaacaatcaccctttggcttatttacattaataaaaatcacaagctttaataacagacacttaaaaataagataaaaatggattgaaagtttttctgattactaaaaggtaaattacttttctgttcattgaatgtcagccttattaagcttgtcatataaattattcaatcatgtcatactgcataaacaaatgttcatttcagagttttaaagagaaatgtatataaaagaacaatgaattttaataaatcaagggtacgtaagtcccttttcatccacctagg

SEQ ID NO: 251913 - DNA, 254 bp, Homo sapiens
attggatcagaacatttcccatcagcaagcaattgcattattacaacaaaccactggatctttgagactgattgtggccagggaaccagtccacacaaaaagcagtacttctagcagcctaaatgatacaactctgcctgaaacagtttgttggggccatgttgaagaggttgagctcattaatgatggctctggactaggttttggaatagttggaggaaaaacaagtggcgtggttgtgaggactatagttc

SEQ ID NO: 251914 - DNA, 477 bp, Homo sapiens
ttaattattgaattttttattatggcagcacgattctatatgatagtttacgaatctgtagttttcgtaggctcccctcccctttatcatgtgagctaagatcttcctgttttcctcctttttaaattctggggagagtaggttggtgggagagggtaagaccgtttgcttatggcgccacctgcaggcctctctgaaaatgaatttcaatacctattcaatcttccgcagggttctagattcctcaggcttattttagcaatttagtgaaattaatttttgttttaacagagaaagatgttaacaatttcaacgcaaatcccggagtttgaaaaggattttgatgttctcaaactacacttaaatcctagaaatgagatgcagtattgaccataattgaaatacaggggtttctgcatatcccatctggacataacaaatttgactaagcagtaatttatccttaaaataatggaa

SEQ ID NO: 251915 - DNA, 487 bp, Homo sapiens
gaatctacattcacatttggtttccaaaaaattggctaaatagggggtaactattaggaattctgattatgcttaaaacagttttcggtgcttttctgttggtacaagacaagacaatatttttggaagaagtctcctcatctggttttcatttgaaatatgtcttacagaggcagctcaagaaagcatttgcccatttttggtaaatatgacgtgtttcaaactgtgacagccattatttggtagcaaagaagttagaattaagtgtcatgtcagctgaaatccaacttagtaattaaatggataaaaagacaccaaaacatccacactctcaaacactgctgcatacttctcatgtaaccaaaagcccctattcattgtcttctctcctctttttttatttgtttaaaaagcctcagtaagggcaatttaaaaaaaaattagcactttggagaataaattgtttatcaaatgaaagctggtttta

SEQ ID NO: 251916 - DNA, 426 bp, Homo sapiens
gaaggaagaagaaaacagcttccccgtacagagacagaaggcagggggattcgaacaaagagaaaaactccaagtgtgatagaaaagtggctgcttatatgaggaggctggaggacgtttgtgtctgatttggatagggctcaggggattggtttgaccaagcatgtcattcacgtagcctgagaaaaaactggccctcccaccctagccttttaatatgcaaatgcagggcaccatgatattttacacatgtgtggatatgtgggggtggccgtgttgccaggcacatgtggaggccagggcaagaataagactgcaggaattgccatgtttgggtgggcccagtttctaatggccggtatttgcatatcaaagcttgctggcctagctttcctgctagacaagaaatgtttctggagttgctct

SEQ ID NO: 251917 - DNA, 569 bp, Homo sapiens
cttatatattttcattttctatagtacttttcatccctgtatgtatgtacaggagtcacttcacccaccaccgaattgcagccacttctgaggtggaacgcagcaactgtttaacagcgcactttcccctaggtgctgacagctgcagaagaaattgtacatggtgctgtacagaaggtatttctccactgtgccatctgcagagtgaaactgactaggagtactacatagactgtaagtttcttgtgtacctgccctagactggaaagcccaataagagaaaataacaaataactgggaaacatcatctaaaagtgtattgaggtcagttaaacttagtgctgctctccctggctctaaattttattttaaggtcttctgattggtacaaaattaaataacaaatagatggatgcactcctttttattctaaaagcaaatgaaactaaaatgcttttatcaatattcttcactttgaatggaacttaatcatattgtttttaaatatttttaagtaaccaaatcaatattataagatttcagagccatgttcttaaaatagcaaaaaa

SEQ ID NO: 251918 - DNA, 458 bp, Homo sapiens
actaaaatgttcaacaaaaattttgttacattttcaagagaaatcaatgtctactttagcaaataagatccagggagaagggggcaagggcgtaagtattgagtattgtactcaatttaaatagtgcatgtgcaaaaagcctatcgagattaaggcattttaggccgggcacgatggctcatgcctgtaatcccagcaatttgggagaccgaggtgggcggatcatttgaggtcaggcgttcgagaccagcttggccaacatggtgaaaccccgtctctacaaaaaatataaaaatcagccgggcatggtggcgggcacctgtaatcccagctactcaggaggctgaggcaggagaatcgcttgaatctaggaggcagaggttgcaatgagtcaagatcgcgccactgcacttagcgtgggcgacagagcgagactccgtctcaaaacaaaaaaaaaa

SEQ ID NO: 251919 - DNA, 433 bp, Homo sapiens
ctatatatatgaggatggttttctcttgatgttgcaatctttattttaacatgtttttgtgtttagcttctggagttgcctaacagtataatttcaaatgaggtttagtttcagctgtttaattttaaactgtagggaacatgattaaaaaaaaattaaggcattatcatttgccttagaattttaatggtttgtatagaaagagttttcctgtgacaacctaaaacaaaaatgagcctaacctaattcttgatattatttgttttaccataaaattcttacattagaacatgtaactctgtcagagaatttcaacatagttgcataaattgtgtttcatattacaacttgttctctgcttgacttcattgaaagtaataaaatgactctttcagaaggatctggtgagttaacatcattatttaaaaaaaaa

SEQ ID NO: 251920 - DNA, 458 bp, Homo sapiens
catgaatgtgaccgctgcaggtacagccagactcaagtatgttgcattggtgctgcaatcagtctctaagaaaatggaatgaaaagagcaagaagtcggatcaaaaatacaagccaataacgactttacaagataaaacaagtaattttcaaaattgttggactgaaatgataataatatatacataaacaactctagatatggtctctcttccttttgtccctaaatgctacttttaaattttcttttctgagacccaacctgggcaagacagcaagactccatctctacaaaatgtaaaaatattagctgggcgcagtggcacatacacctgtagtcccagctactagggaggacgaggcgtaaggataccttgacaccaaaagttggaggccaccatgagctatgactggccactgcactccagcctagatgacaaaacaagaccttatctctcc

SEQ ID NO: 251921 - DNA, 281 bp, Homo sapiens
tagtacagatggggttttgtcacgttgttcaggctggtcttgaactcttgacctcaggtgatccacccaccttagcctcccaaagtcccaggaccacagacatgagccactgtgcctggactaaaatttttatgagacaaaatatcaatttcaaaacagcatcaaaaagtgagtaggccaggcacggtgctcatgcctgcaatcccagcactttgggaggccgaggtgtatttttctgtactaaaaatacaaaagtatttgtctctattataaatacaaaa

SEQ ID NO: 251922 - DNA, 562 bp, Homo sapiens
accaagaattggagaggatgtgaatcagccatatcagacagttagttggtgggaatgtacattggtgccgccattttatgagacagtttggcatgatcttaatagttaaccatttgtatgttcatctgccaagcacgtccacctctaggttcaggagaaacttgaaaatatatgctaggagaaatgtacaaaaagttcatagcagcattatttgataaagcagaaacctggaaatgattcagatgcccatggacaagggaatggataaagcacattctcaagtgaatattatatggctacaaaatgattgaacaacatctatattcaaaaattctgctacataaaattgagtgaaataattaagttccaaaaggtcaaatatgcttaatattcaaagagcaacttaaactaagctacatactcttcagaaaaatatctatatctgtgtgcatatctattatttgcatgtgggaggtggaggatgggatggagggaagatcacatagctgtataaaaatgtcagttttctagttcctatattgggttcacagtgtttattatt

SEQ ID NO: 251923 - DNA, 692 bp, Homo sapiens
ctcccacagtttctgtgatctatctaatggtaaatgtgaggtagctctgatgaatacttaacacatatgatttataccctctgattaatcttaatatcttctaattagcaaccctctaattgataccatttctgcctaatctagctagagtatattctgtttactgcagtaacacaatcctataagcaatgtgtagctacagggagttcctatgtatggaaaacacaaatgaaaatattattataagtgcagggattctttataaaaattcaaataaatctacatatcagttttactgaaatgaaaaaatgcacttaaatctgttgctataaattggattacataagaaacatacaggagcattctggtacctccccagccacgtatagtgaccacaaatacccgacaggatcattagaagaaattacttaattcaacaagtaataaataattactgaattgtgtgcatgtatatgtgtggtggtgacgataatggcagaaatggagatacatgcatggcactgtttgtaacgggaaatttggaaataatctaaatatatgttaggcttttgtccaggttctatgatggaataatgatggtgctaacgataatgaaaatagtgctacagctgttaatgtgtttattcagtgattagttatgtgccaggaatcaatgctaagcattttatgtt

SEQ ID NO: 251924 - DNA, 437 bp, Homo sapiens
ttttttaaatgattgcccaacttattttgttatttacttatttatttaggatgtaagcaacaaacatttattttgcgcagttttggaggctgggcaccagcagactggtgtctggtgagagtatcctcctggtttgcagatggccatcttctcaccacatcctcacacagcctccgtgaagcctatttgctccttctggaagcttcccaggggtctgatgagaaaatcactagcatgtgtgctatcgtcatcttctcttcctctacctttttgagcaattcaacaaattccttgaaggattcagtgatgttaatatcatcatcaagtcagagtatctccaatgaaatcaaactgaaatgaccgcagcatctgggaacatttctgacctgcagaagagtaatgctcaccagctcattataaaggatattacaaaggat

SEQ ID NO: 251925 - DNA, 620 bp, Homo sapiens
ccgcctccgcgcctgccaagcctgcaggccagagccgggctcggggtggcatcggtggtccttctccctgttccccttccaggtttgcataggggctggaggacaggtcagccagccttctctgcccgcctccatcctgccctgccgtcttctgactttgaggcctcgtatcccagtccaagaccatttcaaacggtagaactggtgccagacacttggaggaggcagggcaaagactcgccagtccgtataaacccttttggagaagccaagatgggatgagctccgcagcacgttcccgccagactgctgcaggcagagttccgcggaaaactgaaccccgggagtcctcaggggcccatctaccccggtgcaccgccccctcctttcactgcggggactcggagctgtgggactggagcgcgcaccggcagacttgcgcgcaggttggagttggcgcacacccgcgccagccggggagcggcgtttacgcactggtaccgcgagcgctcaaagcatctctcgggaagtgctttaaggctgggaaatttactatacacttatgccggcggagcctgggattttagcgtatataggaaccgcacattgctttgccaggt

SEQ ID NO: 251926 - DNA, 420 bp, Homo sapiens
gtttccaggaccaacagtgtcagcttcccctgggagaagcttgtgaaaaatgcacattctcaggccccaccccatacccagtgaatcaggaactctggaggtgggccccaggatctgagtttcccaagccctccaggtgagcctggttctagatacacagctgtagaggaaccacgatagctcctgcagaaaacagattgggtggggattccactgtggggcgtttctttaatctctttcacattctacactctttagcagagtttctatatgggaatgcattaggaacatgtgaggcagtgatctggctgataaggggcactaggggatttttttttgaagttgctatacagaaaagcacatggttattacttaaatgatatgttgtagatcaataaaaaatgataaaatgttgtaaat

SEQ ID NO: 251927 - DNA, 353 bp, Homo sapiens
gtgtgagctgaggttcactgttttgcattaggacactcaattgttccagcactacatgttcagaaaatattaccccttacctacctgattactttccacgtctgtcaaatgtcaattgacgatacacgtttagatttgtttctgaaaccttttttctgttccattgatttatgtgtctgttcttttgtcaatatcatactgtctttgtttctattactttgtaaattacgaaagcagcttccctgatttccaaatttggccatttttttttccttcaaaattgtttggctattctagttctttgctttttcatataattttaaaattaccttgcttatttctacaaaaaaaaa

SEQ ID NO: 251928 - DNA, 405 bp, Homo sapiens
gacaggttgggaaccagtcccaagtagccgattggggtataaacaggcatgagggattttattggtagaatgaagctgttctaaaattgatttatggtcatggttataccactcagtagagttacaaacaaaccttcatttgtacacttaaactggatgaattgatatgtcaaataggctcaccttaataaagcttttatttttaaaaaaagaaaggataaaatcaaatatattttcaacttaaactagaaaatgagaaaataaacctaaagttaattgaagaatggcaaaaataaagatgagagtacaatcagtgaaataggaaacaaactaatagtgaagcataacaaagccaaaagctttaataaaattgaaaaatgcctagaaagactgataaaagaaaaa

SEQ ID NO: 251929 - DNA, 432 bp, Homo sapiens
tccccctccccctccccagaagtgggggccgagttgcccactccccttcctagcagcgggttatttccagcacggagcagctgcccaagttacctgggagatgggaaaatcgtgtgaaagctggttaaccctttgaggattagagtaatggtggaagcagaaaggagaaggagtttcactccaggatgtacgtaggaccagccctccctgcagtcctgtccttcaagactcaagtcttgtccactccaaatcaccactgggattcctaagtccaggacagagcttcaggcaaggaaaagaagagttgggaaagccagtttccaacatttatcagccacgtgtacctgcaaactatataccttgggtaaatcatcaatctcttgaaatgggaataaaaccatctgccttgtctttcttacagggttttcagaa

SEQ ID NO: 251930 - DNA, 486 bp, Homo sapiens
ctgccccaccccagcccccacctagccattcccgccctgcctgtcacggccctgcgccctcccgcgggaactcagtttaataattaattaagctctcattccacaaggcgccagttatttccagcacggagcagctgcccaagttacctgggagatgggaaaatcgtgtgaaagctggttaaccctttgaggattagagtaatggtggaagcagaaaggagaaggagtttcactccaggatgtacgtaggaccagccctccctgcagtcctgtccttcaagactcaagtcttgtccactccaaatcaccactgggattcctaagtccaggacagagcttcaggcaaggaaaagaagagttgggaaagccagtttccaacatttatcagccacgtgtacctgcaaactatataccttgggtaaatcatcaatctcttgaaatgggaataaaaccatctgccttgtctttcttacagggttttcagaa

SEQ ID NO: 251931 - DNA, 495 bp, Homo sapiens
cagcaggaaagaaagtccaaagctaaacagcaccatacatgtttttgaaacaggtagacagctaatggcccacatagttcatgttaataatcaaatgctggctaccctgtggattgctactgtgtgctaatgaggagaaccttgctttctctcaggcaagcggctatcagggaagcttctaatacttctaaaaactggtggatacacagagagtgaacgcaatggttactacctgtcattagctacagatgcacatgtaagtcatagaaaatctaattggttgactaagaataggatttatttattttatcccaataaatctctttttgcagcaaagttaaaggttaaaagtatttgaagtgttgaaatgcttctcctattcaccaccagtagatatttccagactcattgcttttctcccccaggattattttgttgttgctgttttctccttcctaaaggaagagagcaaatcattttctttggatatcaaac

SEQ ID NO: 251932 - DNA, 337 bp, Homo sapiens
atctgaagaactttttaaggtccaaaaggaattgagaaagacttggaaaacaggacctttgaagaaagcttacaggagacagaattcgagcttagaaaacaatgcatgtgatcgaaaagaaatgtgaatagcaaagatagaataagaggaaattaatataaatggtagaggaggctagttttgaggctaagggtaaactttctgactgaaacttgttaaacccaaaaatgaacagccaggccaggcacggtggctcacgcctataatcccagcactttgggaggctgaggcgggcagatcacttgaggtcaggggttcaagaccagcctggccaaca

SEQ ID NO: 251933 - DNA, 232 bp, Homo sapiens
cattagctgccattactataagttactgtctcatgggatccatacagcaacctaaggaggtaggtcgaggcatacctcaaagacattgcaggttcagttccagaccaacacaagaaagcaagtcacatgaatgtttttggtttcccaatgcatataaaagttatgtttacactatactgtagaccagcaagagtgcaatagcattgtctaataaaacaatatacatacctaa

SEQ ID NO: 251934 - DNA, 479 bp, Homo sapiens
aggaatgctggcagccaccagaagctggaagaggcaagggaatgatagattctccccctatagcccccagaatgggtacagccctgctgacaccctggctttggcctagtgaaactgatttctaacttctggcctccggaactgtgagggaatccactgaagttgtgctgatttgttacagcggccaccggaaatgaatccatgccgagtccaaggacacgtgcccaggagctggatttagtatgtctatgttcttgataggcagagtggctgtgataccagcgatctatggaccacgctgccccaactgctcaggcaggggactcgaagcaaaggactcaaacccttgaacgggggtttgtagtctgggctccatggaatccatagttgaatttcagtgggtaggggctggttcataattttttttaaattgtatgaggaactatgtgtggtgtgcacatatattcatatttttcaag

SEQ ID NO: 251935 - DNA, 276 bp, Homo sapiens
cagagtgaaaaccagaacgcttggcacctatcagttagcacaggatccttccctggaacatcagcatcccttataagtgtgtctaacggccaactcgtagacagagctattgttaatacactgttctgagtatccctttgtgaacaccttcatctggttgatacaggaaaattaaggaagacaaagttttgggaaagtgattgaaatcgtggaataatcaaagcaaatcaatggcagcttgtgtttaaaattaaaaaccaactgtcaagcatggca

SEQ ID NO: 251936 - DNA, 371 bp, Homo sapiens
agagcctctttactaagcagagatgaacacaggggttagagagacatgggtagattttaaggaggaaggaacttggactttttcgtcagtgatctgagattcttccctccacagctgagtgctaatgctgtattgagagttataccattgggcctggactgtagaagcagcagagccaaggttctcaagaaagacagcaaaggtctggcagatgttgtaactatgccttcttcccatgtgcatggcagacattgccaattggtcatggcttggctccccactgagcaggaacttggtctcagaatcctttccaggacagcaccctaggcagctactgttgattatttaaaattgatgcaagacttgaaaaa

SEQ ID NO: 251937 - DNA, 303 bp, Homo sapiens
agtgatctcatcccattgtacataattttttaatagaactaaatgtaggtctttcaaaaatatatatacaaagaaaaaaatctttatttaatatgtgatacattttaggagcgggaaatagattatattcaagttatttgaaatttgaaaacaaagctgttattttatgaattaagtacaagttaatcactaacttgtccatttccatgatacatgcagattcatcagttttctggtcaagacctgagtctcagcctggaggacattatgttaagcaaaataaatcaggtctggaaagataaa

SEQ ID NO: 251938 - DNA, 417 bp, Homo sapiens
cagctttatttttatttctctcactagaacttgaaagctgctatttggcactttatctcagagcaagaagagaaagagcaggctgtctctttgagaagacccttgtccttcgtgctaaagttagcatgtgctgcctcttcctgtctggatataagactaagctttatttcaaaactgaaccctctagcagctgcataccagtttaccttaatatccttagtacttggtgtcttaacatcctcatactaccttgctcctttggcctcaaagtaagcatattggctggcttatatttcttaacaaaattagcagtacacaaattgaagaattttcatctttgattacaaaagtctgcgcatgtgcttgtactctgagatggtaatagattcttctgataaagttattgctgcctttcca

SEQ ID NO: 251939 - DNA, 798 bp, Homo sapiens
tgtattttgggattccgtatatttcattaaaaaatattttgttgctcttttaaccatttgatttaaaaagtgatttacataggcaaattgaatttattgtacaaccatgtggattggtgttactatagatttgtgtgactcagtctttattgggctctcacagcccctccatcagtttgatcttggtcattaccctttttattttcctcgtcagctattccaaattcttggcagtctcaagacctttacctcacatttctgtgttatctagggataggctaactgcatttaaaacagtaacattatttcagtggctcaacgtaataagagtttatttctcattcacattacagttcattgagaagggagtctctgctccacacagtcattcagggaaccagactccttccttcttgtggtttcacctccttcaggctctggaatcctctaggtgaagttgagggcagggtggtgagtgtgagcaaagtgagggtgtgcctgcgcaacacttgtgcctgcatcctgtcagcaagcatgagtcacgtggcctcatagatcataggacaattgacattaagagcatagtgcatgtttaaaaaacagctgtataggacgtgactttagaagtattttgctgacatttaaaaggctgggtgtggtggctcatgcctgtaatcccagcactttgggaggccaaggcaggtggatcacctgggctcaggagtttgggcaacatggcaaaaccctgtctctactaaaaatacaaaaaattaaataggcatggtggcgcatacctgt

SEQ ID NO: 251940 - DNA, 505 bp, Homo sapiens
ttttcaagtgtatacagtacagtcatcaagataaactatgtttggctatttaaaaaacctcagtcaattgaaaaggatccaaatcaaagtacattgtaaagagttacagaacattactgagggattttaaaagagatttaaataaatggagagacatgccatgttcatggaattgaagactcggtattgttaagctgcaaccctccctacattggcatctaaatgtatatcaaagattgcacctatcaaaattctagcaggattacgtagaatttgacaagctgatcctaaaattactatagaacatagaaggacccagcatagccaagacaatttggaaaaagaaaaagttggaggactcacacttcccaatttcaaaatttactacaaagctacagctatcaagactgtgctgctagcataaacagagatgaatagatgagagaataaaatttagactccagaaataaactcttatgtttatggttatttaaatttcaataaa

SEQ ID NO: 251941 - DNA, 422 bp, Homo sapiens
tatgtctgcagcttaatttttcaggctgctcttttttaggaaataaatgatttggaggctgctttttattaaaagggaaaccttaccaatgaatctcttaccatcactaactacctaaataatttctttttagctcccatatcataaccatgtattctttttgttcagcttttttcattcagcataatggttatgaaaggcatccaggttgttccccatatcagtaatttgttcttttttattccagagtagcatcttgtatgagaatacttcaaatttttatccatccttttgctgatggacttttggattgtttctagttttagactactacaaaaaaaggtgctacacacattcttgtccacatctttttgttgccatttattttcatttctattggataaaaatctaaaagtggagtt

SEQ ID NO: 251942 - DNA, 761 bp, Homo sapiens
ggaatttgaaattatagtgttacatgtatacctatcaaattaaaattaaggaaatacaatagcaatatatagaatgaatgtagtaacagaaattaactctttactgcatcattgaacttattgttagttacaggtttaaaagaagttcatttaacatccagtgtgtctaattcttctggaagtggtgtagtaccattgttcttctggcatttttaaatattaaacctttttggatagatggaagccttatacaaaatctactttattttagcaaggattctctgtccttttgtatagttggtaccttactaatttaaactctaatatcaatctaaagagaaatttattatgcaatttgtatttaggtttttttttttttttaagttttagttcaaaataacattaattttgagagattgaggtaaagaaccttaactaatgctaaggagtttattttgattaacataggttattctgaccaccacctcttccttccttaatctccttagaatctgacagtctcaaagctgtcacacaaattagactaattttgacactttgaaatgaaaacttcaaggaagaagtagccacggacagttatgtttataatcagtaggtggcactctttcctcaggtagccccccattttcacatgatgtgtttgaaggttaaatgccaccaaaagtgctgagtcagctataaaactaagtccctgaattccatggcccttttaaatatgtaatcattcaagattgaaaaaa

SEQ ID NO: 251943 - DNA, 400 bp, Homo sapiens
tgaggagcagtatatagtattcctacagtgtgaatgtatcaccccatagattatgagttacaaattgataattatagattattactttattgtagagggaaaaacatgcatttataatgcagagagaatttggcatcaatagtagtgggatggcatgaaaattatatgtctcttacggaaggtagtgggtggtatacaatgccaacaaagttgtattcttgccaaaaatgtttaacctgaacctactcttgagaaaatgaatgaatcctgaaatgtgggatgttctgcaggacatctggcttggatcatcaaagtcatgaagaatagggagaggtaaagggactctcctacattgagagataatgaaaatcaaacataagaactttggttcttggagtga

SEQ ID NO: 251944 - DNA, 1130 bp, Homo sapiens
aggctgctctcacactcctggaatccagagatcctcctgcctcggccttccaaagtgctggaactacaggcatgagccaccacacctggccctttcctactttccatgtttaaatattcaagaatcaattgctttttttcatggcagcctgtatgtgttcagtaggcataataccttaacaaatttgaagatactaatacttactttaaagctttcttttgtcttacattagctccactgcttcagtgcctagttctgtatttgtttggtctgaagcttctcttagatgctaccgatttcccacaagtgtttagtgatttttgttgtgtgttcacattataaatgtgctagtagtatctcagtccatatgaaaatcactgtactccttctgtgaattcacatttgtaactagccctataattcaattttacacttatacccagtgcttgtgtagcatgacaataacaatgtaagttctttgacttgcagtcccgtgattcttcaatccactttcagtcatatccttttggtatttcatttcctctaaaaaaccactaacttgagtaatacagttcttaagtaaatgttatgctaaacttcagagtcagatcctcaccagctctaacagacttgtctaacagttaaacaaacaatgacagtccgacagaagacagtcataaatgtgcaattcaaagggtaaataataacatggtaatgaatgaatcacttacgtcttgaactcataatagttatgcttttttaaaaccaaccttgaatgttatattagttaaaataacaaattctattacattaaaaaaaagatgactccatgttggttaaattttctgcctttggttggtaatggtatggttggtaatgactccatgttggtaattttctgcttatgccatgactcagtcattctatagctgacagaaatgcatacagatgctcaccaagacatttaatttacaagaatgtccacagtactcttttttttttcttttctttttgagaccgagtcaggctctgtcgtccaggctggagtgcagtggcacgatctcggctcactgcaacctccacctcccgcctcagcctcccaagtagctgggcttacaggcgcccgccac

SEQ ID NO: 251945 - DNA, 606 bp, Homo sapiens
gagcccagacccggcctctccacaggtacagcagcccagcgagcacggaggaagatttccaagccgacagatgcgcgaactgaaaaaggaggtcacgacgctgagagaatagatttaaccctctgctcgctgggaacccagaagactaagggggaacatgtttttcaatgatgcaggcgtcggtggcgggaaggcctgcgaagtcttgccagggctccctgcagtcctcagattccgcctgacttctgcagacagcccagctccctcgccaggaagaaatcgctccgcggctgcacgcaacaccttcaccgtctgaaacctgcgattctccgcatttggtttcctcccgaggctcctgcacaccgcaccgtgattgacgcacccgaggggaccgtcaaaaatacatctcaagcctaactttccaacactcccgcgacgcaaccccttcccctttcctcagcggctctggcccgcccctcgctcctcgggccgcgtcccggctggcgactcggcgtgcacacgaggctcctccgcgggagagcccgcgccccggcccggggcctgtcgggggttgcagacaaagaggctgcagcgccgccgcggccg

SEQ ID NO: 251946 - DNA, 418 bp, Homo sapiens
aatcagatacggaagacctcttatgctcagcaccaacaggtccgccaaatccggaagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagctaccttccggtaccgagctcgattcgatt

SEQ ID NO: 251947 - DNA, 653 bp, Homo sapiens
ccattttttcttcagctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctattcacagattctactctgctactcagtagtggtcactatgattctgtgtactcaaacaatttcagtcagtgcagctgtttgtcagctgtatgtacgaatctcat

SEQ ID NO: 251948 - DNA, 645 bp, Homo sapiens
ccattttttcttcagctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagtaggaatatgataatttgttgaattactgaaatctttggttcctggttccatttcgtaatattaaattgagaattaccaggatgctagtaagagaaccagaattgtatctactgt

SEQ ID NO: 251949 - DNA, 588 bp, Homo sapiens
ccattttttcttcagctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaaggtttgcttggaatcagaaggaagatattataatgctcatatccaggaagttggaaatgagaacaattcagtaacagtcttcattgaagaattggcggaaaagcatgttgttccactggctattcacagattctactctgctactcagtagtggtcactatgattctgtgtactcaaacaatttcagtcagtgcagctgtttgtcagctgtatgtacgaatctcat

SEQ ID NO: 251950 - DNA, 501 bp, Homo sapiens
ccaccttggcctcccaatgttgggattacaggcatgagccaccacacccagccgaaaaaaaaaatgtttctttaatgtctgtgttaaattttaattacaaatttagtgattagatgtaaggttctttcagtatgtgctgtctccattgatccagactggcagtgttgatacgaattactttaaaaagtagacactgaactccatttggggaaaagtggtattttgtttggcattagctgtatctgtcactagtcttgagactagaagtattctcttttcaggtttgcttggaatcagaaggaagatattataatgctcatatccaggaagttggaaatgagaacaattcagtaacagtcttcattgaagaattggcggaaaagtaggaatatgataatttgttgaattactgaaatctttggttcctggttccatttcgtaatattaaattgagaattaccaggatgctagtaagagaaccagaattgtatctactgttgg

SEQ ID NO: 251951 - DNA, 534 bp, Homo sapiens
caagaaaatctacaagcaaactgaaatatgtaataaaagagttcactactgaaatggtagataaaaaactaacaatgatggttactagtcagggcagtcattggggaacagggtgtatagggagacgggtggaagcaaaactcattgtatgctttattatatccttttgacttttgaataatataaatttagtcaatgaagattaacgcaaagaagtggatggacaaagttgctggataaaaatcaatataaaaatcaatgtcatcaaaatcaggaacaatcaatttgaaagtctgatttttaaaatcccattcaagacctgtgtggggaaaatcataaaactttattgtaaaagaaaatctaatagaaagatataccatgtccatgggcaggaagttctgatgacataaagatgaaagttttccctaagttaatatctaagtttaaggcaattccaataaaaataataacataatattttcaaggaacttgatgagataaatcctaaaattcacttggttgaataaagaccaa

SEQ ID NO: 251952 - DNA, 461 bp, Homo sapiens
ttcaatgtcgcagaggggaacgaggtgcttctacttgtccacaatctgccccagcatctttttggctacagctggtataaaggtgaaagagtggatggcaaccgtcaaattataggatatgtaataggaactcaacatgctccaccaccacgcccagctaatttttttggtttattagtagagtcagggtttcaccatgttggccaggctagtctctaactccttacttatggtgatctgcccaccctggcctcccaaagtgctgagattatagacgtgagccactgtgcctggccagcctgctaaattttttaaacatttttttatctcagtgttacgaacctagtttcttttttaatagatagattatagcaacatgctgtggagaatcctcaaagattgcctgtcttggataaaaagggtcacctaaactcaggggcaaagtttgacagagcaatcta

SEQ ID NO: 251953 - DNA, 429 bp, Homo sapiens
gcctaccatcaaaatgctcatgtgttaggctttatatctggattaaagtcaagtcagcaagaactggtctcagaggaattcattcctccagagcagaggcaatgtgtgagatttaagaactcaggccttagcatctggcagatctttaaatttgaatcttagctcgctacttgacatagagcaagaaacatgagtctcaaatataaatcagggaacagcaggaccagagctgatgcacaggaagcacctcgcattgtagaaggcactcaatagctgcttggtatagagtaaatacatgcttggttttcagtaaataaatacttgatattgaaacgattatttcagtcattgatccatgcacaagaaaattgtgcatcataaacattttactcttgagcaaacatcaattattaaaaacatatgttcaaa

SEQ ID NO: 251954 - DNA, 1273 bp, Homo sapiens
aatgcctctctgcctgctcactgcagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtgattt

SEQ ID NO: 251955 - DNA, 1152 bp, Homo sapiens
cactacagaagtaagacacaccccccgcaaaaaaagaatacctcaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtgattt

SEQ ID NO: 251956 - DNA, 531 bp, Homo sapiens
gactagaacttagaatattgaactgacagtgcttttaacatttttcttctggtattctctggtctggactcaaattagtgcaaaacccagaagtggacttgggtgtggacagagagaattcaagatctttctatttctggcttgagtaggaggagtctcacatgtttctcactctgttatcttgccccctctcccccaggtaatcccatggtgagaacagcaggggcatatgggcacctaaaactctgaggagtggggtggaaactcactcacagaagtctggtttttccttctctgtttttctgcttggccccagttgtggctagctatagtcatggaaattaagtggctgaacaagttaagtaatgctccagctctctggctgaaggactaagaagggggagcctcagctgggtgtggtggctcaagcctgtaatcccagcactttgggaggctgaggcaggtggataacttgaggtcagcagtttgagaccagcctggccaaccggacaaaatcccatctctactaaa

SEQ ID NO: 251957 - DNA, 325 bp, Homo sapiens
cagatttatatatatgagctaagagcaggaatgctaaaataatttctttctcaggccttaaagataaatgataggtcaagatgctttacttcatagccaaacatactaaggcacagagcaacatggcaggaatttgagttgtgagcgccagaagtgcttgttcagcactaacaagaaataggagaataggatcagtataatctcatattcttattaaattaaaaaaagacagagagtaatgccaaggttatgacatgaactgacaagaccaaaaaaaaaatcagtttttctgatgcttcagcctttgcaagcataggaaagaatt

SEQ ID NO: 251958 - DNA, 611 bp, Homo sapiens
attttttaatgcaataatttaaaaaagcaaaatcaatgccaaaaacattaggaatgcaataccgaaatttaaaagtaaagtgctagtaagatgaatttaattaaaaattatttaagatcatcagttggtcaagagatatgaaatatgacagtccactcagttgaaaatgagataagccaagaagtcgattttgaaaatgctattgatgaattggcttctgtggaaactagaaaaggaaaattacattaaatcctgattttggtgtaaatagaatctttaaacttaaaataacattgtgagttttaatatacttattttttaaatttttcaatattttttcaactactttaatgttctggaaaaatactgaccatttaaatgatacatataaagatgtatataggggagcgtgtttttctttcttgcctcagtctcccatggttctgtacagcactgaggctaagacctgaatgacaagaaggcagccacatggtcattgtttggaagagcctcctagacgcggggagcatgctgtgatggcattgggaaaaatatgtgtgaaagaagattagagacatacaggggccagatcctggagatgcttatagacc

SEQ ID NO: 251959 - DNA, 557 bp, Homo sapiens
attttttaatgcaataatttaaaaaagcaaaatcaatgccaaaaacattaggaatgcaataccgaaatttaaaagtaaagtgctagtaagatgaatttaattaaaaattatttaagatcatcagttggtcaagagatatgaaatatgacagtccactcagttgaaaatgagataagccaagaagtcgattttgaaaatgctattgatgaattggcttctgtggaaactagaaaaggaaaattacattaaatcctgattttggtgtaaatagaatctttaaacttaaaataacattgtgagttttaatatacttattttttaaatttttcaatattttttcaactactttaatgttgtgtttttctttcttgcctcagtctcccatggttctgtacagcactgaggctaagacctgaatgacaagaaggcagccacatggtcattgtttggaagagcctcctagacgcggggagcatgctgtgatggcattgggaaaaatatgtgtgaaagaagattagagacatacaggggccagatcctggagatgcttatagacc

SEQ ID NO: 251960 - DNA, 804 bp, Homo sapiens
  misc_feature (190)..(190): n is a, c, g, or t
  misc_feature (274)..(274): n is a, c, g, or t
  misc_feature (305)..(305): n is a, c, g, or t
ggtgcggtggttcacgcctgtaatcccagcactttgggaggccgagacagatcatgaggtcaggagttcaagaccagcctggccaacatggtgaaaccctgtctctactaaaaaataaaaaaattagccgggcgcggtggcgggcacctgtaatcccagctactcaggaggctgaggcagaagaattgcnttgaacccgggaggtggaggttgcagtgagcccggatagcaccactgcactccagcctgggtgacagagcaagactccatctcnaaaagaaaaaaaaaggatgaacaagcacagncccttgtccttccagagctccctgtccagtgggggaggcagattctcacacacacatgtgcagcacacacaagtcacgagacagaggaaagggcgccatacaagaggccataacagttctgaagacatgtggcagagtcagacgccctcctcacagggatgcccactcccgcagacccagcaagacacctaatactcacatcccccacctcctcccttccccaggctcagggactccaagcagaggtccgaggcccctagggtgggcacaaatcgcattgcaccccaacaaagtttctctgctcctaagtgctgctaactctaagctaacagagaaatgggccgctctaggtcagcgggctcctccctcatcacggcctctggatggggatgcaggagtgtcctatggctgcccagcgaaagccccagtggcagagcaggaaggctgccagagaaggcactctgccttgaataacctgggggcctgggtgtccaccagg

SEQ ID NO: 251961 - DNA, 397 bp, Homo sapiens
aggtaagcaaaggactaagccatttgggtatctcagggaagtgagtttcaaaacagagcaaatatatcacttgaataagtgcttaaggattaattagttaattttgttgtaagtgtaaagacaataaaaagaccttgcagaaacgtttgtttttaacttattaccctattaacctaaagcaatacagaaaacttttcctaccaatgtttttctacatttattcatgtatgtgtgcacacataagttattgtgtgcctaaaattctttttttatacttaagcatttctccatgttgtttcatcataatttcataatagttttataataattttaacattatcaattattccattagggatttatgtaaataaacaaaaaataaaatgctatatgccta

SEQ ID NO: 251962 - DNA, 475 bp, Homo sapiens
agtagaagtcggaaaagaaaacctctttcaaggtcaggaaccttgaaagcctcctatattaaaatattaattttgtaaggaaaagcacgttttccatttatataattggtaacttaagggtggaaataaaaaatggctaacacatatacatacacaaaagaagaggaattgagaataatgcatgcaagggaatatactgaatggtttcttggaattgaatatggaattgaatatgtgatgaatgcgcacatgttgttttggaaaagttaattcctagaattgatatccttaatttgagataattctaaaggacctagaaccattgtaagatccaggatagtacttttccacaaagtaaatgctcaatgaaaccttttaaaaagttgaactattaaatttttaaatattttagtagatgatatgtattctaataatacatatgggattgattgagcagagttaatattttaaaaat

SEQ ID NO: 251963 - DNA, 467 bp, Homo sapiens
ggctaaggctgagctgactccttctgggggccagagaaggtctccccacaggagccagctgtccttggggtcaaacccagcctcttgactcctggacttctgtctatccaaggctacagtcctgctgtgggtggccagggcacccacatgcctgtactggggaggagacaggcttcagacccaagggtggccatggaacagaaagtgaaccccagtgaagtcttcagagacaatcagcatccatcctgggggaaaggggactccatgaaccaccactgcccacccccacacagaggaaatgccgaggaatccatgtcacttccacatgctggcagaaaggggcatctccacgcccagagcacacacccagcccgttcttcccagggcccaagctattcgcagctgcaggggaggggtcctgtgggcttcatttccatctcgccctgtctcacttggggacttagaat

SEQ ID NO: 251964 - DNA, 775 bp, Homo sapiens
acctcattgaaatgctacttccctgataccttctcgtacttccattcttaaacctttgttgctgttaagtgttgagatgaaacatgtttgctttgtattctagaagtttatgtgattgaccatacctgagcgcagagattaactggggtttgttccagaaacagcattaatcacagtgcccggcacatagaagggtccagaacttggagcaagtaattgaactcaggcagttcccacgcaggccacagagttggacaaaaacagcttgaccctggggcttgcactcaaaatgagccttacccctttaagagagggcaggtcttttccctctccggctcaccccacccctcctacacagtaactgaaacctgatctaatccctttgcacgcgggtaatttattggtctgttgagcttttcttggtggcaaattgcattgtctttattcctgggttcaggctctgcagcagctcactgcattcctaggactcctttctcagggtcgatccttcacaccccctcgtgcactgcaaaataagtcttattgggcttctttgttatgcaaacagggcggtaataatcaggctattattctgaaagattgggcttgattaacagttcaaaggaggtctctgaaagcagctagtgcttcattggtgcataaatattttcatcctgccagcgttggtgcagctggtgctccaagcgccctcccctatctttctgattctcagaggtgctaggttgctattaaaaggaaaagaactaagtcagac

SEQ ID NO: 251965 - DNA, 601 bp, Homo sapiens
tatatacgttggtgggaatgtaaattagttcagccactgtggaaagtagtttggagatttctcaaagaacttaaaacagaactactattcaacccagcaatcctattactgagtatatatccccccaaacccaaatctgtcaaaaaggaacatgcacttacatgttcactgcagtgctattcagaaaagcaaagacgtggaatcagccttggtacccattgacggtggattggataaagaaaatacacgtataccacagaatattatgcagctataaaaaataatgaaatcatgtcctttgcagcaacatggatgcagctggaggcccttatctgaagcaaattaatgcaggagcagaaaaccaaataccacatgttctcacttccagtaggagttaaacactagatacttgtggacataaagatggcaacagtagaaactggggactactagataggggagagatagaaaggggtaaaggttgaaaaactgacttttgggtgacaggatcattcataccccaaacctcagcaacaagcaatataccccaggcaacaaacacacacatgtacccccacaagctaaaatgaaagttgggaaa

SEQ ID NO: 251966 - DNA, 395 bp, Homo sapiens
cccgtatcctcccacgtgctttcatgaacagcagggctgaggtcccaacccggggaatctttacccgcaagtccacagccctaaccatcgggcacactgccgtctcatcctctggagaacaggccacttctccccaccaggccctctggaacatcgtttcccagcacgtgtcccacagagcagcaatcccaggaggcgtgtggagcaaacaagaattcttagacaaataaatgtgggaacagcaccacataccacagctccatagagaatccaggaacactagcatagcaggagccctcttgaccctgcttccccaggcccatctgaccacacaaaccctttgtttccacgtaagatctcactcattgtgcaaaacacaacttgcaaacacacca

SEQ ID NO: 251967 - DNA, 183 bp, Homo sapiens
cattccatagtgattctatggaaattcattgtactttacctacttttttattgatagatatttgaggttgttgacaatttcttttttcttttttttttgctataacaacaaatgcttcaatgaacttttttgtatactcttgtaagttttttgtgagataaatttctagaagtgtaattcctg

SEQ ID NO: 251968 - DNA, 419 bp, Homo sapiens
ccagttgtactttgataagtttgaaagaagcgcttgttataaattaaaggacattcttaggggtcaagtaaaagctgttttttcttatcctgggaaattaaaaatatttctctatatatttgaataccattaagtgagtcttggcttactcttcaacaaaacagtttgaacatttaacattggaatgtcatgacttaagccaatatgagaattgttatttatttcttgcgagatttgtttttaacagacccttgggattacctgaacgtttattgcattaattcccttacgtgcagatttaagtaaaaattattttgccttcattatgctgtattattctcaaagtctttctgtcgtcgtttttgtcagctctacacacagcaaaagtctttaattgttaataaatacaataaattatt

SEQ ID NO: 251969 - DNA, 747 bp, Homo sapiens
agtgtgagtgtgagagcgagaacagccccgcaggtcccgaggcgctggctggggacaatgccgcggaaagttcccagtccccagccgcagatctgcagaattgaaatgaaatgttttgagctcttcaagctgactcgtcagaatcctggagccttttaaaaaatgacgaaatggaaggaaaaattactttatcaataaccaggctccaccaggattgacctagatggttgttcctggcacttgtcattctcagcaagcacagctcagagaacaaatacaaaagacccaaagtgcattgcatcttttatggaagtgcccaatgtggaaatcatagatttcaaggaaggaacaagaaaattgatgaaacaagttcaaaagaaagaagcttggccaatttgatgtcaatggaaatgcgtgagatttttattcagcattcacacctgagcaatgcttttggtcatgatgtcatactaagaagaaaccacctgagatgagactgttagatgttcagagcaaacaaaaacaaaaacagaccaacaaaaaaaacccaaaacaaaacagaagtttctgaaggacagcagaaatggctttgcaggaccacaacaaccactcccagtcatgatggagagaagtgttcaatacccacagatcctgaacgttgagctgattatactaactagatgggacttagttttgtctaccgtggggtgagcgtatactacctgagggaacaggtacacatgaata

SEQ ID NO: 251970 - DNA, 1088 bp, Homo sapiens
agtgtgagtgtgagagcgagaacagccccgcaggtcccgaggcgctggctggggacaatgccgcggaaagttcccagtccccagccgcagatctgcagaattgaaatgaaatgttttgagctcttcaagctgactcgtcagaatcctggagccttttaaaaaatgacgaaatggaaggaaaaattactttatcaataaccaggctccaccaggattgacctagatggttgttcctggcacttgtcattctcagcaagcacagctcagagaacaaatacaaaagacccaaagtgcattgcatcttttatgggtaagcatgaaataggtttatttgtggtagtgtaatctaacttaagaggtggaaagacaaggctttggaaccaatgccacaaacattgtgttagtttttgttcatctatagtaaaaagtgaatgctgactggaatttctgggaaagatttatagcatatgcaattttaagtattcaggtaactctttagttactgtgttttaatccttcaagcccatcagagaacaaaccaatccttgttcttgggattgaaaatactagatatcccatcaagcaccattatcttgatattgaaagtagaaatgtgcttctccattttgtttaacctagttaatattggggtggcttcacatttcagtgccttttcagttatcaagcagggacaacattttgttaaactctaaacagtgaattaaaagcactgaatgagctgaagcagccctctaatgcaaaatgacaaattgcacttaagcaatacatgaattatacatcctaatgctcacaatatcattttctaataatactgtttcagttcagatactatactctgctcctttctgtaagagaaattgatcaataagaggtccaggaatgtttttaaattgggcactggtttgtgatactgattccaaagtgtgtctcgcgtccgctatcactatctatagttaattcatcctccataatctcgtttctttaataaactatctgtctcctatccacaatcatctattccactcttcctcttcgactctatcacacatatcctcttatacctctcg

SEQ ID NO: 251971 - DNA, 747 bp, Homo sapiens
actccaggcgggccggggcgcgtcaatatggcggcgcagggctccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttgtgccacttctttgtttaatatctggactaaatacgcccccaggctgccagcagactattacaacgaaaagcttctgaaggttggagatagcctttgtcaaatgaaagaatacaaactggcccttttacaatgctatggaagatatcttcagcagttcaataccaattttgatgagaataaagtggatgtaactcaattcaaagctacctttttcccaaaaggctttaaagataaaactgctggacttacatttcatgctttgagtggcaaaaatatgtgcaactaccagctggtctgcgacagtgatgaaaacctgaagaataaagaatctgtggtccagtgtctgcatatcttgtcctccttaaggctcatcatgcaagtggctctgccacaagagcatctt

SEQ ID NO: 251972 - DNA, 380 bp, Homo sapiens
tccagtcagaatcccaattcttttctctttatgcctggcatgtagtaggcactccataaatatctgctaagtgattagatgagtgatttgccaaaaattttttaaaagatttgtcatgaaggatgattatttctttaacattataatttattgcaaagctacaataattaacacagtatgatgctggtgcaagaatagacaagccactcaatacaacagaataaagtccagaaataaactcaagtatatataaaatgtatacgatgaaagtagcatttcaaatctgtagagacatgatgaatttttttaaagataacgttaggacaattggacaaacttttggaaaaagtaaatgtatgcctctgtttttagttctaaat

SEQ ID NO: 251973 - DNA, 493 bp, Homo sapiens
ctgtcaagaaaaaacaaaaattaaaacaaacaataactacaacaacaacaacaaaaaaaaacggcaaagttagaacacacacaagatagtatagttccttacccatccaccacttggttttgaggagaaaagggaagtaagaagagttgaagagaagaaaaacagaacagaagagtgggaaaggaagatgaaagggtgctatggagtactatgcacctgtttagaagtggggaagtagcacaaacactagcaaaagaagaaccaccatggagttcctccttgcacatctctctcccctcctgaaggcctagggtgagcccacagcattgttccagcagtgagggagtcttcactgcctcctgagactctctcacggctcttaagatacctccctgaagtccctccaaagaattcaatgtgcccctagtctaaatcagtttcctccatcataaatactcatagatgacgcaacaataaagcgttaataacgata

SEQ ID NO: 251974 - DNA, 437 bp, Homo sapiens
caaaagcacagctaacagagaccagcgtctctccaccccagcaggcctggtcttttgcgtccctgttttctctatggcccatcttacccacaatcactcttggaaccctgacagtttttaaaagctcaaactggattgcttctccccttttctgaagcttttcaaaggctccccattccaggccgggtgaggtggctcacacctgttatctcagcactatgggaggctgacgcgggcggatcacctgaggtcaggagtttgagaccagcctggccaacatggtgaaaccccgcctctactaaaaatacaaaaaattggccgggtgtggtggcgcaggcctgtaatcccagctactcagggggctgaaacaggagaatcacttgaacctgggaggtggaggttgcagtgagccgagattgcgccactacactccagcc

SEQ ID NO: 251975 - DNA, 393 bp, Homo sapiens
gtgtcaagtgatgtattatgctctggggatacaacggtgaacaagacaaagttcttgctctcttggaatttatgtattattgatgagaagcctgttttgttaataataaagtcaggcacagtggctcatgcctgtaatcccagcactttgggagcctgaggcaggtggatcacctgaggtcaggagttcgagaccagcctagccaacatcatgaaactccgtctctactagaagctacaaaaattagccgggtgtggtggcgggcacctgtaaccccagctgctagggaggctgaggcagggggagttgcttgaacccaggaggcggaggttgcagtgagctgagatggcgccactgcactccagcctgggcgacagagcgagactttgtcta

SEQ ID NO: 251976 - DNA, 510 bp, Homo sapiens
cccatggaagcagcctccgaatcctcgagcaatatcattcccagcctctcctgacatgacctgttcttgatgtgattgtcagcagttccaaaatgaaagtctctcctgaggccagaggcaggaagaggctgggctgccatccatgcaggttaatcccaggggggatgcagagaggcctggtggaagttctgggagagggcagccatactgtcattctggttccattttcatgatttctagggtgtctggaaaagaaggcagaaccagtggcctgaatcctcaactactttttttttttttttttttttttaaaatttttagtttaaagggggaaataggtaggattaccgtgataggggcaataagtgtgggaagaaagtggggtggcgttggtatgtccaaactgtcatttaattttaacgttgtcagatttggggagtagggtagatgagggtggagtaaataaggcgttaggttaaattagaggttaaggagggtgatggtggcata

SEQ ID NO: 251977 - DNA, 127 bp, Homo sapiens
gggagatggttgtgccccttctggacacctgggtgtgtaccctttctcaaaagtctcaaggctgtgtcaattttacttttatagaaattgtgtaagttttcttaaaaggcagagtgggccaggagcg

SEQ ID NO: 251978 - DNA, 439 bp, Homo sapiens
agtgatatgaggtatgataatagcttgggatatgagttacgaatattttttcacaagttgtcattagattttggctttttggaaagcctttggccatggtaatttttgttgcctattttcctttaaatttgcaggaggccgggcacagtggctcacatcagtaatcccacactttgggaggctgaggcaggcagaccacttgagctcaggagttcaagaccagcctgggcaacatggcgaaaccctgtctctatgaaaaatatgaaaaattagcctggtgtagtggcacaagcctctaatcccatctactctgggggctgaggtagaaggatcgtttgagcccagcaagctccagcatgggtgacaaagtgagatcctgtctcaaaaaataaaaaataaataaacctgcagtattttgaatcctaaggtagtcttgggt

SEQ ID NO: 251979 - DNA, 289 bp, Homo sapiens
atgttatccccagttgtctccacctcccctccaccccctagagttacagagacctcatattaccaggtgtttgaactacaggagttattgctacattttgctccccattccagtccaattgtacctgacaatattccaatttcaaatccattaagtataaactgttttaagaatggcaaagtataggctcaaaataaagagatggagaaatatttaccaagcaaatggaaagaaaaataaagcaggggtttcaatcctagtctctgataaaacagactttaacaatgat

SEQ ID NO: 251980 - DNA, 474 bp, Homo sapiens
gctggtggtactgtaggtgttatgagaggacccatagggtgtccttcaggtgagctgttgtccacagcacctttcatatctgctgtaaagggagccctactttctgtctatcccccccaccgccggcccccggaatctaagcagactccctgttggaagcttactctggcacagaagctaggatgtcaccttaaagggtgtgattcaattgaatatagtttagtgcggtaccaggcacatcataagcatgcaataaatgttagccagcttagttataacttttggtaataattaatattatttaactaatttgcattataccacttatttcttccattatggagattctgtctcccttaaactgttaaacttgaagaagaaaccaaacatgataatctggtcaagttaacacattttcgcccatgaattctaccttcaacacagccaagctctgatacctcagatataagcaaa

SEQ ID NO: 251981 - DNA, 588 bp, Homo sapiens
ggtgatgaggcatgtttccattcatctttccctttcagaaagaaaaaggtcctccagggtagtgctcggcaaactgcaaatgggcctgtttatctttggctccctctttagagttctgaatgaaagtcccattgtgtcctttcctctacggagctcctgcaaggcccgctctccctgcatgaaagcgtgagcgagtgcagctgggggctcataacccttcgactccttgtctgcgtgtcaggaagggtgttacaacatgcctcatcagcgatggctagcaatcgctgatgaggcataagtggtatcagttttcatttttctaattgtttaaactgtgttttataccagtgtttgcaagtaatggggtgttagcttgagatgggtaaaggtggttgggggagggacttcgttgtaatggtttggctgtaaaaaatgtttccaactccgctgaaatgttgctgaaaagcatggtgctggtaccagttcaacaatccgtggctgctcattcttgcctactttactctcccactgaagcaggttagcggtgaaggtggtatggaaagcctgatgcctcatcagggatggtgg

SEQ ID NO: 251982 - DNA, 427 bp, Homo sapiens
ggttgtgattagatggattgcagcatgcttgatttttttcattgaactggtcattcctgcagaggggtgttagaactgacctggcttcttggcaagtgttcagctgagactacttattggccctgagcacagcccaaacacctgcttagtcctgaaaccctgacctgagttgtggagatggaggagacctggaggaaatactcattccattggagaggccttgtctcttctgccttggaagctgccccagttagatgaggagacagaattacgtactcaagagagtaatttgcaagaagcacagctgtgatttcattttccaggcatccttagcctatgtctctagacagtggtcccctcaagggcagtactgagttaatactcttttaccttgcctaacatggcactggtttaaattaaaaaaaaa

SEQ ID NO: 251983 - DNA, 558 bp, Homo sapiens
aaggtttgacttcctacagaaagacttcccacattcagtacattcaaagggtcctcctctgagtgtgttctctgatgtactctaagagattattttcagggaaaattgtcccacattcattacattcataggttttctcaactttgtgacttatttgatgtataaggaatgatctcctagagaagaatttttgacactgaagatacaaataggacttctcctttatgtgagttctctgatgtatattgaaggtcgactgagaactgagtttccctgcatgtgttattatgacaggatgtcttcaatgtgtaagttttctgatgatgtactgtaagggcttaaatgtggctgacgtttttcccaaactcaaaacgtttcacccctgtgagagctctctgatattctctgaagagtacttttcaactgaaagttgaaaagaaaaaaaagaaaggaagaattctttgtattgatctatcatgtaaaaattctggtgtatacctgactgtcaccctgctgctagccatacttcattaacaaattaaacaaaaattaaagaaa

SEQ ID NO: 251984 - DNA, 452 bp, Homo sapiens
gactgagatccctttaagaaaataaattctgaaagcaggattctacgtaacttaaaattctagtgtcatattaatactatattctctcatctgttgttaccatctctagtgctataaaattgtaaaattccaaagcaataacctcatttcacattcgtaaaaaaaacttgaagccccaggaagtaaaatgatctcagtgcttttcactgaaaatagaaaataaatgggttgctcttggtaaggtaggaggcacaggcctaaatgattcatgataaatgtaaaagttctttgaagatgcatgccttaccttaaaacttcaaatgtatatttcagattctagtcagatataacacttactatagtaaattggactctctaggaagatgcttcatttatcctgtgaactctggtacccaggtttgaattaaagttatcacatcaggggccaacaa

SEQ ID NO: 251985 - DNA, 199 bp, Homo sapiens
aggttggttggtggatggatcagtggacaagttagtggatggatggatgatgaatggatgggtgagttggttggtggatggattggtggacaagttagtggatggatggatgaataagttatttgggagacaaatggacgggcaggaagattgatgctccgctgttcctgctttttgcataaatgtactcgactccctc

SEQ ID NO: 251986 - DNA, 381 bp, Homo sapiens
ctgggcagggcacattgggtggttttgtccaagcaaccagggaagaatcactgagtctccaaagcaatgtaaccagagaggaaagtgtctctaggtggaaactcggggtttgagacatctcacacagcagcagaggtagcactcagtttgtgcaggagagtgctggactgcaggactgcccaccctgggaagctgtggggcagaggaggaagcacctcttggggagatggtggagtgagtcccagggaatcccagaggtggtgttggttagaggggtgctggcgatgggaggggcttggccttcaagaaagaagcaggcttacttacatatgtgaggtgtgatctgagaaatgctaggaaagtctaacttggccccactga

SEQ ID NO: 251987 - DNA, 435 bp, Homo sapiens
ctgggcagggcacattgggtggttttgtccaagcaaccagggaagaatcactgagtctccaaagcaatgtaaccagagaggaaagtgtctctaggtggaaactcggggtttgagacatctcacacagcagcagaggtagcactcagtttgtgcaggaaaatatcagtaggggtcatgggtccagtggacttggaagaggctgggtaggggagagtgctggactgcaggactgcccaccctgggaagctgtggggcagaggaggaagcacctcttggggagatggtggagtgagtcccagggaatcccagaggtggtgttggttagaggggtgctggcgatgggaggggcttggccttcaagaaagaagcaggcttacttacatatgtgaggtgtgatctgagaaatgctaggaaagtctaacttggccccactga

SEQ ID NO: 251988 - DNA, 593 bp, Homo sapiens
acagccaccctctgagctctccgcagcaggaggaaaacgtcagagagcccttgaggccctgtttcctcaccagaaggaaggtggctgacacagccatgatcacccccaatctggaggctcagactagagtggccccaaatccttggggacaaggccagaaagtggatgtggccacacagacaggtaagggtcacctgggaggtgaggtgcggtctcgaaggtgctgcgccacacacccaaattccaaggacagagacatccacatggatgtcccacagataatcaggaggcctcatgccctctccccgggcaggggtgacagctcctccgacttgcctctcagctcacagaagttgaaatctaccaaggacatgcatggcacacgggcgtgtacacacactcgtctgactcacacctcatcctccctttcgcttcagctggggaaggaggtggaaaggtgatgttcaagactggagggtaatttgcccaagaatgcagtgagcaaacatcttaaaacaccacggagagcctctgaaaactgattagaaccatttgtgtggccaacaagaatgagggccgccgagaactggaag

SEQ ID NO: 251989 - DNA, 433 bp, Homo sapiens
acagccaccctctgagctctccgcagcaggaggaaaacgtcagagagcccttgaggccctgtttcctcaccagaaggaaggtggctgacacagccatgatcacccccaatctggaggctcagactagagtggccccaaatccttggggacaaggccagaaagtggatgtggccacacagacagctcacagaagttgaaatctaccaaggacatgcatggcacacgggcgtgtacacacactcgtctgactcacacctcatcctccctttcgcttcagctggggaaggaggtggaaaggtgatgttcaagactggagggtaatttgcccaagaatgcagtgagcaaacatcttaaaacaccacggagagcctctgaaaactgattagaaccatttgtgtggccaacaagaatgagggccgccgagaactggaag

SEQ ID NO: 251990 - DNA, 267 bp, Homo sapiens
tttgattgatagttaagaccactaaataacaggaaaacagcaagtcaatatcattttggagtgtcatatttttctgcttcaagaaatgttactcataatgagatcactcttctcatgaaaatcactcaagaagatgtagcaaagaagatacacaggaacttggtcggagactgtttgatttgatgcttattttcattttaaatgcctaatttaaaaagcagaacaattcctctagcatgttattataataaaacataagatacattg

SEQ ID NO: 251991 - DNA, 473 bp, Homo sapiens
ttgctgcatttttctaaactaaaaaaatgatagagcatgttgattctgctctcagcaatatctttccttgttaaatagggaacttatggggattatggactatattaggagaaatgttttcagtctcatctgcaatatttataaaaataggattccttgaccttcaaagggcaaaacttaaaaaaaaaaaaatcctcagaatagctggcaataaagacctagatcacagtattaaagtgtatggcgtacaatacatgaggtcagtgctacagccatctagcatgaactaacccagcttccacctccataaagttacctagagtggtagagtgggaatatgttctggcatatacctgacctgccaatcattagggagaggcaacaaggtaatacagcctttcctcctatcagcacacagaaactcaaagctgtcttcacccttttctgttccacagcagtcttatcctgacagg

SEQ ID NO: 251992 - DNA, 234 bp, Homo sapiens
gcaacccagagaaagggcttttctggacctcgggccccacccctgggtttacagagggcagtggacgggattatggttttcaaactgggttctcaagagaggtcttgggactatcaaattgaaaaggctgaagtgccattccttccaccctctttttaaaccagacagtgatgtctcttagattgaggatctaagtaaaatttaattgaatcagagttccatagctaatcaaaa

SEQ ID NO: 251993 - DNA, 379 bp, Homo sapiens
aatataagctcctcaaggcaggcagcataactttttttgctacattgtatttagggcccagcatactggtaaattgtcaaagaaatgcttcagtcaatggatagaatgaatttttgtgcctgggggtgccagagccagggtggggaagtaaaaaaataaaaactgtgatggtagtcacacaaacctaaatgtgttgaattgaaattcacagaactgctgggctcagtggctcatacctgtacgataatcccagctactcaggaggttgaggtggaaggatcacttaagcctgggaggtgaaggctgcagtgagctatgactgtgccactgcactccagcctgggcaacagagcgagaccttgactctttaaaaaaaaaa

SEQ ID NO: 251994 - DNA, 455 bp, Homo sapiens
tgtgctctgttatagtcctccttgtcgctgcactctgggcccctagaactggtgtcccagaaagccaccctgctttaggccccgccgcagcagtggggccctcaagcgggtctgaagacgagcaggtgcacagacccccagccgagcctcatctccacgcaagcacacgtgggctcttcatccggttgcttctgtggagcagtgtggattgttaacactaggaattaactgttgaatatgtggttttttcctgtaaccaaattgctgtaactgtacactaaccttgtgtgagaaaagtttgtagtcctgctaaaagctcctctgtctctgcctatataaatgaaaccctaatgtccctacttcagaacactgactccattcctttggagttggtgtttccaggtgggctatactcaagcattacacatgaataaactctctttaagttaaataaa

SEQ ID NO: 251995 - DNA, 258 bp, Homo sapiens
acctgtgttcccagctactggggaggctgaggtgagagaattgcttgagcccaggcagtcaaggccgcagttagccgaaatcacacccctgcactccagcctgtgcaacatagcaagactctgtctcaaaaaaaaaaaagatattcataggtaatacagggtaatgggaatatatctagactagaatttctacttctagctttgccacttagcaatcatatgactttgaacttaatctttgatagtgtttctttacct

SEQ ID NO: 251996 - DNA, 407 bp, Homo sapiens
cacctaaaattgtgcttggcacatggtcaaccctcaaatcttagatgatgttattccccacttactagctgtgttaagtttggcaagttaccttctctcagctatggttgcttacctttaaaaatgggcctaataataccttacttacctagagccaaggggatgaaatcagataatctcctgggaccaaagacttgacccacttcccatgaaattgtgttggcatctatgagtattgaggggatactgaaaccttataattctgctccatgccatggtgcagaagggccagtagccccttccagcatctgttccattttgcccaaatctatagaggggcctggaagcttattccagaaatcaataattagttatgtctgagaaattgagtcttttcagttcataaa

SEQ ID NO: 251997 - DNA, 644 bp, Homo sapiens
aaggaaaggaaaatgatgtattttcttaaaacacagatatttccagtattctttagtactaaaaagttagtgaatttaaaaattgttgtattctttttcattgtcttgtagagatgatcatcaagggaaatgtaagtgaacatggaattgtgactgttttttagttagcttgcaagaatgctatgaacaatattaatgtaaaacaaaaatgaattaaaaattttaatatttataataactgatattccactagtaggtgatataaaacttgagatgccacaatgaagaacaattaaaaatagagattagaatttcttgttgagaaacattttagaaacatttttttcttcagcataccactgttaccaaatagcttgggaacagagttagccattgcaatggaaaatgaatttgaaattcaccctgtaagtgtcattaaataaattttctctaattaataatcagatattttagtttataattggtttatgcaaagttttttaaattacacaaacccctgctaattgtatttataacttaaccactttgattttgtaaaaactgacattgctactattacttataattacatatcaaaatagttcagagaaatacacttcatttattcaatttgatttattgat

SEQ ID NO: 251998 - DNA, 507 bp, Homo sapiens
cctaattgaaaagtgcttcagataaggcatagatggtagaaaaatctcataaaaatatattagtggtgagaaaaatgtcaggtacaactcaagatgagcggggttaaagcagtgcatgctggaagaaagtagtttgaattagtttgctgtaataatgaagatggtaaggaagatggtgatgactgttataattaaaggaaggcatattattcacaagaaagttatgtcatctcttttggagatggcaatgaagatatgcttgtaaagaattcttgcatttcttaaaaatattactttttcccttggccagttttacagggttttagtttactgcctcttactgatttgttgacccattttacctggatttctgaaaatatgttctgtatctagtcctcttagttcgtatgtattagtttttatttaccaccgccctctaaccccaggccccttcaaaaatgcctgcattttgctatagtgcctttattaaaaattattctggacatt

SEQ ID NO: 251999 - DNA, 2055 bp, Homo sapiens
gatgccactccagctggacgggctcgtggagtctgcattcgagggattccctagtccgtccagtcatcacgggctgctgcccgcctgcccgtgccgtccaaggcacctggccttgggccggtatcaggtagccgcgcctgggtcacacctgccctccacgttcatctctccacctacagatcatagggaccgtttcctcattttattgtcatgcaaatgttgtacataaatacatggctataaacaggcagctcagagtaaccaggaggctcttttctcagtgacagatcacaccctcttagagtagtaatttttgaataattgttgcaaaatatgaaaacctttagcaaaactccagcaccactgaagtcatcaggaagtgtttgggagaatacgtgtctgtgctggatgctgttgaagcaggtcaggccgttggggtcccttcgttcttagggcttctccaccagcttctaaatggggaatgccaactttgtgccaggcacacactacctgctgagacactgtggatgaacaaggcgttgacccagggctcactctgtagaggaagaagaccagagaatggataccaccaagacagtgataagtgctgcaacagggttcagagctgcacaggaagtccccaaaggtagtgaacccatcatcggggcttaggaaagagcttttaaaggaagataaagccagcaggtgacgccaaaaactgggtatttctgtagggtagcttttttccctttcgttctacttgttgtactatacagtagagtagccaacccacctccaaggaaaataaaattcaaaatatataatgtaatcagtatgatgatagctcttattgttttgcttctgtacttcaagctgtgaagtcattcttgtaacacaggctgaattttccccctcaaccatggtgtttaatgagtgtgaatcttcattcaaccattaaaatctccaagagtatttttatactaacagttcacaaacttgaggcaattatagtctaagtagattccaactcctgcccccacccgtcttcctgccaccaccgccgcccggtctctggaggatcttggaaagaatttaccagcctttaggaacattcagcactttaaaagtgtcacagagccataaataaagagtaagacacccctaagactgtcatctcatcaccacacccgtctctgctgaggaggacagagacaggaaggaaatgcgacaagttcactgtgcagtagccaagcaggcccagccaacatgtgggagggtgggtgtctgtcccagcggtggggcaggaggcgtgcaggggaaggggctgcctggaggtaaggctctgcggtcagccagccctgggtttggtgctccaggaaaggccagcacgtaggggagtgaggtggggtgctgctgttggtagggtaggaagtgacctcgcagggtggggccagggcttcgtggccagtgggcggccatttctgtgacattgcaatgttctgcgtggatcgttttctggattcctgccaaggtgtttacttggcctggggaaagagaggaacgcatgaggggcccagaccttgccccctgacccatgatagggtctttgagggcatacataacacatctggagcttaaaaagaattaaactgtagaaataagacttcagtgaaggataatatattagtggaggaaagaccaaatggaagatggtgttaaccatcccacaaatagaaatgagtgttatattaggagcctaaggtgggacaaccacacttccccagagctctttaaaaatagcgcagacactcatgcctctagtatgattcagttcagctcctcattgaaccagggaagagaccgacagacttcacaccacttcttctgttcctgtaattctccactgtgcagcttgggatttcctggagatgtttccataaaaatagagagatgccatcatcactgtcgtcactgtcactgctgtacaataataaaagaaggtgctaggatgccttcctgtaagttttagactagatgtattaaaaagtatccggt

SEQ ID NO: 252000 - DNA, 478 bp, Homo sapiens
cctcactccttcccttatttgtcttgtttcccattctttgtctaaatctcctcttttctctccctcttcaccctattcattcccagctccctaaaattatatcattcttccttcatcatgctccctcattcctcactgcagcatcacccagtccaactctgtcccatctgtgattcctcacttctgctttcgcaccatctctctccctaaggtagaagtggtgcccagctttaaacacaaggcaaagtgagggtatgttccactaggacagcgtgtgtcactctgctgccatacacagggagtaccatcagtgattataaagaggaatttcattcctgccagagagctcacaaattaggttattgttgatgttcatatagtttttagtgactggagacagaaaccaaccagataactgtgagatcccagccaagcacaatttctacatgttagtcaattgcaagaaacactgagatgt

SEQ ID NO: 252001 - DNA, 612 bp, Homo sapiens
aagtatatacactttaatatatttgttaatataactactctccactgtttctgttgaatcagacctttatgttatgttgcttaataaagtacagtaagttttggcatatatattttttccatgtaagtagcataaatgctcagccaaacacttagtatatgatgccaaagtagaaagctgagtcttctacattgattagggcaggcctcccaccctccgctaaggcattaaattattttacccaagtcacacttttaacctatctgattaatttgccgaatttgtctgattcagcattatggaattgtactgtctcttttggtgccacaaaatgctaggtaatggcactttaggggctttggatcaatcattttaatcttttttggctttagcccagttatcaatagagagtgagctaaagtagattcttatactgtatatcctccagctataaacttttatggctattgaatgtgaaatttgggaagcatctcatttccagaattccaccctagctcagcagtttcactctgctttttgtgttgtggcagacttgtatttcagtaagcaccttcacctttttgatatcccaggattcaaatgaaaaaaaaa

SEQ ID NO: 252002 - DNA, 1122 bp, Homo sapiens
atagatcttgtgaggcctcatagcccattgcaaggactctgaatttactccgcaagagacagaaaaccatgaccaggcattgagcacaggagtgacatgacagtcattctcactgctgtgaagaagacagaaggggttagggaaaacaactaggaggctgtctcaataatctagactttgcaaatgggcatcaaacacttctctgggctctttgtgctgctgtgcattggatttggtctgtccattttgaccaccattggtgagcacatagtatacaggctgctgctaccacgaatcaaaaacaaatccaagctgcaatactggctccacaccagccagagattacacagagcaataaatacatcatttatagaggaaaagcagcagcatttcaagaccaaacgtgtggaaaagaggtctaatgtgggaccccgtcagcttaccgtatggaatacttccaatctgagtcatgacaaccgacggaaatacatctttagtgatgaggaaggacaaaaccagctgggcatccggatccaccaggacatccccctccctccaaggagaagagagctccctgccttgcggaccaccaatgggaaagcagactccctaaatgtatctcggaactcagtgatgcaggaactctcagagctcgagaagcagattcaggtgatccgtcaggagctgcagctggctgtgagcaggaaaacggagctggaggagtatcaaaggacaagtcggacttgtgagtcctaggtgaccacactgcttccctttctcagttcctgaccttcctctgagcccttgagacactttgtaatgctcttttgtaactatcgacaaaggtgtggggaagctgaggtctaggtcttcttaaaggtcaagtctgctctccctcgcctaaagtgcagcagcagctcctctcaagctcactctctaggtctccagggtaggagtgtttttctagcaagaatcttagtcaggagtaagctctgtgcgagagatctgtgaataaccagataaccccagctgccgttaaccttttcaccaggtgccacagtaatatttctggtttttagccctttctctgcactaccaacaagagataaaattgttactcac

SEQ ID NO: 252003 - DNA, 450 bp, Homo sapiens
aaattgtatttttgtagaaatgcggtctcactacgttgcccaggctggtcttgaattcctggtctcaagcagtcctcccacctaagcctcccaaagtgctgggattacagaaaatggtaaacaagggaaagaaagaggagttccagaccctgcataccaaaatattacagacacacaggaaatgactcttcaaatccaggctgtaaacctgtcatttcgtgggcttgtctgtgggcctagaaaagcgagacaaagatcacaccgaagacattactgtttggggctggctgtactggaggacctctggaggcctttccatgccaggtgctatgattctaaactcaagtcataaaatgaaatgttagaggaaagccaatgaaatttgaggcagaacttgtggcttaaagctcattttgctttaaaaaatgtagactttgaaaaactgttctt

SEQ ID NO: 252004 - DNA, 1293 bp, Homo sapiens
ttagagatagtttttctcatcctcaagtattgggagtccaactttgagtggaatctggactaaacttcagagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccggcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactaccttttttttttctggttttgccattcttttattcatgttgttacactcagtataggatagtttattaaaatcattatgtctgtagacattcaaaaaaaaa

SEQ ID NO: 252005 - DNA, 454 bp, Homo sapiens
gacttcacattctcccacatggagtaaaatggaaatggactagaatgatcagtgggaatgatggtgtggtacctcttgatgttcaaaggggagagcaatccttgccccatctgagctctcaccagctctgatgccctcagacagggagacagccagcaggggtcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttcaaactgagtcatgtgtgagtcagcattttctttac

SEQ ID NO: 252006 - DNA, 237 bp, Homo sapiens
  misc_feature (180)..(181): n is a, c, g, or t
ctctgtgctgcggtcgctctacacggactcccctgcgatgctctccccggggccactggtgcgtgtgtcttttgaaacaccacctctcacaatttaggcagaagctgatatcccagaaagactatatattgtttttttttttttttttttttttttttttttttttttttttttttttgnnggggggggggggggggggggggggggggggggggggggggggacatgtgtctccac

SEQ ID NO: 252007 - DNA, 4255 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttttaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttca

SEQ ID NO: 252008 - DNA, 4289 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttttaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttcaaactgagtcatgtgtgagtcagcattttctttac

SEQ ID NO: 252009 - DNA, 4246 bp, Homo sapiens
  misc_feature (4209)..(4210): n is a, c, g, or t
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttttaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtctcttttnnctcttttttttttaaaaaaaaacaatatgtcgacgc

SEQ ID NO: 252010 - DNA, 4188 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttttaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttca

SEQ ID NO: 252011 - DNA, 4061 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttttaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttca

SEQ ID NO: 252012 - DNA, 3771 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttttttttttttttttttttttttttttttttttttttttttttttttttttttttttatatttacaaaa

SEQ ID NO: 252013 - DNA, 4004 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaaagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttcaaactgagtcatgtgtgagtcagcattttctttac

SEQ ID NO: 252014 - DNA, 1457 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccggcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactaccttttttttttctggttttgccattcttttattcatgttgttacactcagtataggatagtttattaaaatcattatgtctgtagacattcaaaaaaaaa

SEQ ID NO: 252015 - DNA, 2956 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaaggtgaagctctttgggttctctctcctgtcttggtgtttccagcgagggaaggcagagtcaccattccctgtgcctgtgcggtgctgggcctctttcccaggaagactctttgttttccaaataccctcagacttggtcatgtttcactctctactcatttgtctgtgcctaatactaaatagaccatgatgaccccttcaaaaaaaaaaa

SEQ ID NO: 252016 - DNA, 2812 bp, Homo sapiens
cgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatgtcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttca

SEQ ID NO: 252017 - DNA, 560 bp, Homo sapiens
gcagtagtgctgtactcaggggtccccgtgactgacaatcatgctcctctgaaccattgccctaataggcagttgttgcatttgcaattgcgatgccctttctgcctgagggcatggcttggcatctcggaatcctccgtcactagacagatcagaagcacccaccacaactgactttgcccatgggcccctggacacctgacttcacattctcccacatggagtaaaatggaaatggactagaatgatcagtgggaatgatggtgtggtacctcttgatgttcaaaggggagagcaatccttgccccatctgagctctcaccagctctgatgccctcagacagggagacagccagcagggggatggggcgacaggcccaccctgcccagccccacctccccatctgggcttgtgcactgcaggggtcccaagtctagcccggacgagggctctttcttatacacactgcccgacgactccactcaccagctgctgcagccccatcacgactgctgccaacgccaggagcagcctgctgctgtgggccagtcaggggtga

SEQ ID NO: 252018 - DNA, 441 bp, Homo sapiens
gcataaatcccacatgacgaagtgagtaagaggagagtgtaacagcaacaaaactttataatctgggaaaagggtagattatgtagtaactgaatcctaagatgccattgcccaaggcaggaagcaccacatttatattttagaacctttaaaaagttcagtcattataacactagctacttctgggaggtggagccttagaaaaggattggctgaaagttccttccctaatgcagcacagctggacagttaccccagccttgctctgggaaaagacctgctcctgggggcacatggagactttcaggtatggtggcaacatttgtgttagggaataaattatcttccttctcccattttacaaaatgaaggtatatctttcatctaacctttatcttgctaatctggagttgtaaaaaggtctggaagtcccactttaaa

SEQ ID NO: 252019 - DNA, 527 bp, Homo sapiens
aaataaacttcaaattttaatacaacaaattctatttgtggtataatctaaataatgctaatataatttagagaaaaacaaacgatttagtaacaaggcataaagagactttccttacacataacatgctaaatattactcgtttttaaatggtgccacttggtaacgaaaataccgtaactttatttgctttctttaaacttgccattctggaaatcagatttgtgttttaacagatttacacaagcagtccactgaagagtggagcaaaatttatcataaatctgatctcactttataaaactcatgatgaaaaattttccttttatatcatttcatgtaattttaaaactataaactactttcccagaaagatgaaatgtgcaacactctgaaatcacctaaattgatactgctattcttaaaacataaaatcaaataaatggtcattcatacagcaccaaaaatgtctttggaaaaaacaatactcatatccacttaccacccaaggttgcataaagaaaaaa

SEQ ID NO: 252020 - DNA, 490 bp, Homo sapiens
gcaattttttcttaacaaaatttgtaaaactgttggactgatttaactgtgtgtctatataactttggttaaaaaaataaatattaaaaaccaaattgattaaagacttaagagcatgaagtttggaaacagatctgggtttgtttgagtctttcttgccacttattaatggtgtgaccttgagcagtttatttaactacacctattttctcatctgaaacatgaggacattacttacacatttgttgtaaggattaaattatgtaattttttttttttttttttgagacggagtctcactctgtcgcccaggctggagtgcagaggcacaatctcgtctcactgcaacctccacctcctgggttcaagcaattctcctgcctcagccccctgagtagctgggactacaggcacgtgccaccacgcctggctaatttttatatttttttagtagagacggggtttcgccatgttggccaggctggtctca

SEQ ID NO: 252021 - DNA, 837 bp, Homo sapiens
gtctccaagaagagtcatctttatatctgaataaagcttatttgtaatgcatatattaagtggtgttatgtaaatcaatgcttttaagataatttaaaaactgcttgaaaataatatgcaaaatttgaccaaacatttccttgcaaatcttgttatagtcttaatttatttttgctggtttacttcacagataaatttagaattgaactttagtctagtagggacatgccattatctcatttccaattattggatctggattaatgagtgagtatgcccatggggctgaactatttagtattaagcagaaacatttttataccatgacactgagaaccaggttacaagtctagtattcctgtgacttttttaaacacagaagaaaaagtttcctagacaaggattatgcgatgtattttagtcaactttctcatcaaatgtgttgttgggagtcacgggagaccaggtaaaataatgtagatgactcagtgaaggatacttgttgctaagaggaaataaataaatataagatgatgagtgggtaagtcagaaataccttttctgtgtgggaaaaatatatgctattgttattactattcatttgtataataaaagtgcctgttaatgtttatctgtgtctttcttaaaagcaaattaaaattagttcagtaaatattatgtaaaatctgttattcctaaagtccttatttctgagaaactacatgaaaataccttataaaaatttttcatgtctcctatggtcatccaaatttatgtaaagataatagttttggtaattactctacaaagattaaaatttagttggtgatttaaatg

SEQ ID NO: 252022 - DNA, 430 bp, Homo sapiens
ctctcctgtgccctgtatacttccattctagcacccatagttctattgcagtttatttattttcaagttcatatcctggtttgaacacttatccattgtgtggccttagaaagttacttcacttacaagaacctcagtttccagctctatagaatgggattatagtaccaacttcaaagagcaccttcaacaaaacatatttaaagttaaatttaaatctttaggtagctcttaattttctaccagataaagtccaagcttcttaaaaaggcccttcaggcaaatagtcaacactcaagtggtaactgttagtctcttttactttctcctgagcaatctcatttttatgtgatggtctagtagactgttttgattgcaagacattacaattaaactagcctaatcaaaattacaattaaactggcttaat

SEQ ID NO: 252023 - DNA, 451 bp, Homo sapiens
aactgttcctcagtgtgccatcactgaattgactttcactgttccactcatactgttaggctgaacactgacattccatagcctacaactataaagatacctacctatgtgagtttaaaaagtgatctgcacaaaagaaataaaaaaactttatatcctcgtaagcttaacgaggaggaaggagtctctctcctccagaccctcattgaagatctcacctgaagatgtcaggcccaccctgaataatctcccttttgattaactcaaagcgaacagattaggggcttagttacatctgcaaaatcccttcaacttttccataggtatagattagaagcaagccacgggtcctgcctacactccaagggagaggagattacacctggcatttatccagggcaagaagctaaggggtcatctcagaattctgccttccaaatagatcctcggt

SEQ ID NO: 252024 - DNA, 412 bp, Homo sapiens
cctttccaaatactaaagtgcttaaaatctcatttattctctgataaaagaatttgcactttgggaggctgaggcaggaggatcccttgagcccaggagttcaaggccacagtgagctgcaattgcatcacagcaatccagcctgggtgatggagcaagagcttgtctctaaaaaaataataaaataaagtgtattaaggttaatgcttctgtactaagatagcagtttcaagtgtcaaaaccatacaccatcaaaagcaaattttcctcttaatcattctgataaacggtccattaagtgggatctcacatgaaacagattcacaaggtaagtgtgacaaagcccaggttgcataatataggctatgtttattaaataaacagcattattagcctagaaaatgctagtgta

SEQ ID NO: 252025 - DNA, 668 bp, Homo sapiens
ttttgctttatagcaccattttctacaaacgttattttttctggtaattaacaatttaccccctttctcacaaacttagaaagtgagggagttgtgtacatataaaaatgtgttatttttaactgtatcccacagagtccccagattttgaagaatctctgatgggtcactagaggtggggaaaaggcagcaggagcctggcagggaactgactccaactccctctattctctccacaccttgaatgaaagaagcttcatttttaacttttacattttgggcatgatgcaagtcttcctatgacctcttccagcttccagcatagttctatgcttagcaaaacacttgcttgtattaaatgcttgctttgcattttagccaagaactttaccctcattttacctgtgtagagatcatcctttgaagaagccaagaagaagaatttactcaaggataaatgattttcatttttttcctcttatggcatttgatgtaatttagaagttttcaagtcatagttaaactgctttttggttactcatgctctagtaccctactactaaagtaggatttgtgggtaaaaaaatcaaatcagttaggaaagtgctgaacattatattctacacaactttcccaaaggattcacagtgtactttagcatgtaaaat

SEQ ID NO: 252026 - DNA, 659 bp, Homo sapiens
ctgggacacgagtcagcagcactggccttctttcccagcaagaaatcagccagtgtggctgctcactgtcatcttagggctggacttggatccccagggtttgcatttggtgaatcatgccactaaatgcctattacttcttaaaaatcagaattctctccccaatgataatacttggtataatatttggtggtcttttctaatagttaccttccaaatgagaaaaaaaagccaaagtaattttttttaagtttgattcatcttgcctgtgtttgttagggtggagttgagtccaaatgtgagaaaatgtatcacatattggcatatgggaagtaattcaggcattcttgatgtagtagagaaattttagtactaataatctcatttattttcttcaatatttcttgaaaagtgcttattgactgtgggccatatgaaaacctaaactttcagactttatacttccaaattataatattatttcaagtggtggaaaaaaagtttatttaaaccagatgagcatcagcatttgatgacttatggacacttagtagctgcaccatcttgggcaagttacttaaccttttccaggtcccactttttaccctctgtaaaatagggctgataatattaccaactcacaaaatagttataaggat

SEQ ID NO: 252027 - DNA, 559 bp, Homo sapiens
attgttgcataatattttatgaagggggacaccaggtcattgaagcaatggatttggatgtaatctcccaggaaaaatcttgagttagaatagcagagggttgagagaaagtcccaggaaagacaaatatataaggagttgccagagttgaggaggtcctccaagagacccagagatacagaaagaaaattagaagccaatggagaagtttctagacagaaagaggagtcaagatagaaaattccacagaaaatccagggtaagaacagaaaatatttcttaagtggggtgatatggacattaagtcagagcagtgttagaacaggtaacttatcccagtttctatagccagaaagccacaaaaccagcaatagaactcagatccttgggaacattcttgaaacgatcttcaaccatggatgaagttggaggtggacactgttctgcagctctacagagaataagaagccaggtcttcaacattgtaatcaggatgattttgattgaataattcaaaagtatcttctgattttcatggttataaaaggttaaaatgaat

SEQ ID NO: 252028 - DNA, 458 bp, Homo sapiens
aagaaagaaagaaaaatgcttccaaaagacagaagacaaagaaagagaatgggggtttaggtgagaaagattgtctttgatggtagaataggcatctgaagggtaagtactagttataaatgttagccctggacagatgttaacaccagtaaagtttagttacagagtaaaacctcagtttgtttaactttatagaacaaatggagaggaagacagagaatcatttaagagtggactagagagatcagattttgaaatagctatatgcatgtgtttgtttttgagacagggttttgctatgcccagggtggttttgaactcctggagttcaaacctctggagtagctgagactacaggcatgtgtcactgcacctggctgaaataattatatgttttaaaagaaaactgttgctccttcctttggagctgtttagctagtaacagcagaaggaacttc

SEQ ID NO: 252029 - DNA, 426 bp, Homo sapiens
acaagaattacaagatagccccctttccatccttacacttttcagtataagaagctggtaatacaaataaaaagcacagtgtagggttgtttgagaaatgtctgtgtgggtggagtggatattagtggagggaggagagaggtgtatgttagaagctgataaagcaagttaaagatggctggtagctaaggattcagaatgttttagatagaaaggcctagataggatattttaatatttaattaaaggaacaaagaaaaagttttatctacttttcactgaagggaatgttggccaggctgggcatggtggctcacacctgtaatcccagaactttggtaggctgaggagggcagattgcttgcttgagcccaggagtttgagacaagcctgggtaacatggcgaaacactgtccctaaaaaaaa

SEQ ID NO: 252030 - DNA, 321 bp, Homo sapiens
atatagtatttatattttattatagttcattgtatagtatttcatttgaagaatttattatctctctttataattaagaacgtacagcttttatgaagaaatcatttctcttttccattgtaatttgtaccacatatatgtgcttaactatcattggtgaacctctaattttttggatggtaaagacattcaattttaaatcaatgataagaatggatctttggggtaggttttatttcattatgaattcttattttatgcttagtagaaagcaaatagaattgttgttagttaatgatgcacacaataaaattggagtga

SEQ ID NO: 252031 - DNA, 426 bp, Homo sapiens
actagataaatattttaaaatgttttgttaagtagaaatgatcaaaggggaaaaaaaagcccatttcaccatgccgaaaaccccactttacaattctatttccttcccttttatacttttacagcataatttcgtgcttgtatattaaacacattcataattagcactagcttctaaaggagaattgaaagactcattcagaacaatgaagggtactagcacaacttaattgtaacatcaggtattctttctaaggggctggccttgaggatctggtatgtctgtgaacagcacaggagctgggggactgggttgggatctacaagccctcaacctttgcagaccatgcaggaaagcttaaagttgaaggaaaaaaatgtttggaaattttggactcacaaattttcaagccactcccgtaccaga

SEQ ID NO: 252032 - DNA, 404 bp, Homo sapiens
agtgtttcatatcaacaatgaagctacagttgttcattgaccaatggtgaaagagctgaaatgattctgaatcaaggagatcgtggtaaatagtgatgataaagtctacattgtcatcagaaaaagtgcctgtagatgacatggtgaaaatgtgtgatggggcttttgaaggactagggcagaatgcattcataacaaaacaagaaatcgtgtcagtgtataaaatctaagaaaagacttctaagataaagccttgttaatgaggcagatgactttggaggaaatagtttaaaaaaaccattcactggaatgccttctcatccctaggtatttatttcctgatccctcaactgtttctgatgtttttttctcacctgaaaaaataaaatacaatgtacaataac

SEQ ID NO: 252033 - DNA, 472 bp, Homo sapiens
ctgatagtgaaatggctatttttggtttgaagcctgtcattacaacttattgttcactaatctgactctggaacttattttaagcccccttgtctcagttttatcatctgtaacattttcctaataataatatattgctcatgggataattttaagaataaaatcagtgaagattttttgtatatgaatttatttgcaattgtgtctcatagaatccctcagaatattaaccacttactgttccaagactaaaggatccaaagtaaaaattgctttaattaagtccatggctaatcaatatgcaggattattcagcagttatttgcccataatggtcaaataactgcacttgtttatatagatttcttagagcttattgtacacattcttgaaagtagtaggaatagaaatacaatcaattcatttgaattttcagttttggtggtaaattgaagtgacatgcaagtaaaaa

SEQ ID NO: 252034 - DNA, 447 bp, Homo sapiens
ccaaagctctttttctcacatgcaagaagaaatcagtgagtccacaagttaccagaaaacagctttgtatctataattgtgagaggctttgacagtttatgtgcaggaagttcccccaaaacagggatgctgaggcacagggtattaaaaacagatacaggaaggaccatgcaacttccttactcccactctccatgttctcaatcctcaagtctctgtgggacaggtctagaaatttcagagaagaaagatatttagatagtggcaatcctgacacatgaaataaaatgccatgaaatttgagggagagaggtagaaaatttaaggatgagaaaaatgaagaagaacctttggttgtgaagtatttttgtgattgtccatttaactgtttatctactgataacctgggaatcggaataagctatccattactgtcttttgaaaagc

SEQ ID NO: 252035 - DNA, 271 bp, Homo sapiens
actggacatcaagaggagcacatcagcggaggaacacacagggagaggaacacataggtggctggacattgagaggaacacactgacaggcaccagcatgctggtaggccactgactgacagaacaatgcagagtttggctggggcagctggaggacagtctgggccactgagcagcctgacttcaggggaaaaccatctcccttctgactctcccatctgctggtagctatttccactcaataaaaccttgcactcattctccaagccca

SEQ ID NO: 252036 - DNA, 466 bp, Homo sapiens
cgtaagcagcagctccgatcaattctcctttgcgaggtgaccaccaaaggactgcagagctggccgggcattcgtgcgtgttcatgaccgagaacttttcacacagagaggacttctgtcctgacgaaggagcgcagagctggccgggcattcgtgcgtgttcatgaccgagaacttttcacagctaggacttctgtcctgacgtctttattgtataatagttgcgtttaaggctgcagacttcaagtttatatttctctttatgtaacactctgttcattgttgattctagtttattgcattgtagctacaaagggcaggctctgctgcgttagttctgtgaagttccccatattgcctggtatgtggcctattttaaaactattccatgtgtatttaataagaattagcaattaagaattgttcattgtaacaattataacaatataattgtttaccttttgag

SEQ ID NO: 252037 - DNA, 161 bp, Homo sapiens
ttagaataaatttcaaattttctattatattagctttattatcagtgatagagggtacttacatggtcaagacccttagagtaagttaactcccaaggaaatgtagttagttccctttgaaatatttacaaataaatgttaatattcagcgtcaaatcata

SEQ ID NO: 252038 - DNA, 479 bp, Homo sapiens
  misc_feature (4)..(4): n is a, c, g, or t
accnggtggcgttcgctctagaactcccggatctcccgggctgctttaattcggcacgtatggcacagggaggggcctcccagagagtgctacaactggtgtctgctccagttggtagacatttgtggcaaaatgatggttaaatattttgaagattatccctgactgtgtctattttaggttagtttgtaagtaagggggctgacacttagaagttagtagtttctatattgagaaatgtgaaatgtgcaaagggctacccgcatatgacggtgattacttatcatgtatgagttgaggtatcctttttgtttggttcacaagacatctccattcatttcttctccagcctaagaatgctgtgtgctttgtacttgttttttaaattaagacgaattaaactatacaaagggaattggtaaatggattatggagtgttattacaatgaaatacagccattaaaatgatggatatgctg

SEQ ID NO: 252039 - DNA, 638 bp, Homo sapiens
tatagctgttctcgaggatccccgagattgaaatgtgttggaggggggtgtagggggtcggaggaaaaggttggggaacagctaaataggtcgttgttgatttggttacaaaatagtagggggatgatgctaataattaggctgtaggagaagtctggtaataagtagtcatgccaggattagtattattacttgtagtagtagcatcagtacttggagaaggagtagtcacaaaaggaacactattaccaaaagaagtagttgttatggaaatactattactagttatattaccagcagacattgtagctaaaagaaaatttgtcatagaagcatcattatttgtgctagcaacatcagtacttgtaggagaagtagttgccataataacagtagtgttcatagcattagtactttcagagaaagaagtggtcataatggaaaaactgttgctagtagtgtcaacaccagtatttgcaagagaaggaatagctgtaactggaacagtattattaggaacagtatcatcagtacttgtatgagaggtagcagttatattagcaacattagtactagtgctagcattagtagtatttgtttgaacaggagtacttatattattaatagtagtactagtg

SEQ ID NO: 252040 - DNA, 367 bp, Homo sapiens
acaaataatgatgcttctatgacaaattttcttttagctacaatgtctgctggttatataagcatcattatttgtgctagcaacatcagtacttgtaggagaagtagttgccataataacagtagtgttcatagcattagtactttcagagaaagaagtggtcataatggaaaaactgttgctagtagtgtcaacaccagtatttgcaagagaaggaatagctgtaactggaacagtattattaggaacagtatcatcagtacttgtatgagaggtagcagttatattagcaacattagtactagtgctagcattagtagtatttgtttgaacaggagtacttatattattaatagtagtactagtg

SEQ ID NO: 252041 - DNA, 537 bp, Homo sapiens
atacatatagtgaaaacataattcgtggggtttttttttccctgagttttgaatagtgctgaagtatataaaatagaaagtgtctctgtacccttacttccaagtctttcctgaggtgatggtcagtgcatcttcttctggacatttgtctatgcccttaaattcttttctaacctgcaacctgagatttttctaacaaagagatacctgtgcacctgaacatgccctttaagataatccttttagttaggcatggtggaatgcacctgtagtcaggaggtaggcaggagaatcacttgggcccaggagtttgaggttgcagtgagctatgatcatgccactgcactccagcctggatgacagctagaccctgcctcttaatttttttttttttaatttttaaaagttagaaaatgaccgggcatggtggctcacacctgtgatcccagcactttgggaggccaaggtggatggatcccttgagcccaggagttcaaaaccaggctgggcaacatggtgaaaccccctttatacaaa

SEQ ID NO: 252042 - DNA, 672 bp, Homo sapiens
gtacttaagggtgctgaaggaaatgattcgaggggatttggccggtcattttccgggggcaaaaattaatgtttacacccctggaatgctgtgggagggacaaaaagactcacgtatatgttctgtcaaatcggagaagtaaataatccattgggatgccaggatactttattctacagcgaagttaattttgtatccgtcgaggctacagtagaggttaaatggaaaccacccttgggaactggatgcctgtgtagctgttctaccatatcagtgtattgcaatgagtgggggaggagagcagctggatatcctgagtgttggaatcctagtgaaagaaagatggaaagtggtggaatcagctcaacaaccaaaacaagttctgaaaatggaagttgctgttttgaaaaagctgcaagacaggttctcattctgttgcttaggctggagtacagtggcacaatcatggctaactgcagtcttgaactcctgggctcaggcaatccttctgtctcagcctcttcagaagctgggacttcaggaggctgaggcaggagaatcacttgaacccgagaggcctgaggttgctgtgagccgagattgcgccattggactccagcctgggtaacagagtgagactctatctcaaaaataaataaagaaataaatttg

SEQ ID NO: 252043 - DNA, 1152 bp, Homo sapiens
agcgggagaataacgtcgggtcgggtcagcgggctctgcagtagtcgccgcagcggcgatgggagcggtggggacgaggcggcggcggcggcaggagggggagcaggtgctggcacaagagcagcggcttgggggagccggcagcagcagtaacagcagcagcagccgccgccgccgccgccagtaaacgcggaccgtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggtaattttggg

SEQ ID NO: 252044 - DNA, 1047 bp, Homo sapiens
agcgggagaataacgtcgggtcgggtcagcgggctctgcagtagtcgccgcagcggcgatgggagcggtggggacgaggcggcggcggcggcaggagggggagcaggtgctggcacaagagcagcggcttgggggagccggcagcagcagtaacagcagcagcagccgccgccgccgccgccagtaaacgcggaccgtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgcctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggtaattttggg

SEQ ID NO: 252045 - DNA, 1016 bp, Homo sapiens
agcgggagaataacgtcgggtcgggtcagcgggctctgcagtagtcgccgcagcggcgatgggagcggtggggacgaggcggcggcggcggcaggagggggagcaggtgctggcacaagagcagcggcttgggggagccggcagcagcagtaacagcagcagcagccgccgccgccgccgccagtaaacgcggaccgtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgggaaaatgttgcactgaaggtggaatcagctcaacaaccaaaacaagttctgaaaatggaagttgctgttttgaaaaagctgcaagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggtaattttggg

SEQ ID NO: 252046 - DNA, 924 bp, Homo sapiens
agcgggagaataacgtcgggtcgggtcagcgggctctgcagtagtcgccgcagcggcgatgggagcggtggggacgaggcggcggcggcggcaggagggggactggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggtaattttggg

SEQ ID NO: 252047 - DNA, 686 bp, Homo sapiens
gccaaaagctcactaataaagttctgatcacgtagagtgactgcctaagaattgaccaacttcagactaaattttctgaggacataccttcttgggtttctttctggcatgagagactattttattagattcttggattcaattatagtcaccagaaaaagcaaggttataacaaccacgctttgtgttccagagttgtcttagttaactcagtattcatttgaggttttatgttacaaatcccattaaatctttctcaaaatagcccttctctgaacatttgatggaagaatatttgcaggaaccaaaaccatttgatatatacaccggtatatgtcaggaaggatcgtgatacaggggtgccttttaaaagtgggttattatacgacagaattcttccaggtccctgactcttgtcttctgaaaaaaaaaaagtggagatcttcagaggactggataaagacagaatggatggggtgaattatgtaaagttaggatttagactgagggtttacagggctgcagtctcgttttgcctcaacagtcagacttgcccagggtctggcctaataccatacaaatgtcatatccacagtggcattgatacagtggtgggaatggggcatgggggtgatgagcatagcttcttgctgagtgctctggtccgggtgagcctgagatcttga

SEQ ID NO: 252048 - DNA, 3835 bp, Homo sapiens
gggggagaggaggggaaagctagacctgcagagtgaagaaagctggtaatagatgtctgacaaactaaagaaagacttgtgttaccacaattcagacagcccggaatatcaagattcatctttttcactaattgtggcattcacagatgcaaagtattgttcctgggtgtgtctgtgagagtattgccaaaggagagcagtgaactgggaaaagcagacccacctcaatgtgggtgggcaacatccaatcggctgccagctagaataaaccaggcaggagaagatggaagagccgacttgctgaatcttccagccttcatctttctcgtgtgctggatgcttcctgccctcaaacatcagactccaggttcttcgtcttttggactctcggatttacatcagtggtttaccaggtgctctcaggccttcagccacacactgaaggctgaattgtcggcttcccgacttttgagattttgaaacttggactgagctactgctggcttccttgcttctcaacttacagatgggacttcacctatagatcatcaaaggtggacttctgagtcatggacaaaccagaattcttgcccaccagtggtcccacgacttgatttgggaagccttgttgactctgatgatgaggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaatttgatgcagtaagttgtcagcatttttacttatttggaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgtaatggacgtgatgcttgcagagagctcattgggttctttttcactcatgaccaatcccttacaatttatgaatatcgacaatttgggaaaaatagaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggccattcaacagaggaagaaatcaaatcatcctttctagaaacattaaaagttgcctgcagcaagtctgatgaagtgtcatatggtgaatttgaagattactatgaaggtttaagtataggaatagtagatgatgaagactttgttaacatcttacgtactccatgggggatttagtctttaataatacatatgtcatcaacactaagcattttattggagagatgatatcaatgtaaaggatgatcaaacactggaatatattttcctaggacttcctttattctggtttcttgtttgtttgttttgttttgttttgttttctcaaaaatgttgaatttggaaagagaactatccagaaagatagatgtaggggtgtgttagtgtttgtgcatgtgtatgcctgttcacatgtccttacatttgtaaagatatctttttggtttattacttatcttgcgtatattttagaggtcattttttattaacttcagtaggaaagttacatctgcatcaaacaatatggcaacatctatttattaaccaagtttcctgtcctttcacattgttttttgctacctcttcctcagaatatatttgccaccatggtcaatttgataaattagaattgggcccaaagccagtgagataattcaatgtgtttttaacacatgaaaatattaaaggatatgcaagagaaatttttcaagcagtgtgattatagatgttttctgtatatagaatatttcaaatgatggaggtttaccccatgatgctcatttaaatactgacttgtcttttaaatctgtcttctaaattatgtactgttgttggttaaatagagcacaatgtagttattctaatgcccagttgtatttgttcttttattctgctttttaactgtaatcctttttaccagcatacgattgttattgagcaatatgaaagggaaatgttctttattaaaatcaatacattatcttattaaacaaagatcctaaaagtatattgttgcatatatgaatccaaggaatagttcagtaattattgcctaaaatgtgaaagcatattttgtatcctaaaatgaatgtatgatattctaaacatctgttttagtataacaaacaattgaaacatttccttctaaatatatgttatttaatagttacatgtattataatcattctttctaaattctttgctagtcatttcttcctgggaatacagagaaaagagacaactttatgagttgttttcaacttcataattttaaattttctatgttaatataacataaattagaaaaaataagtgattcaaaatgaaaatatttactttgtagaatatgactttagacatatcactgtatccatctatacttggcagcaacatgagaagtgtgatacatgtgaacccaacaaattcaaagttgcacttttcaagatgtgagaaggtactaaaacttaatactaaaacatgagagggaaaatatgtgtaaacctctagtgctattttcactggctaaattctttatttcttgatttttttaaaaattaggttattaaaattaaaacaatatgctagaagacattttggcagaaataagtctataacactatttttgtcacatatctttttcttggaaaaatttatccaactatagacatcttaaaccctacaaattgttcttgttaaaaatgactaatactgggggtgctcaatatgcatatagtgtttttcattgataatttttatttagttcttaagaaacctgttcttaatgttggcatgtcacatttttctgttactataatcagaaaatgtatagtctgttatactgta

SEQ ID NO: 252049 - DNA, 587 bp, Homo sapiens
acaggtaaaccccaatatcccagtggcttcataaggcagagtttatttcttcctttcatgaagtccactgaaggactacagctctgtaaggcagctttcctccaagctgtgacttggggatccacgctgctaaaattttgtagccacttcatttgaaacaactggctttcaggctgctggaggagaggaagagaaaaggaaaggggtatgtgcccactttctaaagttgccacttctgctcacacaacctcgcaaagccgcaaggagcctggagactgtgggggaagcacatgaccgtcgggccagtagtgcctgtttctgcacagagaaccctgggctggctgtgctgcttcagcaagcattgtgccttttctcttccgctcagcaaggcaaccaatttcccttttaccttgaacaggattcctgaatccaggccgacaaagtttcggggcaaagtccagacctgaacagaagcttcctgacacttagtccagcgccgtctttgacgctaaggaccacgctcaattgtccctcccaacaggatgtggaggagcagtcctggactctgaacggccacccagacattc

SEQ ID NO: 252050 - DNA, 429 bp, Homo sapiens
ggctccagccagttggcacatacctggctcagctctacaggaggaggggcaggaaagaagccaaatgtctctcacaataagaaaagcccatcatctgcaagatcattctcaggcacagggcaggctggatctcctcccaaattgcatgctccatgccaaagaggtcaagccaccaaatgacactgacttcctgcctttaagagctttatctctgcggacctggagctgctggtcaccatggaaacagaagcttttgttcaccacttcctcttctctttttctcgctccccacccctcgtctttccttcctctcctcacacccacttgccctcctctctactttctttcctctatttttattcctaattttctatctcacttgccctgatttcctcatctatttatttaaaacttatttaaattttatta

SEQ ID NO: 252051 - DNA, 377 bp, Homo sapiens
catctgtattgagttgagtagtgtccctccaaaggtatgtccacccagaacctcagaatgtgaccttatttggaaaaagggtctttgcagatataattaaggtaagagtttcaagatgagctcattctgaattagagagagctttagatccaatgatgagtgtctttatgagagacagagaaggagatgacacagaaacagacaagggcaaaggccatgcgaagttgaaggcagaaactggaatcatgcagccccaaccaagccaaggaacaccaagaattgccagcggccccagaagctaggaatgaggcatggaacagactctccctcagagcctccagaaagaacaaaccctgccagtaccttcaatttgcact

SEQ ID NO: 252052 - DNA, 316 bp, Homo sapiens
agaggcaaaaagaggcaaaacaaggaacataaaaatagagaatctacaaattagcatgttataattactctcttgcatagcatttaaggacatctttgaaaagattcaatgtcttcagcaactgtatctaactagcatgtactataactcaaattgacatgattcctaaagagaagcatcgggacaactcttctatagtgatgaggcattactgaacaatgtttttggttgataaacagtaatagaaatttgggattaaaatggccttttcaaaggagtaggtcattcctatgaaaataatagatacttaaattta

SEQ ID NO: 252053 - DNA, 1223 bp, Homo sapiens
atggagttttgctcttgttgcccaggccagagtacaatggcactatcttggctcacctcaacctccccctcccaggttcaagcaattctcccgcctcagccttcccgagtagatgggattacaggtatgcgccaccatgcctggctaattttgtatttttagtagagatggggtttctccatgttggtcaggctggtcttgaactcccgacctcaggtgatccgcccacctcagcctcccaaagtgctgggattacaggtgtgagtcaccacgcccagcctagagtagtcaaattcttaatgacagaaagtagaatagctgtcagaggccagaagaggggataatgggaagttactgtttaatgggtagaggtgtccaattgtgaatgatgagaaaagttctggagatcatggtgatgatggttgcacaacatgaatgtatttaatgccacagactgtacacgttaaaatggtaaatattgttaatgtatatctatatgccacacacacaaaaagttttaaattgccaaagttcccaaccagcagatctcatgctgttggccaatctgcagggtggcaggagctccattgactccttggggaaagtatcagaaggctgctggggatggcactgggaccccccctcctcctagtgacaaggaggcttcttcagaaataagaaaagctactcattaatgatcccacaaaaagtttgggaaccactggacaggatgaacatctgcaaggattaatgctcttattctcatgatctctggccaggccccacctaggagctaattcagtaggaaatttcattcgactcattggtttttgctttttttttttttttttttttttttttttcaaacagtaggtacatacacacagattaacagttcaaagatgctggtcatctccatgcacaccaagttcagagcagtctcctatgcaggggatggaggggactccgctggggtgggcccttgggacctttggctatgtgcctaatgctgctctacagcccagccacacgtgaatatctgcagtgcatggagttacctttagtacctgccagtctgctggtgtgaacggtgcctcactgtgagtaaatgtttcccatatccccggtgaggctgaacccctcaccacacattcactggccagtctggattcctcccctacatttttttgttcataccctttgcctatttcctactgtgctat

SEQ ID NO: 252054 - DNA, 1170 bp, Homo sapiens
atggagttttgctcttgttgcccaggccagagtacaatggcactatcttggctcacctcaacctccccctcccaggttcaagcaattctcccgcctcagccttcccgagtagatgggattacaggtatgcgccaccatgcctggctaattttgtatttttagtagagatggggtttctccatgttggtcaggctggtcttgaactcccgacctcaggtgatccgcccacctcagcctcccaaagtgctgggattacaggtgtgagtcaccacgcccagcctagagtagtcaaattcttaatgacagaaagtagaatagctgtcagaggccagaagaggggataatgggaagttactgtttaatgggtagaggtgtccaattgtgaatgatgagaaaagttctggagatcatggtgatgatggttgcacaacatgaatgtatttaatgccacagactgtacacttttaaattgccaaagttcccaaccagcagatctcatgctgttggccaatctgcagggtggcaggagctccattgactccttggggaaagtatcagaaggctgctggggatggcactgggaccccccctcctcctagtgacaaggaggcttcttcagaaataagaaaagctactcattaatgatcccacaaaaagtttgggaaccactggacaggatgaacatctgcaaggattaatgctcttattctcatgatctctggccaggccccacctaggagctaattcagtaggaaatttcattcgactcattggtttttgctttttttttttttttttttttttttttttcaaacagtaggtacatacacacagattaacagttcaaagatgctggtcatctccatgcacaccaagttcagagcagtctcctatgcaggggatggaggggactccgctggggtgggcccttgggacctttggctatgtgcctaatgctgctctacagcccagccacacgtgaatatctgcagtgcatggagttacctttagtacctgccagtctgctggtgtgaacggtgcctcactgtgagtaaatgtttcccatatccccggtgaggctgaacccctcaccacacattcactggccagtctggattcctcccctacatttttttgttcataccctttgcctatttcctactgtgctat

SEQ ID NO: 252055 - DNA, 484 bp, Homo sapiens
catgtgtctagtgttttaggaacatgaattcaaccatacctgtgtgtgctattcaccatgtggcatcagagatgaatgaggcagaatccctgctcctaaaacacttttcatctaggaggaagatttttgttttaatggtatcaatagatttattaaagttaaaacgtgataaaggctatagtagatgattgaatgatgcagttttgaacacttagaagagagagaagttgcttttggatgaggatcagaggcatttcattgagaaaggaatatattttgcaggtcctgggaggttggctagaatttccatagcagagattggcgttaaggaaaggatcgaaacccagacaaaggaaaatggaggagggaaaccagggcatgcttgtaaaatggtaattattcgactcattaaaggtcgttagaaaaactctgacccttggagagcgagaccatcctggctaacacagtgaaaccctgtctctac

SEQ ID NO: 252056 - DNA, 437 bp, Homo sapiens
gggattacaggcgtgagccacgcgccagcccacttacctgaaattcttatctgaatgtttgattaacatagttgtccctgttttgagggaacaaatatagacacctgtcaaacgaagacataactagttgtttacagtatttgagatgtgtgaaatttcaaaacaaactcactttaaattttttatagtattgatttgatatgtataatgaaaatgcattaaaacttgtacattaggagatcttagtacaatttacaactgttaatttaacatgtatgtgtaatattatgttacccattcaatatgtaatggagacttaatgagtatttcttttttatgtataatcttaaacagtaatacaacctggctatctagatgaaatcagaaatgaatgtagtttataaaggttgtgttgtgaggcatgctcctcttgcttt

SEQ ID NO: 252057 - DNA, 451 bp, Homo sapiens
gcagcagggtctcactctattacctaggctggagtgcagtggcgcgagcatagctcactacaccctcaaactcccagctcaagtaatcctcccgccttggcctcccaaagtgctgggattataggcatgagccactgtgctcagcccacagaaactttcataatatgtatatgtagctgattacatgtatttttgatagtactatcaaatttctataaatttcaattttttttttctgaaaatacgagaggcacacgtccctataaactacattgctaatagggaataatataacctttaatatctctgtcctgtggtaaaatgcaaactcaatttaacacaagaggcatgaattgaatgcctaccatatacaaggtactgttctctggtaaaagcagtcaaaaagagcaaaggaaaaagaaaattaaattgaatcttcttttttctgtgt

SEQ ID NO: 252058 - DNA, 714 bp, Homo sapiens
aagcattccttccaccacaacctcccaaatagcccagctaacttttaaaaaaatttttgtagagttagaatcttactgtgttgcccagtctggtcttgaactcttggcctcaaggaatcctccttccttggcctcccaaaacactgtgattacaggtgtgagccactgtgtttggccatatgctgatattcttcatggtatcatacacgtctttcaggctctgttcgttttttggttttctttctgtttctcagactgtatgtcaactgatcaatcttagagttcacagattctttgttttgctagcttacatctgctgttgagcccctttattgaatttttatttcagttactgtgcttttcaactgtagaatttcaatttggttcttttaataatttctatccctttattgatgttctctatttggttaagctgtaattctctttagttctttaaacatggtttcttttagttctttgaacatatttaagatagctgagttgaagtctttgttcaaaatgtacagtgccttagggataatttctactgaatgcttttttctctatgtatgggtcatactttgctctgcatgtctcattttttttgttgttgaagaatttaaaagtttgttattcttaccgtgttttgtacttgttgtctagtgacttttctgaactgattttgtaatgcttgtattctttgccatttgtggc

SEQ ID NO: 252059 - DNA, 423 bp, Homo sapiens
caccttgcttccctggtctttgcctagtggctggcaatgtttacaagtgtaccttactttatatcaacatgaatttgtgaaaaagctgtatgtcaatggattttttaaaaattaaaaatgtattttgaatgaccctaagggagctggctctttaaaagcatcctaaggtaaagattttttttaaatgaagaatctttttataaagcaatgaacaatctctgattttataaatcttaattttcctatgggttttcttaaagtgaaatacaattataagaatacattttaagggtaacattaacaacctagaacccagtttgggttactaaaaataaaatgtcagtattatcaattgataactaccacagttttatactctgcaagtgtgtactgcatgatggttaaggaaaaacaaatttattt

SEQ ID NO: 252060 - DNA, 490 bp, Homo sapiens
aaattcagaacgatgcttcaaagtttatattggtggtttgaagtaattatttcatggaaaattgaaaatgcctcattaaaaactgatttcctcccctgcctgattttcttattttattgaatccatatgttgatcccaatggcaacaaaccacacttcaaatttcaaatgatgtgagcaattttgccgtccattcctttgtttctttgaatgatgaaaagatttttattttttttcaattcaatttctaagcctatttcttaagcaactaagctgaggctttaaaaatgtccatagatgaggtcaggagatcgaggccatcctggctaacacagtgaaaccccatctctactaaaaaaatacaaaaaattagccgggcttggtggcaggtgcctgtagtcccagctactcgggaggctgaggcaggggtatggcatgaacctggactgcactccagcctaggtgacagagcgagactcagtatcaaaaaa

SEQ ID NO: 252061 - DNA, 435 bp, Homo sapiens
tctcttttctgatctttgaaaaaaaagatctaccaatgaaattaagggaggctcactacagtctttagactgcgtctgatactcgtaatactaatcacattaacagtgctgtagagagataagaaatagcactaatgccagctaagtgtgtttttagaaaaatcaaccacagcaaccccaaatgtttcctggtctccagagcagctgttggcagaggcggtttgaatgggattccttgtagccaagagaccttataggaggtctgtagagatgagtcatgtgtgagcttgcagaaaaatgtctcccaaagtagcccggattggagattgccttgagtgccaggctgggtcttacctcaggccagctgagcgtgttccccatggccaggataagatcacgctctggaaagaggagaggcctgacaacccaccgcct

SEQ ID NO: 252062 - DNA, 324 bp, Homo sapiens
tctcttttctgatctttgaaaaaaaagatctaccaatgaaattaagggaggctcactacagtctttagactgcgtctgatactcgtaatactaatcacattaacagtgctgtagagagataagaaatagcactaatgccagctaagtgtgtttttagaaaaatcaaccacagcaaccccaaatgtttcctggtctccagagcagctgttggcagaggcggtttgaatgggattccttgtagccaagagaccttataggaggtctaatgatgatgatgatgatggaaggcacagctgctttccacaaagtgtccccggatcttgg

SEQ ID NO: 252063 - DNA, 559 bp, Homo sapiens
  misc_feature (105)..(105): n is a, c, g, or t
tcggctcggtacgccgtcagacgctgaactatgtgaatattctttttcttgtatttcctgaggggtgccagggcctgggatccagcgaacatctctgcttcatcngccccaggctgcccagcctctgccagtcttgtgggggaaagggggtgacagtgtctctctgtggaccagcctgggtaacctagggagacctcgtctctaccaaaagcacacacaatttagccggtgtgggtgtgtgcatctgtggtcccagctacttgggaggctgaggtggggggatcgcttgagcctgggaggtggaagttccagagtcaagatcacactactgcactctagcctggacaacagagtgagactctttctctcaaaaaacaaaaaacaaacaaacaaacaaaaccccaggccccacaccccgtgatttttacctaattgcctgggtcatttttatgtggagccaagttccagaaccactggtatcgaaggttttggagggcatcagatgagctaattagttgatacacatagttcagcgtctgacggcacacagacacttgcg

SEQ ID NO: 252064 - DNA, 370 bp, Homo sapiens
agctttcatgcatatatgggcaattggggcatctgtgatgaagtgctgttgacagaagtatggcccgtggtaacatgattgctataataaggaaccatgaagagcctttcacctctagccatgattctgagaacttcccagccatgtggaactatccatctacaagtatattttttcattacaaataattcaagaaaaagaaatcattgaagataaatgaaacattgtattacattttatgccaggtattttgccaaaaaaattgtttaaaaagaagccagtttaattagaaatatgaagtaactattgaattgttctatttgcaatgaaataaattgtaatcatgcaggaaaaatttccttagaacaaa

SEQ ID NO: 252065 - DNA, 480 bp, Homo sapiens
gaattctcagtttctttttaaagaattttagatcttccacttccctctggggcttccatataaaagcacacacacgcaggtctgaatgcttaacattgctcctttccttggaaatacattcagaagaaaccttctgaaggttttctatcatagtggtgcccagaagcaacatctatgtgtctggcctcagttgtcaaccatgttcctacgagaagtgtcctcagaaaatattctcagctgggtgagcctctgaagtaccatttccttttttttaatgggctgatttttcttaactgaaaatccactaccataagaatctcttgattcacagctccattggccacaccatgttctacctccagttatttctagaccaaattcttctaagttttgaatgaaccaaaatacttagtttagacaaagtatgagtacaatcaggcaccctgaatatcaatggcttggaatcactgtgctagtaaa

SEQ ID NO: 252066 - DNA, 459 bp, Homo sapiens
catgccccagccttctagtctatctccaataaccgggtttatcctctgctatagccaatttccttcctaatctgaatctctttagctggatatttgctaacacttgtcacactttcccgatattctgcctaatgaaacttactatcgacttgcttccatataaataattatcaactgatttataaataatacaagacaaataacaattattaatattatcatttgttaataaagagttacaggtcaggcacatttaaatatgtgttttgtttaactttcacaatactgcaaggctgattttataatcggtattttctgggttcaatttctttattctttactactatttttattccaggctctcagctcagaagtaacctgcccaagatatcccagacagctgggagatgccaggattccccagatgctgctattcatgctcttctatgtcacattgtt

SEQ ID NO: 252067 - DNA, 499 bp, Homo sapiens
gtggcaatacctgttagtgtaaaattccaaccctgatgacctccttcctcttttgtccagaatctcttctggcctgctcatcccctgatgctatacttcaataagaggcatctgttggccattttaaacatttcttcttgaattaaggtcaaaccattattattcccatctgggtagctttgtactttttttgattcctacagccacctccccacagccccatcttcctcaccccatcacgtacattggcagttcagagaaaaaaaaaagcagaacctttctgttctatcatgtgctccagatcagtgcttccaagggtcccattcttttctgcccaaactaattcttcattggagatcaaagaaacatattctcttcatttatgatagggaaatgcccctatagtgcattaaattcatcctgtattttcccatataaacaagaagagactttacattttttagataaaggttcttatcttttgcatgtattgaacaca

SEQ ID NO: 252068 - DNA, 486 bp, Homo sapiens
agatggacatgttccagtcacaggcatagagaaagttctctgtttggtgcccatcaacttaagtccttccttatacctggcagtgtcaccatctttcacagtcacagattctgccactttggccaggcgtctcattagtcccacccctcatcacaaaagagtctactggggacaggtcagcacaaacccaccaacgtgaccagaagcataactcacagaacctatcctgctggcagaggggagcaagggcaccaaggacagcctcatcccctggagaaatgtcctcatttgccaggatgcctcattggctgcttgaattggttggactcaggaagtctattagctctgagtccagagctgttgtttgagactcaagatgaaaaaggaggcaatttctacatttatctaatgcacagctaagagtggaggttgggtgaacctgatttcaaaagcaaactgagtattaaatttcaccactttttaaag

SEQ ID NO: 252069 - DNA, 714 bp, Homo sapiens
cgtgtttcaattattagtgttttccctgtggcccattcatgtggataagagacatctctgcattattatcttgtcagaaatacagcccctttcccttcccctcatctgattaggcatgcttctctttggaagcctcatcccatttggctaatgcatcttgacaactcctttaataagagtgcttggtgttcgcattcaaggatgtgtaggagttgacagaaatctaccttgtaatctttccatggcttgaaaataaaacccagggagacctagcacccgcatctctcaactcaaaaatggcgagaaagcttgaggggagagggatggccattgatttaacagaaacagttttatttgtttgtggtttttttcccttccttctgtgtgaaaaagctagcagagggagggaaaatttgggaagcagaaaatgtttcaatctacataaaaaagaggaaaataataacccaacaatgagaagagccaagagaatatgagaaggcagcctctttttgaaatagattaaaggctttattgcaagaacatcgtaggacaaaggtgtctctgcaggactgggaacttcagcaaagcacataaaacctcattctcagacttaaagacagccctggaagaggcagtccacaaagcagtgtgtgcctaggcacctattctaaattcaggagagctctgcagtcatttcctttgggggtgaggctt

SEQ ID NO: 252070 - DNA, 138 bp, Homo sapiens
ggtgggtggatcacttaagcccaagaatctgagatcagcctgggcaacatggcgaaatcccatctctagcgctgccccccacccccaacccctgccaaaaaattagccaggcatggtggtatgtgactgtagtcccag

SEQ ID NO: 252071 - DNA, 363 bp, Homo sapiens
cccgtctcttctaaagctacaaaaaattagctgagcatggtggcaggcgcctgtggtcccagctactcgggaggatatgtgtaggttatatgcaaaaaccacagcactttataaaaggtatttcagcatctgtgaatattggtatctgcaggggccctagcaccaatcccctgtgcatactgagggacaactataaacccagtaacaattttaacaatgaaatactcacttgcctcacctgttttttaaacaaacacatttacattatagctcaatggagcagacccttttctttttctgggatctcaaagattaaatgaaaagaaatagatcatactcaataggccgcatccccaggggggt

SEQ ID NO: 252072 - DNA, 161 bp, Homo sapiens
gtaaacactcattacctcttatatccaggcctagttgagggtgctggggatacaggtataaacatgacagttctcttgaggagcacagagtggttgtgggaaacagacatacagacacacagtttctttctttcttttttctttttttttttttttttgag

SEQ ID NO: 252073 - DNA, 700 bp, Homo sapiens
ggaaccctgtagtccaggaaccaggtctatttttccaagacggctttttaaagcattgactccataaagtcaaacttagttgttaaaatattggtcatatctgattcaaggcacatcagtctcaaatatgacaatttagtcaaagccttcataatataacctatgtttccaattatttcttgtttcaaggggaagagatttttattaaacttacgcaaatagctgtattgccatgaaaataagaatactcaataagagtttctgaattctgcagggcttatagagagaaaaagatgaatgtttcatttttgtttacagacatataatctactaaattgctgtaagtatagagagtttaagagaaaagagaaaggggttccttatatccccagaaaatagaacattagagaactaacaatattccaaacaaaaaggccacaaaaattttaactcttcttcatcaattcatttagtcctatgcaattcatttttgttttgcttgatcttagcagtttaatgaacccctatctcctctattagttctggaaatcttaactcagtctagtggtataatcatcaagttacttaggtaatgtaattagaaacctgtacttctgagtacttgtcatatccctttccgtgggtcttgagagaggcccttttgttaaacatgaagcactttgcccagttgctgattgta

SEQ ID NO: 252074 - DNA, 333 bp, Homo sapiens
gctgtatgctttatgctgttctgacaagactagattaatttggggtatcatgtttcattgaagcacactagccgattaatatgcccagagaagatgacagaatgatgaagaaagggctagcacgtgaaagaagtattagatttgttttgcataattccagaggttagaactattcccaatcagtagaaattgtagggaggtagaacctctagagaggttaagaaagatgcaatgggcataagaaataattttctaataattagaactgtctggaaatgggaagaaagggtgcaacagcacagagctaagatttttgcccccaagagtcttgta

SEQ ID NO: 252075 - DNA, 1061 bp, Homo sapiens
gctttctgactccactcttcctactctggcttgctaatcaactttacctggtttgaaatgcccacccttatatacaggcaattatgtggattagaaattaaggatgaaacatcttcccaaaaggtcactgttaagatttacccatcatcttggtgctcctagctctctacgaccaacacagagtggctgacacttcaaccaggcagcttggattgcaatgaggacaatgcaatgcatttgggctggaaacactgcacagaatttaactgtatgaatgcactctagttcatctatgcggtggttaagagcgtaggctctgaagactgctagggttcaaatcccaggtctttcaacatcaactggctgtgaaacatgggcaagtgagtaaacgtttctgtgctttggtttcctcaccggtaaaatgtggataaaagcaattccttcacagggttgtttggaggagcaaatgactttatgtatgtgaggcacttagaataatctctcagtgttattatttaaccaacatttttgttgaatatttagttcatttccaggttttcactcttacaaatatactgtaattaacaaattcagtgcactcttaattgcttccaaagaaaatatctgtggtcacatttaaaaatcttttccagagtgaatcatgcactcaacacaaattgagtgtccatatgtacaaggcattatgttatgcacaaagaataaacacagttctcttcttgaagacacctaaaatgtagtaaggaagaggagagaaaaaggctcatgcaaatataagcaaaatactatgcagaaagagggcacacatgaagacctatgggagattctttagctggagaatcaaatcattcaatgacagagaaatgcagactccctcctctgctcccaccacctcccaaatccccaaatcggaattcacaatggtctccttttgtcatgttgagaatttgttacctcgaaagagcacacccagggctgtgttccaaagttaaaagctgggatatgggcgtatactgcaagaccaaatatttaggaaatacctt

SEQ ID NO: 252076 - DNA, 474 bp, Homo sapiens
cacagcaagaagaaaaagtccatgtaggactgaatcctgtggtacttctgcggtggcacttcttacacaagtgagaagcagcgacaccgtgacacctgcacgccggagccctgcgttagtgagaagcagcgacaccgtgacacctgcacgccggagccctgcgttagtgagaagcagcgacaccgtgacacctgcacgccggagccctgcgttaggctgggtaagggcggggacctgggcatcacacagtcttagatgtgggcctgcctccaacagctccctcctgggtgtgatgctgaagggggtccttgacacctctgaagtctcagtctcctcaaggtcacacccagcttataggattgtgcttctgtggattaaacaagacacagcagtcctcccttatccatggttctgttttccttggccaaaaatattaaatagaaaattccagaaataaacaatttatgttttaaa

SEQ ID NO: 252077 - DNA, 588 bp, Homo sapiens
tccaccaccctacagagttaagtttgaggttttccaactttgataagtcaccacttattcatctattttaaacctacactttattagctctttctttttcattatcaccataaagcatatgctctttgccctttgagtttattattttactaaaatttactggagattaagacagaagcagacattaatatgtgtacttaatattttatatttaaagaaatatataacatggatagaatttgaaagtgaaattattgagtaaaaaaaaatcaagttccaaaaaatgcacagatgacatcaccaattatgtaaatacatagatatttttaaaggagtggacaagtatacacatgtatctcagtattttcttatgaagatggtgtaggatgtgcgtaaaatggaaacaacaggaacactaatgttcactgtaatgttctactttgtttaaaaaatattctaaactaaaaaggtaaattattataatttttaaatttaatacagaggggtatgtatgtctatcataatattatttttaactttgtatatattttaagtatctcataatttaaaaggtaaaatttatcacgg

SEQ ID NO: 252078 - DNA, 397 bp, Homo sapiens
gtttgcagacagccatcttcttgtgtcctcacatggcagaaagagagtaagaggggttctcttataaggacattaatcccattcgtgagggctctacccttataacccaatcactcccaaaggccccacctccaaataccaccataaaccacggccaaaaaaaaaaaaaagtgacaaagaaggaaaaatatttttgcaactcatctagagatagaactgatttccctaatatttaaagagcttctccaaggcagaaaaagaccaacaatgcaataggggaaggcctttcaaagtatgacaaaaatccagaaaccacaaagggaaagtcataaaatgaattcaatgacacaaaaatcaaaaatttctgagcagcaaataccaccataaaccacggcca

SEQ ID NO: 252079 - DNA, 681 bp, Homo sapiens
atattaaaatatactacaaacgtactcatatatttgaattggcattaatgggcaagtcagtggcaccttatagagtccagaaataatctcaaatacatttgaaattttagtttacattaaggaagcatctcaaatcagtgtgataaaaaaggatgttcaataaatggtgctgggacaattaaatagccttctgggaaaaagaaagtttggtggttcatatttacaccaagataaatcctaaatggttccaaaacttacttgggaaaaaaatttaaccgtaaaagttctaaaaggattcaggagaaaattgtttataagttgggaaggcctttcaaagtatgacaaaaatccagaaaccacaaagggaaagtcataaaatgaattcaatgacacaaaaatcaaaaatttctgagcagcaaataccaccataaaccacggccaaaaaaaaaaaaaagtgacaaagaaggaaaaatatttttgcaactcatctagagatagaactgatttccctaatatttaaagagcttctccaaggcagaaaaagaccaacaatgcaataggggaaggcctttcaaagtatgacaaaaatccagaaaccacaaagggaaagtcataaaatgaattcaatgacacaaaaatcaaaaatttctgagcagcaaataccaccataaaccacggcca

SEQ ID NO: 252080 - DNA, 488 bp, Homo sapiens
ctccagggtgaacctaactcatgcccatcttcaaacttggtccagatatcctgaaggggaaggggaacctgcttcagagtgaagaaaccagtttgaagtgtgaccctgcttcaaccaacagaatgttgcagaagtgaagctacgccagttctgggcttaaacgtcaatcaggcctagcaacttctcttctgtctggatgaaggtagacacagcataagaactacctgtgaccatgatgctctgagaagccagcctaactatgtgcagaggccacatggaggaaaactgaggcctccagcccacagccccagctgaatttctagatgcaatcagcactaacctgccagctatgagtgaggccatctttgaagtggatccctcagccccactcaagccacccagatgatgccatatgaactgcccctgccgagccctgcccagattgcagaatcatgagaaaataaattaaaaaggctttgtttaagtca

SEQ ID NO: 252081 - DNA, 258 bp, Homo sapiens
ccaaagtgtctttataccaccaaatgagtccactagctcccaagtgatggctcttaaccagtcagaaatgactgaaatgacagacatagaattccgcatctgaatgatgaggaagttcattaagattcaggagaaaggtgaaacccaatccaaggaatccagtaaaataatccaagagttgaaagacaaaatagccatttttagaagaatcaaagtgaacttctagggctgaaaagttcactacaagaatttgataat

SEQ ID NO: 252082 - DNA, 224 bp, Homo sapiens
gaacttggctccacaccttcgtggctgcactggggaaggctgccccccaacctaggagcctatttcctcagctggaaacaggggaagcccacctccctcctccaaggccgctgtgaagactgaacaggtaccaaagtgaaggctcgggcctgcccccactgtcagggtgctgctgtgaccagggcacaatctcagcactgctatacgacacctgtctatcccgc

SEQ ID NO: 252083 - DNA, 200 bp, Homo sapiens
tatggaaggataaacaaagacatacttgaagaatgagcaaggagttaggagaaaagaatgttgtatcataaagatgaaaaaaaagtaacacctatttcaagatatttgaaaaaagaggtcaagaaagataaaaactgaaaaatatctgttggctctagtaacagcagaaagtgggttgaagaacgtttgaagaagtaaga

SEQ ID NO: 252084 - DNA, 456 bp, Homo sapiens
cactttcctgttttctcacagtgctccaatcacactggccttctttctggacttcaaacatgccaaatatactctccttgagggacatagcacttactgctacctttgtttggaatgttctttcccagatacccatgtggcacacccaaatgcttgagtggccccttattagtgaggccttcctatagcattatatataagatggatataaggtaggactcagaacatactccctatcctccttactctacttcacctgactccaaacactgtcaccacctgacgtagtacatattttattttttatttgtttagcatctgtctgcctctaactagaatgcaagctccatgaggacagagatttttgttttgtttaccgccatattgtcagcagctagagcaatgtctggcatgtagtagcactcaatgaatattaattgaataaatgagctacct

SEQ ID NO: 252085 - DNA, 461 bp, Homo sapiens
ctttatgtaatttacttctacggacaatcttacctagcaggtactattattattcttcccattttttcaggaaaatctgtaatacaggacccctccagttctaaaaccaaatgtctctgtgatttaaataaaagggttgagatcaagaggtttggagaatctctgtccacttgaggatatgatgctatttttacatttacttaagatttattcttaccagcttttgagagggtttgaaggggcttatagactagatggtgcttaagacatttaagaatcataaagaataaagatcacttggggaaaaaatgatggaagaaaggtctttaagcacccaatttctgagtcagaagattgattaaagctttccatctaaggcaaaacataaaaatataattaattaactaattactaaaaatattggagctttaagttatacacagaatctgttgttatttatt

SEQ ID NO: 252086 - DNA, 868 bp, Homo sapiens
gatttggcctcccaaagtgctgggattataggtgtgagccactgtgtccagccaaggaggctgtttgaactgcatgattgaaaacacatttgcaaaagtagttttagggtattttttaattgcctctggtttgaactgaatggaaaaatcttggctgatttcaatgtatagatcttcaaaagaagtttaaaaggatagtaagatctgttttaaatgtgcacgtgtgtctgaaggctggttaaggaaatcataacagggtttgggaccgattagccagccgttcttcagccccaaggtcctcaaaacactcagatttgaagatgatcccgtcttgttccgtggtctcgtccgctcctccacggtcattcttttcgaacctggccgccagtatgtgccctgagagtctatttctcttgtaaatcattgtaatattcttgactttggtttaaataaaaaaaaagaaagctgcatcaggcttaacctccatttctgtgagtttagaatgtcttacgagagtctgagtatgtagcttggaattttggttagttaacttttctcaggcttgaaataccttttcaaactcagctgagacagactaccctgtcacttcagttcattatggttaatattataaattgttaataaattctaagtcacagataggaacgtgtggctgaaaggagacttggagagggcgggaccctgtggggtggaggcagggccacaggctctccacacgccaggagccagcagcctggccgaggcggctttcctccttatgctcctgtgtcctgaggttgttccccaggggcgagggaaggctgctgtgctgggtgggttctgtgtctggggcggccctaactccagg

SEQ ID NO: 252087 - DNA, 767 bp, Homo sapiens
atattcccttgaggccaggaatggacctaagggtgcctcaggcatgggaagacccgataccggcctctctggagctcgctggcttctggagttctgagttaaggaggtagttgaagagacccatgtatgacccccagatgccagtaaaactaatcatgtgcagggaaggtggtcacgtcaataagattttgaaagcaagattcatcaaaaaataggccagatttgcagtcccacatgaacctgcattgaaccctcattgactatccaggtatgtattactttaaaaaaataaaaactaacataaccttaaaacatattagcaaatttccctgacacactgaaagtaggatattattctaaaatttttcctttatgtatgtagctttttagaaaccctacaaatgtgttttgtgtaaaaggatgtagtctgcaatcattttctgactcttggtgtaataaaaattaagtggcctaattatttaaaagcttgtcgtttgaaattattttttgagaaacagtttaaagcatgatactatttttgcttttcatgtaatgtataagtattcgcagaagctgcttgtatatgtttgtgttccatgtatgaaaatgttgtaaacagggtccatgtatttccccagtgagagttgctgatcttttggctgtaattaccaagtgcttgaggttggggtggctggaaatgaatatcaagcttttcggtgcctggagccaactttgtccaaataaaagagctttgtactgtgaaggaa

SEQ ID NO: 252088 - DNA, 391 bp, Homo sapiens
aagattcagaagccctctgaagattcccaagacaacccggaagggaaaagagagtctttgagggagttccaggaaaaaagccactcccgaaagaccgccgcttcaagaaaacctgaggaagggagagggccaacgctatccagccactctgaccagctgaacgaggaactcaatcaaaaggagccacagcaggaccaggaaagtgaggagacttccaccatctccagcgtctccctggacagccagtaatttcagggcaagttcaaaggactagatctatctgagaggtctccataggtctaaccccagagaaatagccaaaagggtctatggtacattttacacacaacagggtacccctcatggtgatgaaaataaaatgaacctgttg

SEQ ID NO: 252089 - DNA, 293 bp, Homo sapiens
tgtgggaaaattttcagtactatccctgagttcattaactaccatcactaacataatcataaagggatttggggaggttgcttagtctatcttcttgccttatggccaccttgaacctaaaattcccagattcctctaaccaatgaatcccgtttctgagattgacttaagcaaagacagattagtacttctaaaaatttcccttttactagttttcctatttctaccccagtagggatttttgtctattgtaagaattatacattcatgaccccaaagaatcacaccaagac

SEQ ID NO: 252090 - DNA, 346 bp, Homo sapiens
tcctagcgaatgtctttccttggagggaggcagggttataaggacccagagaacactaatccctctaaggaggatccttccagggcaaagagggaaacagactgaagtctgtgcctttgctcaaactaccctctccctcacctctgctagttcccatcctgcaaggccttgaagccaatgtcagcccctccaggaagccttccccaagtcctccagctccagccttcctcctctgaactcctcccctgcagggccaatttgagccccaagccctccctctggaaaggctcacaaatgttgccttatgtaactgaaggaatcacaataaaatgtgaataatggcagc

SEQ ID NO: 252091 - DNA, 607 bp, Homo sapiens
tcagagccccatttctgaagtgtcttacctaagtagcactttgtccctattttaacagatgaggaaacagaggttcagagatgttacataatttacaaaagtctcatagctagtagctccccttccttgccttgtaccataattttcaatttattgaaatcgcaaagtattttattcttaagcaatagtattcaaagaaccccatagatcatataccagaaatcatattttttgctcatttgtgagatttaaatttcagttaactcctttactgatttatgctttctcagaacttcaaacatcagtgagttgatggcatccatatctctgtttttatctctgtttttacacccatacatacaaaagaatatatagggcatgagcagaatgtggtggtatgcatccgtagtcccagctactccagaggctgaggcaggaggatcacttgagcccacaaggttgaatccagcctggacaatagagtaagaccctgtctctcgtgatccgccccgcctcggcctcccaaagtgctgggattacaggcgtgagccatcgcacctggccatatctatttctttatttgaatctgggttctcaaaatcttgtg

SEQ ID NO: 252092 - DNA, 253 bp, Homo sapiens
tatttcatagccaaatatgactaatggccactatattggaaagtacagttataaaacatttccatcattgcaaaaatttggattggactgcactgctctagatctactctaacaaaacttaaaagtaagattctagccgtacgtggtggctcacgcctgtaatcctagcacgttgggaggctgaggtgggtggatttcttgagtccaggagttcatgaccagcctggacaacatggtgaaaccctgttgctac

SEQ ID NO: 252093 - DNA, 510 bp, Homo sapiens
  misc_feature (306)..(307): n is a, c, g, or t
  misc_feature (314)..(314): n is a, c, g, or t
  misc_feature (317)..(317): n is a, c, g, or t
  misc_feature (367)..(367): n is a, c, g, or t
  misc_feature (452)..(452): n is a, c, g, or t
  misc_feature (477)..(477): n is a, c, g, or t
  misc_feature (481)..(482): n is a, c, g, or t
gctatgaatacatagtttaagttctgggcaaaaaccatctatccccgtatgtagataaaatatttacttactgtgttctgggtctgttttctcctaggtatggcaaccgtaacttgagtataatgccacccaattaatgttgatgcctgaattatgaaccagagatggagaagtaaaatcacagagagacaagcaacttcctaaggttacactgctagtgagtgtgggccagggttcaagcccaggcagcttgatgttggagccgatgctcagaaccaccatgctgtattattaaaaaggattatnngcgtganccnccacgccccgcctaaaatccatattcaaagaagcaatttcagttcctttntaagctttgtcagtcaaggggctccactgacttcctaggccctgtaatttaaccagtctttaaggttttgcaggaaagtcccttnttccaagtggtttttccaaatcgcncaanngcaaagccaaacagaggaaccaccatta

SEQ ID NO: 252094 - DNA, 989 bp, Homo sapiens
atttgaaataactaacaggctcttagctaaagcatactttttatatgtatacattttatagtagggaagtggcttagtgtgggcagatagactagagttcaaactttccttatctattgagacactttgaacatggttacggttaacctttctgagtctcagtttcctcatctgttaaatgggcatcatatcatttgcctcacaagatagctatattaaaggaaacactgcacatagtgaacttagccagtggcccatcacataatacatgttcaataaatggtagctattacattgtttgcatttaactattatgatgatttctaaaaacctttaaagccttggaaaaaactagccccattcctcagcctgtttttttttaatcaaataggaatttgggaaaaaatctaaatatgtgcaatgatctgcttttaaaaaataactatcttgtgaaactcactagttctttatagtatcaaaagtgatttttggctgctgaggcagcatggcacagggactaacaataaggctcaacctgcccagcctcaaatctatacaaaatacctttgtaaccttggacaagtcgcttacctcttaaagcctcaatttctgcatcaataaaatagggataatactgcatagggttattgaggtgattaagtgaaatagtctatatgaaatgtttagactatgtgtggttcacaggatgcaaataatggtggctgttattttcccagcacattccgttttacaaataagaatttgcagaagaccaagcacagtggcatgtgcctatagtcccagctcattggtaggctgaagccaaggattcccttgagcctaagaattcgagtccagcctccgcaacgtagcaagagcccatctccaaaaaaagcttttaaatcaaatttgcagaacactgttttttgtgataaatggattttatgaagacatttctatatgtaagaagttgttcttactgttttgtt

SEQ ID NO: 252095 - DNA, 456 bp, Homo sapiens
acattgggatatttatgttatcacttggtataaaatgtacattagtagaaattgagtttagtttttattattttgtgcgtggagatgattgatcaatggcaaacttattttacgctccagatagctaaaacaaacattgatattttgatacataactcattacattttacttcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaa

SEQ ID NO: 252096 - DNA, 316 bp, Homo sapiens
aggcccttggagaatggattttaaccactagagattggaaggagggattccaagtagatgaaacagcttgaccaatgtcatggcagggagaaagcaaagagtatgtttagtacacagagcattcaactcgttcaactgtgggatacacctacaggagtgaatagtattcaggaagttgagaaagggaggatgtgaccagatcgtttaataccttataaaacatctgatgctggcttcagcactgctccgtctagctgtatgacctttgttatgtttcttttcttccgtttatcttggcgttcccatgtattagtga

SEQ ID NO: 252097 - DNA, 288 bp, Homo sapiens
ggtcagctacctttgattgatttaaattttcaattcagttttcttagttcattgaaattgacaaacatcttttctatttctacttgagttcagaaactttaagattgtatttttttgggtgataatcttaccctagttaaaaattacaccagcctggccaacatagtgaaacccggctccactaaaaatacaaaaattagccgggtgtggtggcacgcacctgtagtcccagctaccctggaggctgaggcaagagaatcacttgaagccaggaggtggagaaggttg

SEQ ID NO: 252098 - DNA, 458 bp, Homo sapiens
acgttgcctacttgaggccaaggcagaagcatcaatcacatggggcgtagtttctgtctggctaaagaacggctcacgcggacctcgggaatgcgactgtggaaacgacggggaagctggaagggctgggtggcgggggaagctggagggcacagcttccagattccagtttgttaagaatcacctgaaggacgtttctctgaagggaaagtgggcatctgtgaagggttagaggcacatacttcaactttccctagcacaagagtggaaatccatactccttggggagggactttgtcactgaaccttaagaaaatggttactggactgagcttggttacttatgcctgtaatcctgacgttttggtagatggaagtgggagcatcgattgaggccaggagttctagcctaggcaatgtagtgagactctcatcgaaaagaaaataaaaaaaagaag

SEQ ID NO: 252099 - DNA, 602 bp, Homo sapiens
aacagacattcaccaaaaaaggtatgtgatttgtaaataagcaagatgcttgagatcattagttattagggaaatgcagattaaaaccacaacgagataccactatacatctgtcagtataactaaaattaaagactgaatgtatcaagggttgacaaaaatgtggaggatgtggacctctggaacatccactttgcaaaacagtatgtagcgatcttaagaagctagacatacacgtaccatatgatccaaccactcctctcttagaagtttacccaagagaatttcaagtggatgtccatacacaaacttgtatggaaatgtccattagcaatttcacttgcatagtcaaaaactggaaacagcccaaacattcatcaacagaaaaatggatgaacaaattgcatttgtttatcttaagatactattcaacaatttaaaagaataaactattgatacatgcaacgtaagtgaatctcaaaattattatgctgagtggaaaaagtaagatttttaaaaagagtatatgctgtatgattctacttatagtaagctgtaaaacatgcaaactggcctgccacagtggctcctgcccataatcc

SEQ ID NO: 252100 - DNA, 137 bp, Homo sapiens
gtgaaatcttaagcttatctgcacagttgcattactggttgcaggtaggggtgttattcatgacagaaacatcccttcatacatcgttcaaggctaaggtaaagaggactattgtttatttgggggaaagctgacgt

SEQ ID NO: 252101 - DNA, 668 bp, Homo sapiens
ccgtgttagccaggatggtctcgatctcctgacctcgtgatccgtctgcctcagcctcccaaagtgctgggattataggcatgagccaccgtgcccggccccatcctgccttctaaaaccatctcgtcatattctcaaatctttctgaccctgtatgctatattttctgatatccttttaaattttcttaccttttcctgttatttcctttttatgcaattcttctttatagaattgtagagtttagcagttttctcattttgcttttgttgcacctgatttttaaattttcctttcctttaagattgatttatttccagcaatcggattccatggtgccctcaaagccctcatctctatggctaacataggagatgaaagctcagttcccacaatacccaaacaccagccactagaagaatcaatgaagagagggagagaaagaaaagcagagtgttagacttcagaataagaagtgagaatggtcacatgggaagcctgcttcatatccaaatcctaaaaacactttccaattccactttgacaatttattgccattttcttatactgataattggtatttaattaatctaacaagaagtacaaggcaaagacagttttattcccacgttccattcagattatagcacctaagctcctttatattc

SEQ ID NO: 252102 - DNA, 562 bp, Homo sapiens
aaccacatagctcccatgatccatccaataattcctcacgtcctcttcactctttactccatgcataaaacagaatttttttttctcatcctgggtatgaagcaattaataatttacggatttagcctatttggattcaatcccttcaaactccatactacatccaaggtggaagtgacttaaactctgatatcaatcatcaggcttgtaatataggctttgttaatggcaggagagtctaataaaactttctgttccttatccttcatttaaatgaaaaactttttattgaaaacaatcataactctagctcatcataaatataattcatgaggacattttattatttttatattaaagaaataatattatagatgtaaactttgcacctttctaattattatcatgagttaagctaatacttgtcttctggtccctagatgatgattcttttttgccttactggaggagcccttgtcttgaagtgagttgcttcaacagcagaggacttctagtttctcccagttgagcctaaagtgaacttttcatcttcttcagagga

SEQ ID NO: 252103 - DNA, 235 bp, Homo sapiens
tgtagagaaaggatctcaccatcttgctcaggctggtcttgaactcctgggctcaagcgatcctcctgcctcagtgtcccaaagtgctgggattagagacgtgagccaccgtgcctgaatttagccttctttcatagtcatcattttatttgtgagactcatccatattgatagacttagctcattctttttaattttttttttttcccgaaacagaatctccctctgttgccca

SEQ ID NO: 252104 - DNA, 451 bp, Homo sapiens
tgtatgttacatgtattgtgtactgtattcttaaagtaagctaaagaaaatgttactaagaaaatcataaggaagagaaaacatattcactattcattaagtggaagtggatcaccgtaaaggtcttcatcctcatcttcatgttgagtaggctgaggaggaggaagaggaggaagaggaggggttggtcttgctgtctcaggggtggggaggcagagaggtggaggaggtggaaggggaggcaggagggacaggcacattctgttacttttattgaaaaaggctacgtatgagtgggcctgcgcagttcaaacctgtattgttcaaactgtctacatgtttgaagtaataatggctgagacctttccaaaattggtgaaccaaaccacagatccaggatgctgagagaacaccaagcggaataaatttaaaaagaataaccttgttggta

SEQ ID NO: 252105 - DNA, 1467 bp, Homo sapiens
gtggggcccatttgtagaatgaaggtgataactgcctcgtggggttattggcattaaatgaagaatgtagggaacctagcatggttcttgatgtctaggaggtgctcggtgaagggtgcctatgattcgctttgtcttctaaatacttttggcagcacttgaggtgttaaagtctgtatcccagactttattagtcttgttgttttacgtgacttaagcgattagctcaaacgcccaagtacaaaatggggctaaacccaggttttccgacacgattctacctccatggctctatctccagctccacccaaggcctccaaaatggtgttctcctaaagtgaccaacaaaacaccaagctgtgtcatggtgccactttggcgatgtggtctcttaggagagggaattctaagtagttaattagcttgttcctttctacgttgtagtcttgaccaaggacaatgtgttggcatttaatgccactgaagatttaagagactaaggaatcagatcctctgagattcctaaatctgtgtaataaaatgggttctacacatagctattccaaaaaattcagtcagatattactaacaagatagacagattataatctgtatgaaatttctaggagtaataaaaatcagaatagaccccgtaaaaaaaaaaaaaaaaaaaaaaaaaaaaaaaaaaaaaaaaaaaaaaaaaaaaaaaaaaaaaaaaaaagggggcgggccggtaaaaatatatttcctccccaggggcgccccacatttccgccccataccccgcattttttgttgacaaaagggtggcccccattaagggagctttttttatatataagcaacgacggccgggcgcgccggattttataaaaaagatggataaatgtgtgtgaaacaacagggacacacacagtcgggatatatttgtggtaaacagagaaacccttatatgttggggagagggagagaaaattatgggagcacacaacaacacacctctccacaaacactatcttaaacaccctctctcaagagagcacactactatacaacaccttattccaaaatactttaccaacgctctaacaaaaacacacaccctgcccaattaattacctaccacacgtaaacaaaacatatattccctacaccaacacatcttacctcctattaccaaaaccatatttatttacaccccagacaactcaccatccctcaaacaaattacctacatctccactccatccagaactaacatcactccatctatctccacttctcacccaacgaccaccacactcctaccacaatcatacaaccctactcactccgtactaactctgtactacacctacctacaagtcctcctatacccattatctttcaatctcaaaacctacacccacctcatcgaacatctatcttacccccacataaccacaaccaaacataaacaccacacct

SEQ ID NO: 252106 - DNA, 390 bp, Homo sapiens
tgtacatatagaccagtattgctttatgcacgttttttttttattaaaaaaccacactgttgcaattttctgtttttttttaacaaaggacaaaataataattttttatattaaaaatcagttcctggatattaacaactgattttctttcaaggataaactgtgctatttaatagttacattaaaaaaaaaccttcataatcttaattgtaacctaaggacagtaatacctagcccacttaaatctccggttattatggagatgaaacaaagaaacatgtgtaaataatctgataaatgctcattcttggatgtaagttatatctatattttattaattctgtttctttaatgatacctcttactcaataaataaaacttttattttca

SEQ ID NO: 252107 - DNA, 244 bp, Homo sapiens
tgttatttttagttatttgataaacacttgctgcgtgtctgtttaagcaaacctttagaaacacatatgttatctgctgtctcattagagcatgtatggtaaaagaaaaaatcatggacgaaaggaatcagactaaagtctagggtttgaaaataattttaagtctttgtttgcagtgaggtattttaggatgagaattatgggcttatttcaatgtgctcttccaaaccatgttatcatctgt

SEQ ID NO: 252108 - DNA, 516 bp, Homo sapiens
aggctaggagatcaaagaggcagaattagaccgttttagaccaataaatttttcctggggtgacacacagcaagacgcaaagagaaaagaccaaggcccccgccgccgccgtctgtctagactcaagcgactgaaggggccaacagagctggtgtttaaagtagaacctgcccagtccaacagcccgagcagggagcgatttcggggatcgcgggaaggaacgcacttcgccaagggagggccgggtgccctcgccaccggctcattcctgctccggttttgcccgatgcgcgtccaggaggttctggcaggacgcactgcccctctgccccggccaaggaggatgcggatactgcccgcaaggcttcggcctttatggacccaagtcagccaactgggccgagtcctgcggacaccgaaacctccctttcgtttccaggcttccttctcccctcttgccctctgtggtctgatttaaaacgaaaaggtcggataaaatcaggctttcaataaaaa

SEQ ID NO: 252109 - DNA, 454 bp, Homo sapiens
actataaaggggtagcatgaaaaacaaaccaaatgtccatcaaccgatgaagagatgaacaaattctggcatattaattcagtggaataccactcagcacacaaagggaatgaaatatttatattacaaagactgaccaatcttgtgatcactatgttcagtgaaagaagccaggcagaaaagactactacataagtttatttatatgacattctaaaaagggcaaaaccatagtgactgaaagcagatcagtgactgcctgggaccagtgaccaagggaggggatcaatcatcatgcaaagggcataagcaaacttttcagcgtcaggaaactgttctgtatcatgattgtggtgatggttacacaactgtgtacagtgaccaaaactaataaaactatacacttaaagtagggaaattttatttttaaataacacttcaataaatctggagg

SEQ ID NO: 252110 - DNA, 262 bp, Homo sapiens
cagtgatgttaaaatggttaatataactctattccgtatgtccaaaaagctagaggaaagattgaacatgttaagtagaaacattaaaggatttttttaaaagacccaaagcaaaattatagagatgaaaataattatgtatgaaattaaaaatatactggatgggatgaatgatagataagacattaaagaataaataattaacaaacttaaaaacacagcaatggaaactatctgtaataaaacacagagagaatgtaag

SEQ ID NO: 252111 - DNA, 425 bp, Homo sapiens
aaaaatcctgtggaacagttactttttgcttataaacttcttgacagagcaatcggtggaataaatttgaattgcatgttaacctctttgccaaatggatcatcagtaattgaccactgctatgccaagcgtacccaccatatagatggagatacttacaaaccacttgcctcaaatagtttcatgatggatttgcatcttgaactaattcaagctcagcatcgaatagctgttgtgcttctggacaaattgcaaggtagtagtcactaaagcaagtaaccattctgaatcaattttaagccagactccagtacagaatcaatttaatttgaaaactgtgttcttgttgacttaagttttcagataaatttcatttttttctacttccctaattaatatcaataaaaacataattaaatctttcc

SEQ ID NO: 252112 - DNA, 814 bp, Homo sapiens
aaaaatcctgtggaacagttactttttgcttataaacttcttgacagagcaatcggtggaataaatttgaattgcatgttaacctctttgccaaatggatcatcagtaattgaccactgctatgccaagcgtacccaccatatagatggagatacttacaaaccacttgcctcaaatagtttcatgatggatttgcatcttgaactaattcaagctcagcatcgaatagctgttgtgcttctggacaaattgcaagttttgcagactccaactgttagcaaagatatttctaccaagggtccggaaaagttaaaacaatctggaagcactgattgttttacagaattaaatataatgaataaaataaagaagaatacattatccaaagcaatttacttaatgcagaaagctcttttaatattcgagaaagatgcaacttctacatcttcatgggaacttttgatgattcactatatataattcatcctgaccaggggaactaattcgtacctccagttctgaattctgaaatgagagattctctttttatcagaacttcatgcaatctacatgagaagacaaataaaatcagaaggactcaaaatgagggaaattatagaattggagtgacactttaccagcttaatgtattctttacaatggaattaaaattcttaaagtccattggctgaggaagcatattccttaattcagaggattgaagctgaacaaaatgccctatattcctatcagaaatatttggaaagttcaaaaagaaagaaaagcagagtcccccctccacctatcctgctgt

SEQ ID NO: 252113 - DNA, 694 bp, Homo sapiens
acgtagcccacctgtgaatttccagtcttgagcacatttcatcaatccacttctaactgtctatagcacatcctctggctgagtctcctggagaatggaaataacaaaatcagggccaagtgaggggaagcccaggctcctcagagactgtgccttccccacagcagcttcctggggatgcctgtgacagactctctttgttgaagactgggccctcactgttctctttgtgagggtaacctgctactccggaaagtagcatggctactccggaaagtagcatgtaagtaggacccaaggcaccgcagataataaaatcttggctgatgtgatgggctacggcttttcttttctttttttttttaataaaataaactaatgataataatagctagtgttcattgaaggcttacttgtgccgggtactatgctaagtattttgtgtccattatctgactttaacctcaaagcaaccttatttaatacagatattattagctctattttataaataaagaaactgaagcttagaacaattaagtatttccttaaatgccttaaagctagtagttgcaaacttgggatatgaacttgcttctgtctgtcttgaaagtctgttctcataaccattttaccatgttgtcttgttttcgagtagggcaaaatggttaaaggaaaagtagattaaaagaaa

SEQ ID NO: 252114 - DNA, 377 bp, Homo sapiens
cagggcaattaaggagacctgaggatcaaggaccgaattcaggggacactgcaattatagcaaatacaatatgagaggtcagagaagaagtgacaggagagactataagaaaagctggaagtgggccgggcatggtggctcacacctgtaatcacagcactttggggctgaggtgggcagatcacatgaggccaagagtttgagagcagcctggccaacatggcgaaatcccatctctactaaaaatacaaatattagccagatgtggtggtgcatgcctgtagtcccagctactcaggcggctgaggcatgagaattgcttgaacccgggaggcagagattgcagtgagccgaggttgcacgactgcactccagcc

SEQ ID NO: 252115 - DNA, 765 bp, Homo sapiens
aataaatataattataggaaggaggggggacagggtaggtgttaaaaaggagtttcctgggaaaataaggaagtgaagaaaggcattccaggcataaaatatgcttgctatgtgcaaaacaacagtgggaaatagcatagactcttccatgtacatactgcaagtgggtatgtgatggtggagctacagttggaaaggtaggtaggggtcgtatcatctagcccgatttactagagtttaactttatttactcatgaataggtagatcttgacagattttaatgaggggagggacatcaggtgccaagtacctacaaacatttaaacaagggaagggttttatggttgcagtgattaggacacgtttgaggaatatttagacaattaagttagtggaacttatatttttataggatgtaaatgaaggggcacagggaagccaccgaaggtgatttctgagattctgttttgcataacttggtacatgatatgccacagacataaaggggaaatgctttcaaagagatctgtgtttttctcaaattttacccaatatatttgcataaagctcaatgtagattggaactatggcaatttgattcagttccacagcttaagtaagtgttattttgttcagttaattgaaaatgaaactatacctgacaggaagctgattacttatatgctaatgtgacagtattatagatcataggacttataacacctattaatttggtaaatgggaaaaacaaaactgtatactgt

SEQ ID NO: 252116 - DNA, 351 bp, Homo sapiens
aatcctgtatgtcacatttgatgaccttagcaattatacagacagggaaaatgtttatcttgatttctgctacagcaacactgaagccagaggtgtctgagctttggctaatgtcacttgatgtaggtcagccctactgtgagcgtcaaccctggtttctaaatgtgctgctggaggaatcccacttcacttccagtttaagtgtcagctgaggcctcgcctgatcatttgattcagagcagccctagttctcacaacactatctgaattttctacatatcacatcacagactaatattgtttataccagtcttgtttcctcctaataaaatataagtgccatgaaagaac

SEQ ID NO: 252117 - DNA, 429 bp, Homo sapiens
ctataaatttaaaatttaaaattatttgtaattattgagtgaaaaaaagatcattttctctttaacaaaatagtgagccataagttttcaagaatatagcatttggcaatgtaagtataagaaaaagaatcagggctgggcacagtggctcacgcctgtaatcccagcactttgggaggccgaggtgggtggatcacaaggtcaggagagcaagactatcctagccaacgtggtgaaaccccatctctaccaaaattcaaaaacattagccgggcatggttgtgcgcgcctgtagtcccagctactcgggaggctaaggcaggggaatcgcttgaacccaggaggcggagatttcagtgagctgagatcgcgccactgcactccaggctgcctggcgacagagcgagactccctctcaaaaaaaaaaaa

SEQ ID NO: 252118 - DNA, 491 bp, Homo sapiens
actttctagttacttgggctcaggaatctcgattttaacaaggattgcctgatggttctctttccatcactaaagtttgagaatcactgctctagagctttatggattacaccagttctgcctttggcctagaagcaggttttcttattccctgttcagtgatacttgactcaccatatgttgcctaccaatttcttacccatctacaaaatcaggattgtaaagaaagatatttgtgctgggttgataattttagttgaaggaaataagtcattagaaatacatattttagatcctgggtctgtcagtacctatgatttgcaaaataagtaaatttaacttatttccagtcttttgtaaaacatatttatttgctctaaaaatgtatctgcagttatttaagtgtttaatacatcagactgggattttcaattatagctacttgaaaatactgctaactcagaataattgaggtcggatccagtgtaaat

SEQ ID NO: 252119 - DNA, 736 bp, Homo sapiens
  misc_feature (7)..(7): n is a, c, g, or t
gagtgtntgtataaaaattcacgcaaagttgctagagagcatacaatttccaagaaatgtcggggtgttgttattttcagttttctaaggatgcactccaatcaatggaaaaatgcagacattatgcaagatttcattatctttggtaaaagtattctcattattttgtctcttcacagtattaactctgatatccactttgtgtgagtctgctattgaaacttctaaaactaggcctagttttagaagtttcaatagcaggaacaattatggagagattggagtgttacagatagcttgggctttatccagtaaaaaacagagaggcattgtatgtattctaagatactggcaagatgaaaaaattaacctgacatatagaatggattggggaaggggggaattaaagacacataagataattatgggacttttgcttataatctcaacagtgaaaatggagagaaagaaatgaacctaaaacattctgaaggaataaacagtggtctgtgtgttagtccattttactgaaatagagttgctctaagttgctattgaacttctaaactaggattcattttactaccaaaaggaacagactttctggggtctgaagggatttgtacttgaagatactccgtcagcagaggctcatgttgacattctgccagacagagctgtttcagtctgcagctgctattgaaacttctaaactaggggtaccggctcgattcta

SEQ ID NO: 252120 - DNA, 867 bp, Homo sapiens
  misc_feature (7)..(7): n is a, c, g, or t
gagtgtntgtataaaaattcacgcaaagttgctagagagcatacaatttccaagaaatgtcggggtgttgttattttcagttttctaaggatgcactccaatcaatggaaaaatgcagacattatgcaagatttcattatctttggtaaaagtattctcattattttgtctcttcacagtattaactctgatatccactttgtgtgagtctgctattgaaacttctaaaactaggcctagttttagaagtttcaatagcaggaacaattatggagagattggagtgttacagatagcttgggctttatccagtaaaaaacagagaggcattgtatgtattctaagatactggcaagatgaaaaaattaacctgacatatagaatggattggggaaggggggaattaaagacacataagataattatgggacttttgcttataatctcaacagtgaaaatggagagaaagaaatgaacctaaaacattctgaaggaataaacagtggtctgtgtgttagtccattttactgaaatagagttgctctaagttgctattgaaaacttcttaaaatagggctaattttagaaagtttcaatagcacttccctggggggactgacaaaaagctgaacttattttagtggcactgtcactacaaaaggggaaaaaatgtctcaaaggcaagaaacccatttcctacaaagaaacagtaaaggcccttactatgtaagtcgagagcccaccagtttgctgtttaaatccaagtaattcaatcagggcaccaaattacagcccggaacaagacaaaaagcctacattataacatgggttaactgctattgaaattctaaaataggggggatcctc

SEQ ID NO: 252121 - DNA, 484 bp, Homo sapiens
tattctcaggggatcatagtcaatctctggtgatagaggtcaggaaagaggttacttttggtaggggtagtaactaaaagaagaccttaggaggacttttttggggtactgctattgttcagtttattgatccgtatggtgcttcatggtgtgtttgtgaaaatttatagaactgtatactagttatttgtgtactttttacacatattttatactttaagtttactttaaaagggaattacacacttgtatcatcacaggtttgttgtggaaatcagatgaacaaatgtttttaaaattgctttaaaaattaaaattctatgctataaaaataatggagtaaggaattattgggtgataaagatggctagacaagataggaacaattatggagagattggagtgttacagatagcttgggctttatccagtaaaaaacagagaggcattgtatgtattctaagatactggcaagatgaaaaaa

SEQ ID NO: 252122 - DNA, 310 bp, Homo sapiens
ttagggctgctggatggacaaaaggtgactgtgtccacagagcgtccctgggcaccgagtaaacccgcagcatctcacagggcagccgccagcatcggggctgctggctgggctcggggactgcatgcgttgctactgagaggtgccctggacgccctgggtgtaaaacacatgttgggtttccttggatttcgaagctccaccataaagagtgtaaaatggctcaatcgcaagtttgcatctgatgacaggttcaaatgagagtattttggacctgttgagctaaataaatatattagtaaagttgatt

SEQ ID NO: 252123 - DNA, 209 bp, Homo sapiens
agtggttgcctggggggaaatggggagtaactactgatggattaagtgttcttgagggggacagaaatgttctaaaattgatagtggtgatggttgcccaagtatgtgaatatactaaaacctactgaacgttatgctttaaatgaataaattgtaggatatgtgaattattagtatatctccataaaacagttgaaaaataaatgaac

SEQ ID NO: 252124 - DNA, 606 bp, Homo sapiens
gttgcccactgcttttttctcttaaggttgaaaagtaattttgcttggaaacaccaacaaccattagcctagatgtttttgtagaatagcgtccatctttctagaatctacctgagaagttagacttttttctggctttgtcattttattttttatcaaagtggtgatacatgcatataatgtttatttaaacaactttattgaagtatgatttagacactgtaacatttgtctattttaaggatacaattcagtgacatagtgaatttacagaattatgcaactgtcactactgtgtaattttagaacatttccatcccaccctaaagattcctcctgcccatttgtagtcactcccattcccacacccaacctcacaagtctactttttgtctcaatagagttgcctttcttggacatttcacataaatgaaatcacaatatttaatctttttgcatctggctggttttttaaatatcttttgagacaataccatgtgcttcattcctttttaatgctgaataatattctattatatggatataccacattttcttcattcatctgttcatagacacttgagttattttcagggttttttttta

SEQ ID NO: 252125 - DNA, 535 bp, Homo sapiens
tctgggtgacctttatacacagcatccatcagtcttctttcacctttcttagacttttttctggctttgtcattttattttttatcaaagtggtgatacatgcatataatgtttatttaaacaactttattgaagtatgatttagacactgtaacatttgtctattttaaggatacaattcagtgacatagtgaatttacagaattatgcaactgtcactactgtgtaattttagaacatttccatcccaccctaaagattcctcctgcccatttgtagtcactcccattcccacacccaacctcacaagtctactttttgtctcaatagagttgcctttcttggacatttcacataaatgaaatcacaatatttaatctttttgcatctggctggttttttaaatatcttttgagacaataccatgtgcttcattcctttttaatgctgaataatattctattatatggatataccacattttcttcattcatctgttcatagacacttgagttattttcagggttttttttta

SEQ ID NO: 252126 - DNA, 441 bp, Homo sapiens
gaaaccctcaagatctagggctaggcaaagagttcttagacttgacaccaaaagcacaatccataaaaagaaaagctggtcaactagacttcttgaaaattaaaatttttattccacaaaaaacaagtcacagactgggagaaaatacttgcaaaccacctatctgacaaagacaaaggagtagtatctaggaaatatacacctttcaaaatggctaaaatacagtgataacaccaagtgctagtaagaatgtggaaaaaatggatcactcatacattgctagtccaaatattgaatagtacagctactctggaaaacatcctggcaggttattaaaaaaactaaacatgcaataattagccaagtgtggtggcgcacacctgtaatcccagctatttgagtggctaaggcatgagaatcgcttgaacctgggaggcgcag

SEQ ID NO: 252127 - DNA, 559 bp, Homo sapiens
taagaaaatatccttgaacattattgggggaaatgggaaatgttacagtcttcctaaaaaacaacctggtaatctccaataaaataaaaaatatatttatcctgttgcccaacgattctaatcctgagaagaagaagaaaaaaataccagttcataacaacatatatatgagaatattttctactgacataatttatagtagccaagaactagaaataaagtaatgcccacctatagaagaataaatacattatggtttaataccagatattgtccagccacttaaaaagattgaactgagttaaactagatgatttgaagaaattttaatgaaacattgttgcattaaaaggaaaaaaatctgtaaaatgatagacaagcatttgtttatgtatatgtaggtctacataggattgtataaacagaaaatacagtgtatgcacactagataattacctggggaagtagggactggctgtgagagaagagacaggaaaattgtctataataaaaacagcatgtgtgttatgttcttatttctataaaattaaaaaagtat

SEQ ID NO: 252128 - DNA, 402 bp, Homo sapiens
gcaaagcccccaacatcattgcttttcatgattggttttgacactaccgtgcttgtgataagagagatttgtttgtttgttaattaccggggccagaagtgggatcattctattccttccacacatgcctctcgcccaggtgctctttggtgagggtgggttgtgtgcttagaggcgaagtcatgacatgttatttttgccacctcctgtgtttgtcgacttaggcaagcatgtttttgcagttaatacttatcctccttagtctttttgttgttgttgttgagatggagtctcactctgtcgcctaggctggagttgcagtgagccgagatcatgccattgcactccagcctgggcgacaagagcgaaactcttgtctcaaaaaaaaaaaaaaaaaaaaat

SEQ ID NO: 252129 - DNA, 463 bp, Homo sapiens
atctctctctctctctctctctctctctcaaaaggcagtgaaataacgacttatttggggaaaaaataaaggcagagaatttgttgccagcagactagcataaaaaaaaggaagtccttgaaacagaagagaaatgataaaagatggaaatttggatatatactaaagaatgaggattgctaaaagtgacatacatagataaatatgaaatatatttttattttaaaatttatttaaagcaaaaataaaaatacatcatatttataacatagaaataaaaaatgtatgataatagcataaaggataagtggacaaatgctgttgtcgtatttttggtaaaatgcactattatttgaaagtagaccatcgtgaattcgatgcatattgtaaaccaaatagaacactaaaaaatgaaaataaagagatatggctaatgtgccaatggtggagataagatagatgc

SEQ ID NO: 252130 - DNA, 735 bp, Homo sapiens
ataactttcagccaccgatctcaatatttataagggaaatgataatgtctcaacacatgccccatagggaaagagccagaatagaaatatttttgacacttccatttggaaccagaatctctcatatttactatctaaaactaaggagcctttcccaagttagtttattatgatactaccacgaataagttaaatattaatctgttccctaaagataagttttattgctttgaaggatgaaaaaaatatgaaataatcactttgtgtgaggtgtgtctgtgtttgtgtgtgtgtgaagtaaaaatcaagttaggaataaaacatctttttaaagtttatcttataattccaaacgaatccctggaaactgaactactgtgtgccatttgtttttgttgaaatggttgttaaattattctgattatttagcgatgccagaggctctcttagagtaatttgatatatcactcggtgtctttgtttcacctcagctaggtccagaaagagacctggaagggaggtggataatcataataaatgaaagccagcctttctagtttagttatgcacaaaggttaaaataatttgttagccaacaaagtgtttgtgcaattaccataggtctttaatcatgttttgccactattgccacctgtctgaaatcttagacatcttatgttctgttataacattatttgaagttgccccgaacattatcttatgtgatccctcaga

SEQ ID NO: 252131 - DNA, 478 bp, Homo sapiens
cgcgcgcgcgccttggcgggagccctgcgcctcccggggtctccctgctccttacttggacctcgggcgcaaggtcccctccgcgcagagctgaagccgcggcgggcggcccacgggggatcagaccctcgggcatccgcgtttcccctccgccgtccgccggacccccacctcttctccaagctccactcccgacttttcttccccgcccccgggaagctctggaaacccgcacccccggctctgaggtcagggctggcaggagtaatccaccctttccaggtgtgtggcgcaaacacggacgcaaagatctcccctagggtctgtaacaatttccaggctgaaaggtgataactccttctccttccataacataccttccccccgcccccacttcctttactatcctaactttgggaggaatattgattcttgatcaaagtaaatgcactgtcttacctttggtatcggcacaggc

SEQ ID NO: 252132 - DNA, 235 bp, Homo sapiens
gcaagttatttgtggctctctgaggcattcacttaacactgttctatagcgcaattttaggaagtagagttggaattttctagtccttgttagaatgttttcttcaatccagaagtgttctacaacacaaaaagccccatggtaaagaacaagctcacagaaagaacactgaggaatgacacttggaatgtgccactgttttgtcatccctgatacactgatctggagtgaactg

SEQ ID NO: 252133 - DNA, 949 bp, Homo sapiens
accacacacgtgtcctaattattccaaaggtgatacatttgcatgtttccctttaaactcctttccctctgtcactctgtggagggttcacatgctgcaatatttctgttccaagtaaagatcacaggttttgatcctcagtcctcagtatacacacctcttttagggatttctgggcttcttgactagctcaagctcttcagaggcatgcactttatcttggtgttcagtcttgactggtttaaacttttgatgtccagaaggttttcttcatgtgttgttgtgtggaattgtaaatattttctagcttttgtaaggttgtggctcatatttatatttctcctggtttgaaagaagagagagaaagaagtatgtcaaattgagactcttagattggaaatctgaatttatttacacgattgagattgatctagagttttattttttctgctgtaactgaaatttggattcaagattatatgtgttttgtgaatatgtttggtaacattgtgacttttctataatttagggaagtttgatgtaggagaaagagaaaaaatttttgagagaatcctaaattcatatatggcctaaccttttaatatctatgtaattttagataataaataatttgtttgagattatgtggctctaacaacacctgcttcacagtgtaattatgaggatttcatagaatttgtatagtgagcgttagttttgatgttactttaaacctctttgccttatacattctgttttttccatggaatattatatgatttcatgtccacatattaatctcatactttcaattacattttatgtttaaattgaatattatggtaatcgttatgtaaatgattaaaaatttaaagggacaacatttaatgttgctctggaattcacctttagtcataaaataaagatttaaagtatcatctgtagacaa

SEQ ID NO: 252134 - DNA, 506 bp, Homo sapiens
cagggtatgacacactggtgaccttataactgtaaggagtgtggataagtatttattagtccttgtgtgttttagatacatgaaagaatttactcaaaaggaaactctatgaatgtaaagaatgtggtaaaacctgtgtagtttcagtttctcttgaataaagtcatttcctggtattctcaggggattggttccagcaccccttgagaatatataattttgctcaagtgctttatagaaaagtgtattgcctataactaggcaatcctgtatactttaaatcatctctagattacttataatacctaatgcattgtaaatgctatgaagacaactgttttattgtatttagggaagtatgacaagaaaaaacaactgtacatattcagtacagacacaaccaccatacggctacctacctagtacacattatctacaatataacattttctttttaaaaaacagttatggattggtttcattaaatgacctgcaagcgtgtgtta

SEQ ID NO: 252135 - DNA, 499 bp, Homo sapiens
gtgagccacagcacctggccaatatatttttgtattaatttttcaattttgtctagtccacatggctcttaacactttctctgcattcttttctttgtcattttgtaattatcccaaatatttaccattctcctcagcttatccccctcttactttcagacacagattggatctaccttatctctgaaattgaggaaatacagctgtaaattctcttgacgtctccctacccccagtatttcctagttctaacacatttctatttaaccttaccaacctccaattttattctgactctttttcaaggccagtcctcttcctgtcttaataataccattcttatttccttctatctcttccagaacagtgctgtcagttttattttctcctattttttattttttatattttatatttctccttcttcaacctattcatttcttccaccttctttcctttattctaaacactctcaagtgtctcccattgggagaagaaa

SEQ ID NO: 252136 - DNA, 435 bp, Homo sapiens
gtcattgatgatcattgcctagatccattaattcatttagagttgcaaataatgatattccaattctattcgtcccttcatttattagctgaggtacttctatgaaaggaaacttctcctattagttattagtaactttgaagtacagttcatctagtaaagccggataaatgtttgattcttggccgagcacagtggctcacacctgtaatcccagcactttgggaggccgaggcgggcggattgcctgaggtcaggagttcgagaccagcctggccaacatagtgaatccccgtctctattaaaaatacaaatttagtcgggtgtgatgatacacgcctgtagtcccatctacttgggaggctgaggcaggagaatcgcttgaacccgggaggtggaggttgcagtgagccaagatcgtaccactgcactccg

SEQ ID NO: 252137 - DNA, 252 bp, Homo sapiens
gttggtttgttatatgggtgcaggctggaaatgtagggcagctccactgcagccttactctagagtggccaggaaagacaggggtaagggaaaaatcctcccaactggttccttcagagagggaagaatagcccaagttcaggacagctgtggaatcaagggcagcagcaagtggcttggctgcctagtcagaggccagaaacacaaagactggaagaggaagaattaggaaatcggggtaaagagacatag

SEQ ID NO: 252138 - DNA, 429 bp, Homo sapiens
tattgaacagaataccaagtactagcagcctagaccttaagaacattgattgattgcttaaggggaatctagaggtaagcagtgctatgtttggtttggcaactcagcacttcatcacacttctctcttaactccataattttcagcatgttgactttcatttttcataacctcatggtggcaagacagtggccacagctgcatcttgccttcacacaactccttcagattgggaactggaaaaggagctgaggctttctcatctggtttcttccttttgtcactgagaaaaatctttccctgaagaagggacggagaggtgttgagcaatcaatacaacagatgttttctatcttcctctgcctttctttatgaccagtcctccttgaaggtcttagcccatcttccaccaatatttaaaacatttta

SEQ ID NO: 252139 - DNA, 380 bp, Homo sapiens
ttaatattaatgctatattgcttcattaaaatttttttttcctctttctgtatttctcgaaaattcatttatcattggaattatctactccttaaaagtttgggccgggcacagtgggtcatgcctgtaatcccagcacttttggaggctgaggtgggcggattacgaggtcagcagatggagaccatcctggctaacacagtgaaaccctgcctttactaaaaatacaaaaagttagccaggcatggtggcacgtgcctgtagtcccagccccttgggaggctgaggcaagagaatcgcttgaacccaggaggtggaggttgcagtgagccaatattgtgccactgcactccagcctaggcgacagagcgagactctgt

SEQ ID NO: 252140 - DNA, 1001 bp, Homo sapiens
ccgggttgaagcgattctcctgccttagccttccaagtagctgggattacaggcatccaccaccacacccagctaattttttatatttttagtagagacagggtttcaccatgttggccaggctggtcttgaactcctgacctgaagtgatccacccgcctcggcctccgaaagtgctgggattataggcatgagccaccgcactcgactgagcatcatttttatttcagactgaatgagatataattaatacattaaaaatcaacttattctatattccaaaactgtagaactcctaaaatgtatcccagagtcaataataaagttatccactcacttcattagaggaagagtttgagctttggtgtcagaaaggtagcacctggaatccaagctctgccacttaataactatgaccctgggcaagctatttatccctcaagtctcagctcctccatctgtaaaatggtgtattaatgcctatctcaaagggttgtggtgaggtttaagtgagctaacttacataaagcactggctgtaataaggtactcgataattggtagctgcattctaaaccatcaagtttactgttagccacttctctcttcagaggttcacttaagatgactgcaaggtgagaagattcacaacctgagttacgagcttaagcaccttaaaatcctttaggagcaaaggactgactttagttactcttctcccagtagttggccccattcccttgctttccatcactgtataaagaagctcaattctggcatgatatgaaacaaaccatattttacttgactcaaaaacttctcctaatggaggaataaacactattgttaggttggaaactgaatgttagtcacagatacggtctgtaattttctaatcatgagagatgttacctggatgctgaaaaatgccaaatctcaaaatcctgaggggaggattcattactaaataaagaatggctagcacaaggaatgggaaagaaa

SEQ ID NO: 252141 - DNA, 596 bp, Homo sapiens
gacccaggttagactaacaatactatttatccctcaagtctcagctcctccatctgtaaaatggtgtattaatgcctatctcaaagggttgtggtgaggtttaagtgagctaacttacataaagcactggctgtaataaggtactcgataattggtagctgcattctaaaccatcaagtttactgttagccacttctctcttcagaggttcacttaagatgactgcaaggtgagaagattcacaacctgagttacgagcttaagcaccttaaaatcctttaggagcaaaggactgactttagttactcttctcccagtagttggccccattcccttgctttccatcactgtataaagaagctcaattctggcatgatatgaaacaaaccatattttacttgactcaaaaacttctcctaatggaggaataaacactattgttaggttggaaactgaatgttagtcacagatacggtctgtaattttctaatcatgagagatgttacctggatgctgaaaaatgccaaatctcaaaatcctgaggggaggattcattactaaataaagaatggctagcacaaggaatgggaaagaaa

SEQ ID NO: 252142 - DNA, 598 bp, Homo sapiens
gtaagaactgatattgaagcacaactcagtgaagttaatcctgtcaggctaggttcacacaagaaaacttctgacaaaatcctagaattccggcaaatgcaggcatggaatgagagattcctattccatctgcctcgttgtgcctggggccaggcctgagtgttgaagacagcttgttccaatgtaagatcaaatgagattgttcataacaggagtctgcaggaatatggcacctctgatttgaaatgatggatgattttcatcagccgtgtatctgcttccttggcagcaccccaagtgcagaccccaggctgtttcagtgtgtcatctggcaggcccaaacagaggatgtctcaattgtgcatgtgtaacacagctttaattcataatttcatttctggatggaattttgagcagatgggcattgctgtcctttttaatggtaaaaaatcaatgaaagacaccgtggttttgaaattaatgagcacttgaaaaataccagctttgtttggctttgcgtttttttttttcctctcctcctaagttgtttgcagcaaaatattcaattgaaaactcaacatgtccactgcctcccaaa

SEQ ID NO: 252143 - DNA, 455 bp, Homo sapiens
tgggagccgcaagtcctccgagagtgacgatgatgtgcgtggagtgcccagcccagattgaagcgcggccaaggcgggtcgctatctgggcaccgctcagctccagagggcgccactcccgcggagcctgcgggatcggggcttcccgggagcagcgcgatcagcaccacgactcggggacacagccagggcccggtttctacaggaagcgcctcatttggagcctttttgtgatagaatgatcattagtcctaagcccattcagaggttcaagaatggggtcggctcaatttcagggccttattacccaagcccggctgcccttcggtgccaccagcaccactgctccgtcgctgcggaattccaaaggcaggtttggcgttagggccttggccccagagaggacgccgagcgctccacggaaagtctccgcccggctcccagggcgcacactc

SEQ ID NO: 252144 - DNA, 681 bp, Homo sapiens
tgagtaaactccagaagaaactaccattgcataaatctggttggccctaggcagtcttatcattcttgtgttttagtctttgccagactcaaagtgcctatatttcatcccatgagtctgcaaacctgctttgtggtaacctgcctggctacttgccattcattaactgcttcttgacccatgttgattccctctgtcacttactctgaaaagacctgttagaaataagcttgtgatctgcttgagactttggcaatactggtttagccagaatagagaaatccttaagtagcacagcaatcctttctgaatcttctatttgtttcttctttgttctctgtgtctctcccacctaacatccctctccaatttaagtaatcaaaatagaaagaggggcccaggcaaggtggcccacgcctataatcccagcactttgggaggccaaagtgggtggattggtttagcccaggagttggagaacagcctgggaaagatggcaaaaccccatctctacaaaaaatacaaaaatcagctgtgtattgtggcatgtgcctgtagtcccagctacttgcggggtctgagacaggaggatcacttgagcctgggaggtcgaggttacagtgagcagtgactggaatgctactgcattccagtctgggtgacagagggagaccctgtctc

SEQ ID NO: 252145 - DNA, 843 bp, Homo sapiens
agcaataatacaacagaggagagggagcagcattctgttctagtgactcagaaatgccgattaaatacacaaactaatttagaaaaaaatgtgccctcctccaggcttagtcacaaagtaaaatatgcaaacagcatcagtgttttaaaaatctcacaaaactaaaacttaaactattttaacaagagaaaaagaacttagttttcaatacaagcaacaataacagacccccgcaaataacaccttttgtcatggtcggttttcatgttgctttccaccagtctgaattctattttaaacggattatcctacaagtggcagatatactgtcctctccagagtcagccttgaaatgaaacagctgatggtgggcctggcctgggtgtagggcgtgccccgatagcatctccactcaatgatccctccaacaccaccacagtatcctgaaccagttgtcaaagcaaagccacaacacctcacatcaaccaggtgccaaaaaagaactagtgtatgaattcagaattccgccaccagaccagaagtccttcaaaggatatctagataatattattgcacgcttttgaataaagggtttaaaaatgtcttccaacctttgcttggtggaaagccaatattttggcatgcaatcaggtaggggtaaggggaagaaccctcacatgttcagagacaaggaagtacaaaatatactagaagggaaaagcttgaacaagaaacctatgacttctatatgtgttccctgggggaaaaaatccacaccacgtgagagagaaatgaaacctaagagatgtcacaatttcaaaataaatgctgcaccataaatgt

SEQ ID NO: 252146 - DNA, 391 bp, Homo sapiens
gttggtgtaggtgaggagtggggtgggcattttgtctcttgtgaccccgaataatgtttccttgcagaattggaagcctctaggacaggtggatgccagctagatttagccattcacattggcaaagtaggtgatccatctttccacacactcttctgtcaggcttccagaaaggctttctgctcccatcccttaaacacctccctgtgtttcactgtcactgtgcctggaatcataccttcctgtagccttccagttcctgttcaggtggtatgtgctctgagaaggctgggaccataaatgctgtaatcagccgggaatagctaagctcagagccagagccaagaaggaaagggttacccaaaattgaggcatgaactgttgattcact

SEQ ID NO: 252147 - DNA, 468 bp, Homo sapiens
atgactgtgtctgaagatgcttctttcttatgtagatgtaactgtgttcacttagctgcattcactgagctgcacctgcacgtgttctgaatgtgtgacgggcattttgattaacattctgtgtgacctgaggcacagcacttttctgggcatcagttttctcagctgttagatgaagatggtggactttttatttttttcagcttggaaattccagggggcactaattatatgtgtataattggggcaatggaaataagttcagggttttggtgtcctgggagagggactattaatttgtatgcatctcagtcatttctctttctccaaaggtaactgttagaaaatcctggaatctctagaacctcaaattcttccagcccaattgtgaaactggagttaatttaattatgtattatcatgcatggtggcctttaaagaaaagaaatactttttcttgcattcccc

SEQ ID NO: 252148 - DNA, 572 bp, Homo sapiens
agtaatggataccatataacttgtgtgatactgtagcttttataatgaattacttcttgaaagttttttttcctatacaatgtattattaaacaattgtaacgatagtctctttttgtttaactatagaaaatggtagatagtgtggtacagcaaacaagattaacaaattttcgttggagagaaattatttgggctcaggcttgcaataacattatgatgattttaagaaaaattgcagttcctgtgagttatatattgataaggcagatttttaaacacttagttgctaaaattagttttcctaaagtcgtatttgggaaagtctgagtagagaaccagtaagtcactctaatcatcccaacagagagcaaatattttagtcttaaattacctcaaaaaatctgtatgtcgtttataatatgtaaatgcacaatatgtaaaggataacataagttctcgaaattgtcataagtccttcctaaaaactgaacctaagtgtttaggtatctgtactgttacagagatccttgaaaatatgaaataaagataatcgaaattaagatgaaatgt

SEQ ID NO: 252149 - DNA, 251 bp, Homo sapiens
tctcaaagtcagggattacaggtgtgagccactgtgcccggcctcctcagtccatttttaatactgaaggtataaattgtataaagatgtttagaaagttctaattcattttatgcatttttgcaaatttgactccatgaaagtgcattatcacgaagctgaatttgtgtaagcattgtgcatgtatgtaaaaacattgcaacttcctcaataaaatatcttctttttgtacatccatatttgtgaaagat

SEQ ID NO: 252150 - DNA, 280 bp, Homo sapiens
caatatttcatggttaaaaatggaagaatatttcagggctacgaaaattatatgaattcaaaatttgatgatcgtaaacaaagttttactgcaacatagtcatcatttacatattgtctatggctgctaccatgaaagaacagcagagttggatagttgtgacagagaccttatgacccacaaaacctaaaatatttactgcctgatttgccaacacctgctctaaaaggtctgttcagtggtcacaagataaagcattaaagccagtaaatgctcatat

SEQ ID NO: 252151 - DNA, 322 bp, Homo sapiens
gaaggcccggacaccgggcgacgcacaccggccagctcacgcgggagccagcgagaagggtcggcgcgagcgcgcgcggggtctcacgcggctcggcagcgcggagcgcatgctcagtccggcagctctccctgctgggcgggggagccggcgctccgaggcggggggaggagcgctcaagcagccgcccctgaccggagcgggctcggccgctgctgcagcgctcagcgcccgggccctgctgaagccgggtctagcatgtgccgcggctccccggcggcggcggcggctcctctgcagcagcctcagcagcagcggccgc

SEQ ID NO: 252152 - DNA, 453 bp, Homo sapiens
gctaatcatgcctccagccccattctctgattcatagctctggtttggctgtgttcctcactagaccattttgcctttaaactccacctgccacttcttagttcccctgttctctaggctctaggcagccccgttcctgattaaactcaacctcttttatcaagggaaggaaagtgaaggaatgtacaattgcagtccaaccacaggccaacccaggtgtctccgtgccaggatctgaagatcggatctgtcttgtttgctgtcatatccctaatccccggcccagtcgtggactcatagtagatattctgaaaaagtatttatcaaatgaatacactgacagtacagcatgatgattaggactgtagaactgggcatcagacagttctggatttgaaatctgactgcctcttactagcattgtgtctttttttttttttatttttttgagac

SEQ ID NO: 252153 - DNA, 934 bp, Homo sapiens
  misc_feature (934)..(934): n is a, c, g, or t
tataggtagtggtcaagcagtggatgaccacgaagtagtgggtatacagccatgggtggaattcagccattatgcagacaaagtaggaagcctgggcattctctgccattcttgaaattttctgcttaagtttcaggttgaaatgtttggttatcaaatgtcttaaaacatagccctgaatcccccctttttaaaatagaacctttatagccatatagagtttcatttcattaaaggaaaggtgtgacagcagccttgttaatcggagggtgaagaagatgatcagctaaagctttggcattcagtatggcccagattagcatttcaaatgcagatttctgcatgccctctctccccaacccccatctcctaattttactagtgaattgaattcctgggtgatttttatgtacgctaaaggttgaaaacctctattctggatattgtactgtgtcataggagagagcagaagcatccacagtgaaaggaagaaaacgcattttagattctggtattcctcttctttcacatttttaaatgttattaacatcaatacctactatttctagttaaaattcagatggagaagaaaaataatagctcccacgcattacatttgtaacttcaaatggtaagcctctcaggagcttctacagctgcttggaatttctatacaacgatcttacttaacctactttctttcagatcaattccttgcatctaaacgatgatgacgtttaccgaagctctcttgacacatcttgcaaacctcttgttgatggtacttaatgacagttcaacggccgcgatgattgctgtcacttacttgggaaccacctgccggacgactgcgtgagtcccttgcgattctaataaacatgtactagcttgtattacgaccacacgtctcatgttaccctggagtggactctcn

SEQ ID NO: 252154 - DNA, 349 bp, Homo sapiens
ttgcctctttatagccacattcactccttctccccatcctaccctatctccatccctcacccccagcagcacttccctattctacatttctgtaagttggtcaattcacaaaggttaaacaaatggaaacacacagtatgaaacatttttgtattgcctttttttccccacttggcataaatccctagagatctacccaagttgctgcatttttattgctgagtagtattccatggtatagatgggccagtttctgtagtcactcacctgttgaaggacacctaggctttttttttttttttccagtttttgactgtacaaataaagctgctatcagcatttgtgaaca

SEQ ID NO: 252155 - DNA, 501 bp, Homo sapiens
catgaaatacaacaatatacagatataacgattgaacctatcaaggataataatgggagagagatcaaagcgaaagtcattccctccagggaaagattttcctttgatcttctccattttctcttgggttttcacatgttttcattgacttaggatttctcccctgatttattaaactttgtgttatagtaattttagttgttgtcttcaagtcctacgcttgtttgctttttttgagacagtctgggcaacaagagtgaaactctgtctaaaaaaaaaaaaaagaaagaaaaaaaaagaggtgatcaggccaggagggctctgctctggggatggattaatgctgttattgtaggggtcagttcctaataaagggatgagttcatctcctcccccttgttctcactgtcacctttgacgcagcatgaagcccctcaccagatgccgcaccatgctcttagactttcgaactatgaggcaaataaacttctgttcatttaa

SEQ ID NO: 252156 - DNA, 712 bp, Homo sapiens
catatatggatgaggaggggcgtgagggagccgcgtgcagggcgggaagccttctgcatcttgagttgggcggtcgttacacaggtgcgcacagatacagacaaagaggggcgtgagggagctgcctgcaggggaagaagccttccgtatcgagctgggcggtcattacacaggtgcgcacagatatggatgaggaggggcgtgagggagccacgtgcagggcagcaagtcctctatatcttgagctgggtggtcattgcacaggtgcgcacagatacaaaaatttaccaagttgtacactcaagatttgtgaattttattctgtgtaagttatatctaaaaaaagaaaagaaaagaaaaagctagattccctaaaacagagacagcagggctcgagtctgagctagctatagccatgccagcagctagatccatgaaaaggttggggttggctttgcccaggtgatcattcggggacgggggacgtgctgtgaatggaagatgtgcctgctgtcagcactgatgttgcccaccctttatttctacaacgctgtcttccccgcacaacctggaaaccctcgcctggcgtcggctccatctccagatgttactcactggctaccgctaggtggctgcgaagggtggcggcgtcactgatgcgcagctcaggcagcagccatggggaggttgaatccccggggcatctgcctct

SEQ ID NO: 252157 - DNA, 512 bp, Homo sapiens
ggataaactatctgtatgattgagtttaaaaggcatggaaagactattacgaagtattgatcccactcagtgagagcaagcacagctttcaaatgatacagatctggctatgaatttgaatggtgactgtgcctagctgtgtgaccaagggcaactttcttaacctctctgggcctctgagtcctcgtctttaaaatgagacaaataagcccttgcaagacgcttgtgatgataaaataaaagagtatgggtgaaagtccttaacagaatgcctgatatgtagcagatactcaacagagttagcaatgtttcatttaattaaagcatttgagagcaggatagggagcaccactaacttcagctcttcaacaattttgcctggggctggctctggggaatagacttggattctcacgagtatgtgaatcttcagttacttccttgaaaggacagacagttataaaagcaagcagtgaagtctgggaaggtggaggagaatggttatggaaagt

SEQ ID NO: 252158 - DNA, 241 bp, Homo sapiens
gcagatgagccggtacctttcaaagcggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcatctccgctttggaaa

SEQ ID NO: 252159 - DNA, 376 bp, Homo sapiens
gtaaattttggagagggtttcccatgccttaagaagtcctatttcatggctatgatagactagacatgaaatatatctctccgatgacactacagctgtgaaatatagcctgtttgcactaaatgaaagtactcacattttacacatcacatagcttactagtttactttcccaaactggctctgtctaccctttgggaggtcacattatcattgggagaatccaaactgctccatttggacagtttttatggtggattccttccaaaatttgacattagctctagaaaagggttccttataaactaaaaatgcaaagtaaatcattcttatctattcaataaatcttcccattaaaattcctcctgccattgggg

SEQ ID NO: 252160 - DNA, 185 bp, Homo sapiens
accccagcatcgggccaggtcagagtgaggaaccgactatgctggctggccagaaggagggctggccaggagaggggggcccagaggagggggacccagggattcaggcaccctcagaagaagctcctgagacttgtgtctctgagagctaaaaccaaaacatatgagcaaataaaccaagtaac

SEQ ID NO: 252161 - DNA, 574 bp, Homo sapiens
tgagcagctgtggaaactggttagtaactaattctttacccagatgttccttcaagatttcattacatcttgcagtgatcattgacaccagttgtcactgtatggttaacagagatcttgaactggccaattaccaggctaatggagaattttttttttaatcgaatgggatactgcagtttttagacctttttgagtagaggaggggagagtatgagtcttagtttatttttaattgtccaacaaattccaagttcttaattaaaatattgaaaattcattacttttaggacaaaataattcattttataaatgactaagacttctgtcgtagaaagccctggagctctgcttatcagaaaacactctggataaggagatgtgacatgctggttttttgtgtcatctttacgctataaacttcctctgctaatctaagtattctttgttcacgtgagactgcaaatttaagctgctgcttctagcaagatttccaccatatgctagaacttaaatagaagcgtgttttttgtacatttctgttatgtgtgaaaaataaagttttgaaattata

SEQ ID NO: 252162 - DNA, 412 bp, Homo sapiens
tgaatgggccttgtttggattctaatttaaataaaccaactatagaaaaacatgttttaggcaatcagattttttgttatgggctaaatatttagaagatgttaagaaatgtttattaatttcattaggtaaaataatgttggtgtggttatgtagagtatgacttacgtgcacagaacagaatgataaggtgtccaggatttgctttaaaatattctagatttttttaaaaggtgagaggaaatgacacatgtatatctaaattttgatggttgttgaagctggctggtaggtacctagtatttcattatactttttcctttgtgtgtttggaaatttttataataagcaggaaaaataaaagtaagaatatatgtattatagataatttgaaatatgtagaatcatgaaa

SEQ ID NO: 252163 - DNA, 347 bp, Homo sapiens
tgagacaccttggacagctcctggcacatagacacctcccagtaatactagcaggtgtgaggactgggatgaccccttcccattaaaccaggcagtttctcctggctcatgctgggcggcccaaaagtcccctccttaggaagccaccttagattctgccaactgtggtaactttgtctgcacctcagttatagcttttatgacataaaaatcatatgttcaggctgggtacggtggctcacacctataatcccagaactctggggagctgaggcctgcagatcacctgaggttaggagttcgagactagcctggacaatatggcaaaaccccgtctctactaaaac

SEQ ID NO: 252164 - DNA, 446 bp, Homo sapiens
accaagtccttgcctgataaggaaataaacccaacagtaaatcaaatgtatgaaggaaagaccaggcatgtttctttgtgttctcaagtgctgaaagcaaaatagcatgtcaaaaggctgatcttcattcttagttatgtactagactaatcaagtcccagaaagagtaaagcgatcagttcttttactcaggcagaagttcttgcccatttctttggatcatgtccctggtcctccttgtattctacagtgttgctgtgtgggagaggagccttgatggaataccaaagcccagtgcacgtgagcaatctgtgagtggtccagctcatcagcaggcttgtatcttacgaggtttccttctgagctaggagtccacttcagccttccttcagagaacgtttcctagaatatgtacttgtgattaaactattcaaaagttgttttct

SEQ ID NO: 252165 - DNA, 582 bp, Homo sapiens
ccaataactattccttagtcacctaagtttcagcttattatggaggctaaagttcctaaccacctgagttcaaagctcaatgtggtcaagtatgagactggctggaattgctggaccttaaatctcctttactccttcaaactcaaaatgccagtgctatcacagacaccggcattgttgagcccttctccctatctcacaacctaaatgatgttaggtatcttacttatcagttcctcagtaatctaaaattcatacctcacaggtattttttggactcaacatggaagcatcatcattacaggtaaagactataggcttttaaagttgaatagacttgggtttgaaggccagtttcatcacttactagctgtgtatcctcaggctacacaacctttttgaacctttgtttctttgtctgtaaatcaggataacagtatcttctacacattggttttataaagattaaataactaatacatataaaacactaagcaccaggaagctattttgtccaaaactagatagagcagagtagtactcaactgcctggtttgaatctcgcttcttaccaacagcata

SEQ ID NO: 252166 - DNA, 463 bp, Homo sapiens
tctggtttgtcaatcatcaaggccagactgggccagaggggctttgtcaggtggactcagagagagactcacttgtcagtgcacaagagggcagccactgcacagacataggctgagagctgcgaagagggaacctaaagcaagtgtcgccagatatccccattattagttatcagctaactcttagttttcagttaacatcatagtttccaggaaatattttagttttctattaatattttaattaactactagcatcagagtcatcagcaaatatctaagtcatcagtaaacatcttaggtgtcagtttcctctgagtgaatgtagtagacctcttagtcatcatttacttcattattaccagttatgcactaataattagtggtctgctaatatctcgtctaccaatcatcttcagcaataaacatgctttaattatcagctgataattaatgtagccat

SEQ ID NO: 252167 - DNA, 352 bp, Homo sapiens
cagggccatcacgcctgctcttccctctttctggaatgttcttttggcatctctcctcacagtcgcattcactctcacttcttcaggcagcccttcatgatcactctgtaaaaagcaggtcaccccgccactccctgtcacagcacccgggccattgcctgtgtgacgcataccagaatgttctcctggattccttatgaaagtgttcacatgctcgttgtctatcactggggagctctagtggggtttttcctgttcttttattgcacccctagcacgcagctcatggctgtgttcatgaacaagtgtaagttgtaaataaatttcctctctgtccacctctctccacaca

SEQ ID NO: 252168 - DNA, 496 bp, Homo sapiens
cagatattgctccaaagctgtttgttaaatacttccctactcttcctaaacccctgcccctccccaaaagaaaaataaatcatattcagaccatcgtgcgatggttatatctctggcctccctggtcacccagcctctagctctctgctagcaccactccaaattgctgcttcaaaagaggtcagtcagcccctttcccttactcctcaaccatgacctggtctgtctggaaagaggatgagatacatggaccaatacatcctatttaaaagggagcttgctttctcactagggactttagactgcctgacacacaggaaatgactagaaaatctgaccagtggagcataactcattgctaaaatggcaggtttggacggctgcaggatgggagagcaggcttcctgaagaggcaggaaggggcagctggatgggaaaacagtgacttttgagtttttccttttagagtatggtgacgtaggccgtttattaaaaa

SEQ ID NO: 252169 - DNA, 230 bp, Homo sapiens
agaaaaaaaacccattctaaaatttgtatggaatctcaaaggaccccaaatagccaaaataatcttgaaaaagaataaagctggaggactcacacttcttgatttcaaaacttactacaaagccacagtaatcaaaacagtgtggtacttgcataaagacaaatgtgtagaaaaatggaatagaataaataaacccataatagaataaataaaggcccagaaataaacct

SEQ ID NO: 252170 - DNA, 130 bp, Homo sapiens
caccaaaaataaggcattattgttcttaaataactatttttaatgccatttctgagtgaatttcctcccggaaagacctgcctagaagcattcatgcatagttttcaggcaataattttcaagaaatgta

SEQ ID NO: 252171 - DNA, 444 bp, Homo sapiens
gcttgggaacttttcagaacgtcctcagaaccgcaggagccaagaggaaatctcccgtaggggatctcaggtagggcgtgccaagaaattccaagagacgggatggagaagagaagccggagaaaaatcggccaattagactcctgtaaaaatgtgtgtctccatgtttgtcctccctcctgaaataagaaattcatagctgggggtggggagtagatgggggctgggggaaaaactttctcacattcacggagcagcttccctcaaagcggcacggaatcgggaaccccactcaggacaggggaaaacggccaagttcctagaaatttgttttctttgtggggagcaattcatgatgggcgttcttgtctggtttccccccactccgtcccctgacgccgagtaacacttaaacctttctagttgcaaagtcaaatcagagtt

SEQ ID NO: 252172 - DNA, 445 bp, Homo sapiens
aagacagatgtttatgaactgtacagaactgacttggagaaaatgttttgaaaaaggccaaaacagaagaaaatgtgaaagagctttaaaatgttctagcccaggggcctgggggcaggggtgctgttggaactgggatggatggatcggggagatcaggggagcagagccaagattccctctagagttaagggcagatggaaagtggtgcttggagaaatgcagggccacagggaggcaaactcagggtctgcctgatccgtgtaaacaataattaaacctaatcttatgatctagtgacttgtaagaacagccaccacctacagctacctagttgtgcaaatgttcacaatattatgctcatactaatatacaaatgttcacaatattatgcaaatgttcacaataatatgcaacacttaatttggcaaactcccaggctcaa

SEQ ID NO: 252173 - DNA, 295 bp, Homo sapiens
cagcctcccaagtagtggaagcacaggcatgcaccgctaggcctggctacaatgtctgacatttggaaggaagatattaagactcagaaaatggtcaaagtgtcaactgctgaaaaatgtccaaataggttgatgcaaaggacattggatttaactacaaggtggacttggtgacttctgatagcagaatttgaatgaaaagactaggagagtctgtgtagatacccaaattgaagggatagtgaccgtaataattgcctacaagataatagtgctgataaacatttcaaatagt

SEQ ID NO: 252174 - DNA, 1617 bp, Homo sapiens
ggagaatgctgatagaatggtatttttggatcaagataggagggtgtgatatgggaacttctagtccccccctttctcaggagagagctgtcttttgaagaaatccatcgcacgaaaagcaggcgagagaggggaaacctgacattgtttgagcccctgcagtcagctgccatcaaagcctttgacttcgcatgacttgaaccactgaatcattttttttctttttttttttttttgacagagtctcgctctgtcacccaggctggagtgcagtggcacgatcttggctcactgcaacctgcgcctcttgggttcaggcggttctcgtgcttcagcctcccgagtagctgggactacaggcacccgccaccacatctggctaatttttgtatttttagtagagacaggattttgccttgctggccaggctggtcttgaactcctggccttaagtgatccacctacctcagcctcccaaagtgctggaattacaggtgtgagccaccacacccggcctgaattgtcttttatctcaagttccttcattgctactcaaagtgtgctccacaacccagcacagccacatcatcggagagcttgctagaatgttgggccctatcttagacctactgagtcagactctgtattttaagaaggtgcccacgtgactcacgtccacgctaaagtttgaaaaatgctgagctacttcaacctggactttgtcacctataatagaattaaatccccttcatcagttgcgacaacagaaaccccaactcaaacttccctaaatcattagggtatctttgattggccaggtgcaatggcccacatctgtaattctagcactttgggaggctgaagcaggggcatcgcttgaggccaggagtttgagaacagcccaagtaacgtagcaagagacctcatctttacaaaaagttaaaaaaaagaaaagaaaagaaaagaaaaagaaattagctaggtggtagcacgagcctatagtcctagctactcaggaggctgagctggaggatcccttgggcccaagagctggaaggctgcagtgagctatgtttgcaccactgcactccagcctgggccagagcgagacactgtctctaacaaaaaaggatatattttacttaagaagccccatggtagagcagactcgagagactcaactgagccaagcaaagatccagattttcttcatctcagctctgtcatcctcagtgtggacttcattatcacaccataccaaggtaatcatcagcaggtctaggcctgatcatgtctctaggccttcttaggagtgatagaatctttattagaagcctcctaggccgggcgcagtggcttacgcttgtgatcccagcactttaggaggctgaggcgagcaggtcacctgaggtcaggagtttgagaccagcctggccaacatggtgaaaccccgtctctgctaaaaatacagaaatttgccaggtgtgatggcgcacacctgtaatcccagctactcgggtgactgaggtatgaaaatcgcttgaacctgggaggtggaggttgcagtgagccgggaacgtgccattgcattccagcctgggtaacagagcaagactc

SEQ ID NO: 252175 - DNA, 464 bp, Homo sapiens
aggctgaggttctgactgctggcctaaaagaaacagggtctttctctgtcccccaggctggagggcagtggtacaatcatagctcactaaagccttggatttctgggctcaagcagtcctctctcctcagcctcccaagtatctaggactacagccaggattcccccagttggactctcacatacctgtggacctcaagtgctccttcatatgtgttttcaatgaacttcatccaaaccacatcaaatggctgtgtataacactaaggaaatgtcatattgtctcctagtcctctaccatgtcttttacacacactgaagatcatgtgaagaaagagagaagatggtcatctatacaccaagttaaacgaccctcagaagaaaccaaccctatggacaacttgatcttgaacttctagctttcagacctgtgagaaaataaattgctgttgtttaaatttaaaa

SEQ ID NO: 252176 - DNA, 689 bp, Homo sapiens
cgattggcgggcacttacaggtggggattacagagaatctcttatccaacatcaacagtctggtcagatttgaactcttcaatctcttgcactcgaggcgttgtaagatagttaagcgtgcataagttgcccgccaatcgattcgattgcctggcaacttaaagggcactggtagatgttattagtcttctttttgaaagttcttcttctctcgctccttttcaagtattgtttggttgatttgctaatactccttaaccttgtctttttggctccatagggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagtgagtaatagtcctgcacaatgttgtgatctctgttcctcttgccccaccacacatggctgggtcctgagggctatagacaacttactgatggtactcaggaaaaaggaactaaggaaaggaggagactgaaatctttttaatcctaggcaaaagactagtgactcactttaagtaaagtaaacccctaggagaaagtaacctcatgttggcta

SEQ ID NO: 252177 - DNA, 525 bp, Homo sapiens
ggagtttttaagattaatgagttcgtacatattaggtcagtagaatagtgtcgcgtacatagtatgcactcagtaagcattagctactatatgtctttctgtctctctgtttatctatctgtccatttatttatgtatttattgagacagagtcttgctctggcacccaggctggagtgcagtggcatgatctctgctcattccgagttcaaggaattctcccaccctagcctcctgagtagctgggactctgacactaaaaaagacactaatttgtttctaaatcatgaagttttactggttatcttatatgtaaaacattttagcctatatattataaactgtagccaatgattgtgacctctatagtatagctcctagtagaaaaagacaaagacaactgtgggccaggtgtggtggttcatgcctgtatcccagggctttgggagaagcatagaatttttagagaagaatttaaaataatgctgtgcctaggcaacatagtgagagcctgtctctacagaa

SEQ ID NO: 252178 - DNA, 455 bp, Homo sapiens
tggaagaattttctactctgaagatgccacagatagtgtcatccccagggcaatgacacaatcctaggaccagctcacttccaatcacagaaaaaaggtggatccccaagaatacccactgaattaggcaccagatctgatttggctctgtgtccccacccaaatctcctgttgaattataatccccatgtgttgaaggaggggcctggtgagggggtgtgtgattgaatcatggaagtggatgtcccccttgctgttctcatgacaagagttctcacaagatctggttatttgaaaagtgtgtagcacttcccccttcactctctctcctgtcaccatgtgaggatatacaggtttcccctttgccttccaccatgattgtaagtttccccagccatgcctcttttacagcctgtggaactgtgagtcacttaaacctcttttctttataaatt

SEQ ID NO: 252179 - DNA, 405 bp, Homo sapiens
gagagaaagagaaagagaaggaaggaaggagaaagagaaggaaagaaggagccttctaattttatttcatttctccaataaatgttcctatattaagactttagacaaagattagaaatatgatttgacagaaagtgtatggatgtgttgttctattgcattgtaagtaaagtatccatggcaatatacaaataatacagctcctacccctattctctgttgttactttcatgtgttgtcttaactttttaaatttcaagataatattgcgcttatttatttttccatgaggaggcctaggatttagcttgattagaaaagctgtggaaaatgaatgtgctaattactttaaatcaaattgaaaataaattttatcctgtttcatgcaaaacatagtgtatttga

SEQ ID NO: 252180 - DNA, 559 bp, Homo sapiens
ggcttttacttgagaaagaggaagagaaacgtctgtgtttgcagtaaaatgtatgcccttccatttttgcttttaagcattcgtaggcatagctattctttccatcagagtggaaggggtgggtgctgggtgctgtgtggttacgatgtcaaaattaagatggatgagggagcaaccaagtgaaacatccaattcctagttttaaaatatcccctcccccacctccactaagcaatattggcaaagcaattttataatgtgtgaaagccacacgaagagatgagaatgcagccctccgtaatattgttagtggaagggctctaaaatttgttccctggcctatttgctcctattttttcaatgggtttcatatgattttagaagagtcctgtatgtaaaatgtcatcattttcacaccaaaataaattttacaaaaatagaaacaagaatttataaaacaatggattttaaaaaggcactatcacattaaatcctgtcatttagtgaatgcagaaactgagatttagagagggtaaactgcttcgttacaaaaaagaaa

SEQ ID NO: 252181 - DNA, 1104 bp, Homo sapiens
aacaacacttccctttctcaagcttaggaaattttttaaaagttacggaaagggccccatagtgcacttcggttggaaagaactgtgtactgcacgtgattatttacagccaagtggagagtgactggatcctaaatacatgtttccgtccctcagcccctgtgttggtctgtttgcttaataatgtaattagtgctcagagggagaatattgacgctgctgccagcaggctttgctcttccgtgcgtttccgaaccgttccttttgcccacttggcttttgcatcacctagtttggtagcttcagctgtgcacctagccatgcctactccgccccacacactcctcagaggcccctctcctaatagaagcccaactccacactccccacctgcgggctgtctagttctacatttgcgaggttcacatcttaaacgttcagatggaatgttccttgagagaagcagctatgaagaccacctctaatttctttctgaccttttagtaaggaaaggttggacgtactgcttgctgtgcatttccctagcaatgtcccttatctggtattaatctgtcagtgacttggggcccgactcactaagacactacccatcttttaatgcagtcttgctggaggctgaaaatggtgcaaactccactatctggaaatggaactctgggctaatacctcagctcggcaatgtttttccttcttaccccagctggaggtgaagacagtaactcttactaagctattttctcctggaaacacagacgctccctgagagagaatgagagaatgaccagtgatgccatctcccgttggcagcgccatgctgtggtgcggcccagatgggcctccatgggactgctgctacccgtgggatcacggcccctccgtggatttgggggatctgagaacacgttttctcaggtgtttatctggcaacctacaaaatcccccagcccttctccagtagaagcccagaagggtgattatggtttaaaaagccaagtcataaatcgggctttctctactcaacttgctttgtagctgaggaaatccgcagagagcaatttaaaaggaaaagaaaaaggctgagaa

SEQ ID NO: 252182 - DNA, 447 bp, Homo sapiens
agctaaacaactatttcctactttccaatttggctttaatgagcccgtatattctactttccaattttgttacagggggagtgtaacctaaaggtcaggttcagtctcctgtcccctgagatctaaggacaattgattcaacaccctcctctaatcctcatagggtagagaagtccaagctttccctagagcaccttaaaattccacgtcacccaaaagggatacccttctcagtttccacataaaatgctctcccaggcagtccccatgtaggaggcttactaaaagggcctatttcctcactggttttaaaaaaaaaaggcatcagctggtctctttggactctgccagcccccaaatagtgaatccttctcattcttcctttttttccatctctcccacttccttctcctctcttctcaaccctcctttccttaaaaaaaaaaa

SEQ ID NO: 252183 - DNA, 636 bp, Homo sapiens
ttttaaaagagaaaatgcctagcaggtaaagatacaatatcacagtttagaagagagaacagggtatcatcagtaccatcaaaatattattaagttttactaagtacttggtaggtgcaaagtaccatgccaagagctctctaggttttcactcatttaataccataaatttaaaacgtagaaactattattatagccattttacagatgggaatactaagattcagagtggttaagtagcttgcccaaggttacaataactggtaatgcttagttttcaaacctgcacagtcttatttcagaacctagcctttaaacaatctgctagtaaaaaaaaaattatgattttgcctcctaacaagccctgaaaaaaaataaataatgactgtgaacaaaatccatcccttcctccaaattacacacagaaagaacgtgtaagttttcttggcactagcctaaatgcctatttcctaaatttaactcaaaactttgctttcaaaatatgcacttgctttatttacatttttcctgtttaaaattaatgtattaaaactttttgattttatttaaatcttgagttttctaatatgatttataaaatattgacagtgaagtaaaaggtaaatacaaacaaca

SEQ ID NO: 252184 - DNA, 507 bp, Homo sapiens
ttgcgccgtttcagtcctccagtcgctgttgaatggagtttccgtctccagtctcagccaaagcaggcaaggcggacaacctcggcctggcaaccagaagtatcattccttgattcaggatcaggctcaagagttaacccaactccgaaacctctgtaggggccgacctgctggaaaagaatcttgctgagatacagaacctgcgccagcgcctggaggagtccatcagtctcaatgaccgcctgagggagaggctgcagcatgtgcttagcaatggtgaccaaggaaaaggtactgcacagtccactgtagcccctcattcatatactcagagtcactcttctggctgtggtgaggacatcctgtgacatgatgcctagagagtctggaagaatgttctccagaacttttccagccctatccaacagaattcttgggtgggaacttggaggcattggatattatctttaaatgaagagatcaaattaataaattatttttaaaatt

SEQ ID NO: 252185 - DNA, 545 bp, Homo sapiens
cactagtatcttgaggaagatgcataatatgagtaaagtgacagaagtcctagagaccaagtgggatgcccggtcccagactcagccccagatctggtgcagcaaccacacccggtctagcccacatcactccctgagcagcacgtctccacagcttgacaaggaggaagtgcatccttcagtgactgtagtcataggggccgacctgctggaaaagaatcttgctgagatacagaacctgcgccagcgcctggaggagtccatcagtctcaatgaccgcctgagggagaggctgcagcatgtgcttagcaatggtgaccaaggaaaaggtactgcacagtccactgtagcccctcattcatatactcagagtcactcttctggctgtggtgaggacatcctgtgacatgatgcctagagagtctggaagaatgttctccagaacttttccagccctatccaacagaattcttgggtgggaacttggaggcattggatattatctttaaatgaagagatcaaattaataaattatttttaaaatt

SEQ ID NO: 252186 - DNA, 384 bp, Homo sapiens
gagacggagtctcactctatcgcccaggctggagcgtagtggtgcgatctgggctcactgccacctctgcctcccaggttcaagcgattcctctgcctcagcctcctgagtagctgggattataggcatgtgccaccacgcccagctaatttttgtatttttagtagagatgaggtgtcaccatgttgtccaggctggtctcgaactcctgacctcaagtgatctgcccacctcggcctcccaaagtgctgggattacaggcatgagccaccgcacccggcctactgtcctttttttaacttagtatgcaagtatacaactctgcgtctttgggtctccatttcttatgaaggctcccatgccacattaaacttgtattaacta

SEQ ID NO: 252187 - DNA, 367 bp, Homo sapiens
cattcccaatgccatttaactaacaggaagcagaagctgtctaactccatttgtcccaaattaaccaccactctccagtgcgtttactttttctttattttgctttgagcccacatcaaaaacaaaaaacaaaactctggttcatcgacctgactgctgattgaaagagctgacagtggtagatgagcaggagatctctttcagaagaccagtacctttggaaatcttgaggaatcctcattgagaggaaaagttaagacctaataggttattttaaaagaatacattgattccaatgacttatgttttagaatgtctttcgtatcataaattacttaattttaataaataaagtgtataaattaaa

SEQ ID NO: 252188 - DNA, 711 bp, Homo sapiens
catctgtcatccatctagtgaggtcaggagagtggctgcttaacttctgggggttgcagaaaaggaagaagaatcagcagagagcatttgtggccagcaaagcttaaaatatttcctaaccgatcctttgcaaaaaaagttcacccactcctgtagtcagcagctcccctactgtgcgcagtcagtgtgccatctcagactagcaaagttgtccagagaggaaagacaggccaaaatagttcagtatgctgtcttactgggaggacaacagcttaagccacaaagccctgagtttgaccctagaactctgtggctactggtgactcatcttgaaaattatcagattgaatcttctctaccggtttgataacaactgatgagtggaaaaagaacgccaatcaaatgtgcatgcttaataagcagcctccttattcccctctgcagatttgtgcttggatcatctacacttccctgaatgttgaagaagatatgctatccatgcaatccttgtcgactgcttgattaaaaagtggataaactgtcttcaggcccttggagtatggtgtctgtgtgaagaagggaatgaggcagaagtagcagtcagtggtggctgaagtaggagaatcgcttgaacccgggaggcggaggttgcagtgagccgagatcgggccattgcactgcagcctgggtgacagagcgagactctgtctc

SEQ ID NO: 252189 - DNA, 308 bp, Homo sapiens
aaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttct

SEQ ID NO: 252190 - DNA, 555 bp, Homo sapiens
ctgggctttaagtcatgggcacaaacatctttcacctcccaccctggccaggtgacagtgccccttgcctagttcctgaccctgcccttgagtcttggttagtctgagtcctccaagaaggggctagggagttttttacccttgcctcccctccctggcctcttcccgtctgcctggctacagaggtaactgagaaaggattgctctggtgccaggtggcttttggctcgcaacttatttcctgtggccggcccttaacaacttgtcatccctccctcccctcattcccgggggcccccacgtgaagccccatagtgggtcactcgggggctgtggccacctcacccttgctttcagaactcccctattcctctcctagaacacaccacaacctacctgcaggaatacccatggctgggggtgggtgggggcaggtaaagggcttggaacagaagagcaacgctgggcagcagggcagggggagcaggtgttgctgtgccctccctggtggaaggctggcccagagagcctgctcaggaatgaggcactctcagg

SEQ ID NO: 252191 - DNA, 442 bp, Homo sapiens
taaaacaggcatgctaatagtgcctccccacagggctgtggtggaggacctaatgagagcgtgcatgcagggggacattggcgaagccatcactcacatggcccctgggtcccccaggaagtgcagggcacagaactgagcaaaggaactggagaaaggcaacagcgctgccctccaagtctgaggacctctggagtcttatccagatagccccaccctgccctaggttctgcctcctctgtaccaggcaccatggcaaggtgcttataagcacagattctggattctgacagagctcagcaaatcatcgtgttactttgggcaaatcattttgcttctctgagcctcagtttcctcatctataaaatgggcatcattacctcctagtacaattatgaagatcagatgagctaatgagtataaaaaaattagcatggtatct

SEQ ID NO: 252192 - DNA, 746 bp, Homo sapiens
ctgtaatagactgtctcaacttgtcaactctctgagctgccacagagattgtttggtgtaggatttagaagaaagaattttggagacaatcttggatttacatgccaacttcacttaacggtgcacagtaaagtggccttgtgaaaggtacataataatctctaaaccccagtttctttacctgtaaaatgggaataaataggatgtgtacacaatatatacgacaataaatgtaaagcacttagcataacatcacaaataataacaataatactcattggagatggtcctgtgtgtggccttatactttctattccagtttttctgaacctcttgagctaaatagtgacagtaattttggtatggacaacttgagtaaagtttttgccccgtggactaaggggccagagagcagtgtcaaaaagcatgatggcaggattttgaatgtgacagatcatggaaggagtttgacttaaggagatttatggacttcaagagtagagatcggcatagccacttctaagtgtactcagccttcttgctcccggagactaagaagcggttaaacatctgagctgcatcactgttcgtgacaggaattttggatacaggaggctttttcttattctttatcctcttattctctcagcaagatctggtagttcatctgtgtctggattttcactacctgtaggactaccagcttttggattatattaataaccaggcctgaacccaagtgagac

SEQ ID NO: 252193 - DNA, 413 bp, Homo sapiens
tatgcatgcagatgatacggtgcctggcattctgaatacatgcactaaatccaccacttttccccatttatagatttggattaacacactaacttactcatatctgcaagtataaataaaaaaaattgctggtgccaatttcaaaaaaaaaaaaaaaacagaccaagccaacaggaacccagcaatcgaccaatacagctgtgactctgactggctagtagtctctggcaccctgtccgtctccagccagccagctcatttcactttacacgctcatggactgagtttatactcgccttttatgaaagcactgcatgaataaaattattcctttgtatttttacttttaaatgtcttctgtattcacttatatgttctaattaataaattatttattattaagaataaaaaaa

SEQ ID NO: 252194 - DNA, 568 bp, Homo sapiens
  misc_feature (58)..(58): n is a, c, g, or t
  misc_feature (78)..(78): n is a, c, g, or t
tgccaaagcgtagtacccaataaacagagaccatagctactagctaaggagaatttanaaacaagaactgaattaganagaggccaggtgcagtggctcacgcctgttatcccagctactcgggaggctgagccaggagaaaggcgtgaacctgggaggcggaacttgcagtgaggcaagatcgcgccactgcactccagcctgggcaacagagtaagactccgtctccgagactgaaataaacttgaaggggctaataaagacatgtgtgagacagtccatcagtggcacaaggcctgtcttctcagaacacactacaccaaaacacactgcattgggtactacgctttggcatgccaaagcgtagtacccaacacgacagttttttgacctgagtggtatcagaaataggctttactataaccaggtaaatacctgaacaaaggaaccctcatcaggaaggcactgtcactcttggcagcagcaatcccacaggaaaggagttcccctggcagagacagagagacagctactcatctgacaaaactctctcagtctgtcctttgcc

SEQ ID NO: 252195 - DNA, 314 bp, Homo sapiens
tcgatacgacttttttttttcatagaaaatgacattagcagtgtctcctaaggtcattttctatgaaaacataataccgtatcttgaatcactttcttcatttggtttcttgattctcctcatatttcactggctccttctcccaggtctcttttgctggttcttcttcagcttcctgacctctaaacagtggaatacacagggctctgtcattggatctcttctcttctccctctacatacacattgtgggtcatttcattaactctaaggccttaaatgctatctacttgctgatgacttccgttttctctc

SEQ ID NO: 252196 - DNA, 799 bp, Homo sapiens
gacaaactacaaacaattagagaactcaggtaaaatgctggtgtacacatagggtcccaagttgacgagtagcaccaagcagccatcttgaaacagtctccccggccctcctcttgataattgtctctggtgaggactaaccacacaattaactggtttagattttctgattttcaaatgatatgtttatcctcccaactctgaatattctcttcaagaccatgtcctcagattatccaacggaatctttttggcatgtttatcatctgaaagccaccagctgtactcggtttgtcccctctcctgtgacagtgctggtcctacctgagacttttcaacttgtgtgaattgggtcttccaagcattatcaaaggaaaagcaactttccagggaagggtggttgtagtaatcatcgtgcctatgtctcttgcaataatacttaaaatcagatggtgctgacccacttagaaacaaggattaaagaaatctgcttagaattgaattgagtccaccatagcaacttgccaagagaaatgcattccacagaatgcccttcagagaacctctcattagccagactgcaaacctttgatttcttttcatttaatatatgactgcctggaattcatttaaacatggatgtgatacatgttcatatgtatgttcacagcatattagtctagtcttttatttttcctggacaacatacacaagtcttatgtaggacttagtcatctgtagctctaacctaaattttaaaagttgtatatttttaataaaaagtatatatattctaaaa

SEQ ID NO: 252197 - DNA, 723 bp, Homo sapiens
gacaaactacaaacaattagagaactcaggtaaaatgctggtgtacacatagggtcccaagttgacgagtagcaccaagcagccatcttgaaacagtctccccggccctcctcttgataattgtctctggtgaggactaaccacacaattaactggtttagattttctgattttcaaatgatatgtttatcctcccaactctgaatattctcttcaagaccatgtcctcagattatccaacggaatctctgagacttttcaacttgtgtgaattgggtcttccaagcattatcaaaggaaaagcaactttccagggaagggtggttgtagtaatcatcgtgcctatgtctcttgcaataatacttaaaatcagatggtgctgacccacttagaaacaaggattaaagaaatctgcttagaattgaattgagtccaccatagcaacttgccaagagaaatgcattccacagaatgcccttcagagaacctctcattagccagactgcaaacctttgatttcttttcatttaatatatgactgcctggaattcatttaaacatggatgtgatacatgttcatatgtatgttcacagcatattagtctagtcttttatttttcctggacaacatacacaagtcttatgtaggacttagtcatctgtagctctaacctaaattttaaaagttgtatatttttaataaaaagtatatatattctaaaa

SEQ ID NO: 252198 - DNA, 661 bp, Homo sapiens
ctccacgtgccactgaggctgagcgaggaaaagtcatggcaaagaaacctgggacttagaaatagttccacgcatgctcagcgaaagaacaaaaggctgcatatgaactggacagtgtggaatgagcagacctgtagcacgggaagcagctaaactggacggtgtggaacgggcggacctgtagcacgggaagctgctacaggcactgggaggagaatgggcagcagcaaacggccttgggagacgaaaagcgtctcaaaaccaattgtggtgacggctgcaactccatgaatgtccacgtggacatttccacgagtcacggccgtgctataggtatgaggattcataactgtggtcagaatacggtgctgagaataaatactacctaagagaaggaggtgagagccctacgaagtggggtttgttgtggaccccgttgagtgtgtgtggggtctgtcttccgagccaccgagcctgggctgtatcgcggtgctgttcactctgacagagtgcgcctgaaggacgtagcctccaggtcccagagtcacagaagcgtcagagcatcagagcatccgtctcatcgcatggaccagaaacaagacagtgggctggtgtgatcacagctatcacccagcgaccggcctttcgctattggcaactc

SEQ ID NO: 252199 - DNA, 404 bp, Homo sapiens
gatacggtctcactctgtagcccaggctggagtacaggggcatgatcttggctcactgctacctccgcctcctgggtgcaagcaatcctcccacctcagcctctcaagtagctgggattacaggcgcacaccaccacacctggttatttttaaatttttggtagagatgggattttgctatgttgcctgagctggtctcacactcctgagctccagtgatccgcccacctcagcctctcaaagtcctggaattacaggcatgagccaccatgcccagcctcattactatttaacctgggcacaaagtaattattttacaatggaaaaacctgaccggcacctttttaacccagtgataaaagggcacctggcaaggaccaggtgtcccactacggtgctcctcc

SEQ ID NO: 252200 - DNA, 367 bp, Homo sapiens
aaaaaaggaaaagaaagaaaaagaaaagcaagaaagcaactgtgtaatcggtgtcctgagatatcaaagccacattctggtccccagcggccctcacctttctctccagccctgtcacctggtgaattccgaggatgtgtcttgtctgaattctgaagagtccccattagcagtcacaaaaagcctttgtgtgttttagaccactgtaggcatgtggacagcatgtgtgtctgtctctgtgtgtgtttgtgtgtgtgtgtgtgtgtctacacacattaggatttacagctgcctgttgtaataggttcagtctgaaagaataaacaagcctccttattttgccattaaaatacatttcttcccatgg

SEQ ID NO: 252201 - DNA, 345 bp, Homo sapiens
gttttctggctgagttaataaatgaatggaatggttcagaatttccagccacagtgtgacaagtaattggtgaaatctgcaaaatacctagtgcctatttaaaaagatgttatgttttcagatcattaaaatacagcattttatttgccaatgatttattttatttgtaaagtatcttactcataatgaaatgaaatagccatgactttagctcaataaaatattttactgcttctaaaacctatgactgtgtgtgtgtatgaagtaaaagagttgaaattaccctgaaactgtctccatctgtaattattattatttttagataaaaagattttttaaaatctg

SEQ ID NO: 252202 - DNA, 371 bp, Homo sapiens
tggtttaactgcaagggcctgatgaccttccagaaacaaagaagttctgctccaaggtgactttctgtgtctgctgctagaaactgctagcaactgcagttctcctgcttaaagaaaaaaaatccagtttcagttcaccaagcgtctgtacagagcagagatggtggtagcctagcgcagagcaaaacccgagtcacaggaatggtggcaagcctagaggagcaggagcagcgtcccagggacctctccagcctgccccgtgaggcctggccactcagccgagctggggggtcaccacccaaaagaggcctgcacaagcagtcggggaagcacccaagaagaacctgaggtcggccagtccaccccattca

SEQ ID NO: 252203 - DNA, 412 bp, Homo sapiens
gtaaattggtttcattcttcaccttgttgtcctcatagctgattttattagggatccctaaagacagcaagaaagcagcctatataagggaaaattacttcataatttaatctaaaatgtttccatctactttacaaataagttacagtgcaatagagatcataaactggcaggaagtgatttttatatgatcaaatagccactcaagaagaatggcgccacttgcatttcttgattttgaaaaataaaataataataggacgtcatggttacactgcagtgataacaatagtatgttttgttttggagacagtcttgctctgtcacccaggctggagtgcagtgagctgagactgtgccattgccctccagcctgggcaacagaacaagactctgtctcaaaaaaaaaaaa

SEQ ID NO: 252204 - DNA, 364 bp, Homo sapiens
gagttttggaagtcaatgtccaggcataaaacgaaaatacatggaaaaataggaaatcaggcagaaccagtgtcccgcagcatatctcctttccttttgctacccacccaccatcctgtacacacataccttcaaaaaatcaataaaagcttcacaactggagaaaagcaaggaaggaaaggcacagggaatatgttgatggcagcaactggtaggacacagtgactgaccagagtcagaattcagaaacccaccacctccactcaagtgaaaatcatccatccatagtatctgagaaccctgtggacagctgttcagctcttgggatttgtgcaggaggagcattatagaccttcagtagagg

SEQ ID NO: 252205 - DNA, 370 bp, Homo sapiens
tcttttttaaaaccttggtggaaactgtgctggcaaggcaaacagggaggagaggaagctccatgtggggcttgggcttggcggacgacttggggctggccggactttgggtggccgccgaggaccattgctaaatatgcccctttcgtcctgaaatagtcacttccccggctggcttttgtgttggtcggtcgccacaaatgtgtggctgttgttcaaggaggcctcctgggatataaaaagagagaatggggccaggctgcggccagggctgtgtaggaagacaggagagctgccttttctcctgtcccaccacggactcattgtaagattcagagggagtgccgtggtacacgccaggccgtcccag

SEQ ID NO: 252206 - DNA, 358 bp, Homo sapiens
gttttataatcgtttgtatgacattccttcctttttctgtcttctatttgttagttttggtgttttacctaacttgcttttctagtctttccacatttataggcttcatacagcattgtttatatgtgatataaataagctgatctgaaattgttataaaatcaactgccgtttctgaatatcaccaacatgtacttgaatccttctggttttcaggatcctggcacctctccaaggcctctgtcctcccttgttctttgttctcaactctgcccccgtcacttctggaccaggcatgctggtttgcttgcaacccctgagctaccctttaccaacagctctctccatgactttttca

SEQ ID NO: 252207 - DNA, 796 bp, Homo sapiens
cacacctctgtattccttcaggattatatttaacactgaatgaaggccttactagtgtggcaaatataggctatttatccagaagtctggcttcaaaactcacaggagagctgtcactacggaaatgccttttgaatgtaatgtttgcaaaaaagcactgtgccttctgtcattgaatcctagaacactgagatgagaaaaacactgtagatgtataggttagatatatagggaatgttattattttttcctttttttggagagacggtctcactccatcacccatgctggtgtgcagtgctgcgatcgtagctcactgcatcctccgccccctaggctcaagtgatcttcccaccttagcctccatgtagctgggtccacaggcatgcaccaccatgcctggctattttctcatattagtagatatagggttttaccatgtttccaggctggtatcgaactcctgagctcaagcaatctgtacacctcagcctcccaaagtgctgagattgtaggtttgagtcactgtgctcagccaattatgtttttctgtgtaacatgggaggagatcctttgagggcaccatgtgcccaaattgaaaaaactccaggcatgtggcatctgtattatattttttactatgccctgttatcttgctagacttatgtgactgccacttatctggcaaaagccattacatctcagctacttggtaggtacccacattgcatcattcacctatttcgtattctagaagtatattttggttgtctcccattcacgagagatttttttt

SEQ ID NO: 252208 - DNA, 361 bp, Homo sapiens
atagcatgcattggtcattgggagaatactggttcatcaagtcacatagatatttcaaacgttgacatattttattatgtaatatttttaaaagatcacattgatcactgattccatcagaaaagctgttaagaattgggaagctgtcaagcttgccagtggatacagattttctaaaattcaaattttcatttgaaagtttgaactttatcattggcaacaaatattgtcagttattttccttgaaatgacaagctcactttattcctgtttggaaaaagaaaaatgaccaaatagccaagtccagataattatagtttgtcatttttttaaataaaaatggtattccatgaaaaaaatg

SEQ ID NO: 252209 - DNA, 558 bp, Homo sapiens
tgtcttatactattttaattgaactaacagggcagaaaaattagataaaattagcaaaatagctgtttattaaaatgcctcattataaatgttgccttaaaaacctggatatattgctgagtgatagaagtggtgacaaaaataagacctcttaaaatatgttgttttgtgtaccttttatgtttactttttattttaacagaaaaatctatatagatgtttcatttaatgataaattggtaaagtcctgttccaataaagtaaatattgattatgacttttatataatcttggacgtaaagtaaccatggactgaaaaagtgatttttcacttgatgcctcaaaaatttgattttattatgccaatagtgatattgagtttgtgactagaaaacccagcagagggcgccacaatcataattctttgtcatagcccaatataattaggataaatagctcaaataataaccctaagcttttaccatgtagacatataaagatgtgtctaaacatttctatttgattcatttataatatatttaatatattcagtaattc

SEQ ID NO: 252210 - DNA, 924 bp, Homo sapiens
ttgaaccatcacaagtattttgggaccgataacaaaccccttttatgctaatttaattcttgacttgggtaataggtgcacctggataatttataaagctgtccatagatctaagtttagtggtacagatactactgggcaggagaaaaagcacaagttaaaatatttctacagtcagctcttaatattcccacatcttgtttgcaaaattttatggtcacgttctggcttttttacatgaggaaaacaaagttttaacagttttctcttctgtccccttctccagaggaggtgtgaaccagaactgaggaggccagttatattttaggcttttcagtagtacgattttgtcctctcccactgaggaggagggaagaagggggaagccagtgggagttccacacacgtggtcagtgctgtaagttcccggatatcagtgtctctcacatcaacacagaaatagggcacttctcaacattaattttggaattattcaccatttaaaaattgtcactgctctttttcattactgtagataactgagagttagctgttctaggaaaaggccatgtttcagttagtgctatgacttcttttttcgattaaggttgaagcagtgttctcttagtagcctgaacacttctcaaagcgacttatcactagcggctttaatattgagcttctatatcgttgtgtccacctcactttttaaggctgttcatacctggcaatattcacttactctgctatttttaaaaactattttaaagttttaagcacaatgttgactcttctgtaatttcctaaaattatattgttttcctacagacagctcaactttccttgatatgtaacactctaggaaaataactgccttgtaaaataaacgtgattttttttttcttttataccagaacaaatctg

SEQ ID NO: 252211 - DNA, 851 bp, Homo sapiens
ttgaaccatcacaagtattttgggaccgataacaaaccccttttatgctaatttaattcttgacttgggtaataggtgcacctggataatttataaagctgtccatagatctaagtttagtggtacagatactactgggcaggagaaaaagcacaagttaaaatatttctacagtcagctcttaatattcccacatcttgtttgcaaaattttatggtcacgttctggcttttttacatgaggaaaacaaagttttaacagttttctcttctgtccccttctccagaggaggtgtgaaccagaactgaggaggccagttatattttaggcttttcagtagtacgattttgtcctctcccactgaggaggagggaagaagggggaagccagtgggagttccacacacgtggtcagtgctgtaagttcccggatatcagtgtctctcacatcaacacagaaatagggcacttctcaacattaattttggaattattcaccatttaaaaattgtcactgctctttttcattactgtagataactgagagttagctgttctaggaaaaggccatgtttcagttagtgctatgacttcttttttcgattaaggttgaagcagtgttctcttagtagcctgaacacttctcaaagcgacttatcactagcggctttaatattgagcttctatatcgttgtgtccacctcactttttaaggctgttcatacctggcaatattcacttactctgctatttttaaaaactattttaaagttttaagcacaatgttgactcttctgtaatttcctaaaattatattgttttcctacagacaaaaaataaatgaagaagtcg

SEQ ID NO: 252212 - DNA, 213 bp, Homo sapiens
aaaatgttcaaacttctcaatatgatatcaatatgaccccaattaatgtttccagtcttttcccctcttttttcctttttcgtatgtttcttctcacctctcgccggtctaatgattcggccacactgcttggtttttgctgccttctggatttttgcttgttaattctatgttcctgcagtacctttaattaaaacagacatttaatacatc

SEQ ID NO: 252213 - DNA, 260 bp, Homo sapiens
catagcctgcctctggggaaagaagccaagtctttcttcatagtcattatgctctatgcatgtgactctgccattcctatgactactactgagccagggggtctgtgcctgggccaaagggcagccatgtccatgagaaaggcccatgcagaggctctacaagagactgcccaatagcagggcaccatattagatggtatcaaatggatccagtttcctcctctctctcagtgagaataaatgtgagatacacagagcag

SEQ ID NO: 252214 - DNA, 235 bp, Homo sapiens
gcgacacagtaagatcttgtctcaaaaaaaaaaaaaagatgtttttaatgccccctcagagaacattttccccagtaaaccccctctaccccttagctggctcctgtcaatattccccctctacccctgaccagggtaccaggaatctactttctgtccctatagattagcctattctgaacattttatataaatggaatcatagactatgtggcccttcattgtctggcttctt

SEQ ID NO: 252215 - DNA, 453 bp, Homo sapiens
gcatggtgcctggcacaggatctctggtaagcaaatgaaggaatgaatgaaaactaactacgaacctgttccatttccctataaaccacccagggtcacacaagggccatccacggtgaccagcggtgagaaacgcaatgctgtcctcgtgccatgctggaggtgaacgaggagaacgtgagctggggtctcctcaccaactgctccccccaccccaacccccctgacggccagggctgtgtccagggctcagggcacaaggctccgttagctgggcagcagctggcccatgaaacagccctttcagctccacctctgaatggcagttctatgggctcctcggaagaacacaggcgccttctctgtgtcacttctccgctcattagcagagctgcagaaatacactacaggtaacttttcaggaacagagatgggtccccccccgaacaccac

SEQ ID NO: 252216 - DNA, 309 bp, Homo sapiens
ttatcaagggtgttacactgggcttccattacaagatgaggtctgtgcatactcctttccccatcaacttagttatccaggagcatgggtctcttgataaaatccaaaatttcttgggtgaaaaatacatctggatggtttagataaggccgggtgttgcttattaagttatcttaagtccagaaaaatgtattaatccttgaaggaaatgacattgagtttgtttcaaattcaactgctttgatttagcaatccacaacagttaaaaacaaagataacagaaaactttcagatgatctgtatgtcact

SEQ ID NO: 252217 - DNA, 431 bp, Homo sapiens
aaggactgcaccctgaaatagcttcagagaagagggaactttgaaataggattcaaattctaagagagcaaaaggatagagaaaagcagaagggcagaccataaggtgttccagtagtttagctgattgaaaactagcttgtccacagcaagaatggaaggggatggctttgaaaaatattaaagaagatataataattagatgtaaatgatgaacgacatagaggaatatttagagtaatccttagattgatgagcagaactttgaaggatagttacaattagaaagttgaggactaccgggcatggtggctcacgcctgtaatcccagcactttgggaggcggaggcgggcgtatcacctgaggtcgggagttcaagaccagcctgaccaatttggtgaaaccccgcctctactaaaaatacaaaaatt

SEQ ID NO: 252218 - DNA, 373 bp, Homo sapiens
acattattgttaaatatttctttcatgtaatcatttagttgctctcttttatttgcatgatttatttcaagtggtttgtagccttctttattttcccattttctcttaccccttttttccttcagcaaaccaaagatagaaattatattttgtatttcctgtttctattgcatgtaatagacaactttctccacatcaaacatcaccatgtttttttataaagtcacagaataaaatttcttggtatagatgaaattgttccttaagcaaggaataccaatttccgcaacgttggattcagtccccttatgtcttctaaaagctatagtttatacactattttcaagcaataaaattgtctattgaaaccaat

SEQ ID NO: 252219 - DNA, 468 bp, Homo sapiens
tattctacaacacagtaatgtgacattttagatgatcaagaacagaaatatcctctttcccctggaatatggatgactgggccagggttcctcaagttgttatgaaccacaggcctggtcagagacctctgaagcatgtgtcaagcaccctctccctcagggctttgtgtgtgtcttccctctgccaggaacatcctttccctaaaaagtcacatggttcattcaggtctctgctcagatgtggccttctccaggacacctttcttgcccatcctgtccaaagttgctttactctctttacacatgattatttttcctacctaacaccatgtgtcctatggttgtcattttgtaatctgtttcccaacagattgatatgagcttcccaaggacaggagctctgtctcactcactctgcatctccagtgcttgtatacggttggtacttaataaatatgtgaattgcat

SEQ ID NO: 252220 - DNA, 463 bp, Homo sapiens
gtagctgaggaggcttgacatgcccactgcttgcggggtgtctgaatgctgccttggagaaggacagacagtcatgacacgtggggcctgaacaggggcgcttgctgcacggagtagctctagccttgctgacggagaggtacccaggagagcaggtgccggaaccttccatctttagcaccaaaggcagaaaggagccggcgttatggtcagctcatcacgcccttcacggttcctacgttccttttgtgtgctgagaggctgctgccgtgagtgtgcagtctgtggaaatgtggaaggggcaggaaagagaggggactctagaagttccttccattgctcctgtgaaaacacgtgcaacatggaagtcagcaccatcctgtaaaaatagaatgtgtgccacacaggtcattttgaaatttccttggagtcacattaaaaaagtacgataaaggatgtcttg

SEQ ID NO: 252221 - DNA, 505 bp, Homo sapiens
attcaacccatctgggcctccaaattgcattcccatctaagcttccatctttgcagacaaggtacagtcacaattccagttgtgagatgtcccttctcttttcttctctattagccacaccctccttcatttaaacttgggataatcatgaccttcagaaaaaatgattttcactcaaagcaatattccaagcatataggaagaaactcagaaaacccttagtgaccagaaattaaaactgcttttctttcatttgcaaaacacacaaaaacagataatctcctgaaaaacacagacaagcaacatggacccagaggcccttaggctaaggaaattcatttggcatggaacttacagagttcattgttaagatagataacaaaagccatttataacaagagtgttctcattatcatcatctcttgtagcccagttgaagacaagtagtgtcttctaagatcccatctttcatactttgcacacttttcctccacccatggaattt

SEQ ID NO: 252222 - DNA, 567 bp, Homo sapiens
agatatcagttggtcagccttctgttaggatgagttacagacagagtgtgaagaaaggagggttggaaaacaggttggtgaccgacaggaagtcatcgtgaaggtcctggtcgcctgtcctctccgttcttctctgtgccttgctggggatcagctccagacaatctgacacattgtcttttggctttaatatgtttgtaagattccagactcttagtaatgagccttggtatagggttctatcagttaggatggttttggctgctagaaacaaaacacccaaccaaacataccttaaacaatatggggtttagtatctcacatggtggttccaaggttagttcattaatgcagtgatggcatcagaatcatgagttctttccacttttctactccactgtcctcaggttctttgcttgatccttgggctccttccttccttcccttccttcccttcctttctttcgttctttctttgcttgaaccctggtggcagaagttgtggtgagccaagattgtgccattgcactccagcctgggcaacaagagtgaaagtctaaatccaaa

SEQ ID NO: 252223 - DNA, 438 bp, Homo sapiens
ataataccagtgtggaatacatactgtttctttgcatttatagtattccaaacacactatctttccatctatgtattcaacaaaacatatttgttgagtaccaagtacgtgccaggcacagtgcaaggtgtgagagaaatacataggtttgcattgtgctgtggcaaaatatagaaaatctgaatttaataaacacagtaatctattatgaagtcatttttagacttgtttatattttgtaatcacccaggtaaaaactcaagtatagttgatagacagatatgtttccccatggtcttttgccattgtgtataaaatatgcttaaacatttgtggaattagattgtcttgttttgaagaaaggctcatcaaagtttgaattttatgagtataatatgtattcaagtatcagtgttcaaaggcattagcctagccaat

SEQ ID NO: 252224 - DNA, 353 bp, Homo sapiens
gtttgtacaaatgatgacagcaaagtgaacaacttgtacagaatgtgttaaatttcttgtacaaaattgtttatttgccttttctttgtttgtaacttatctgtaaaaggtttctccctactgtctaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggcgttggtcaaatgagggaacatctgggttatgccttttttaaagtagttttctttaggaa

SEQ ID NO: 252225 - DNA, 731 bp, Homo sapiens
aggacggtaggaaaaccccaggcactttcggaggggttctgccggcagtcacggcgtcgggaggaagacatccccaccagcccttccctttctccccgcttccgcacatccacgcttcagcgcgcctttggcttctgtttttccatttctgaggactgggcccgccatcctccaggctcccctcgccgtcgctgcagctcgtagccgtttacatcgggctttcgcagcaccccttaggtgggagcgttgttataatccggttccggggaagcccaaagggatcaacgacttcctcaacgaaacacagctagtaagaaatggggccgggatgccctcaaagccatttttcagttcagctgtgccccatcaggtgtccagttcagagaaagactcctggagttccttctcattgttagaagagtgaagttgtcaagaagagcaaatgtaccttccacagagctgggaaattattttgtcaaaaactcttgtacccaagtttgaacaacgctatcagatgactcagtctagctcacctgactccagctctgtttcaaattttgagctctaagctttggtggcaataactctggcagtgaaaaaaccctcaggcttgtagatagctttgcttctttgtcttcttttgcttcatcgttatcatccttcatcattctggaaagattgacagtttagtgttcaagggcacagactctgcagtcaaggctgaggtctta

SEQ ID NO: 252226 - DNA, 431 bp, Homo sapiens
tggttctttggaacaaatcattaactgataaaccagtggccagaatgacaagaaagcacagatccccagtatttggtatggaagaggatattctgtagaccccacaggcatcaaaagagtacaatgaacaacctcatgcccatacatttgaaaatttggataaaatggaccaattcctttaacccaagaagaaatagcttgagtatctcttaagtagataacccgtatctatgaaggaagttgtagatgcataatctaaagtctgaaaaggctctttttccagagaagccagaaattgtgtctgtgtgtgggtgtgtgtgtgtttacagagttaccaactgattagaaacaaagtgttgaaactcaagtgtgagctgatgctgcatgccaagtaaagccacgggctttgtgtgggaagtagcctgtccctg

SEQ ID NO: 252227 - DNA, 451 bp, Homo sapiens
atacataggaaagctgtaacttaaaataactgtaaatattgaaattgcagtttttatttatgctgcatagttatttggtcttgctggttgattaactactcacaaaagatgtattcatttatttatatatttagttacatatttagttagatgctttctagattatgtagcccatgactacttaggatattgatatacccacagccaaaaataaaacacaaaaatattataaatgatctgataattcagagatacactgtcttgtttctttgctatttgtacttccagcctatttttattaaaaatatgcatatatatttacatattataaaaataacatcaaaatttacatcgtgttttgtaacttgtattttttgtaatgcagaagtatatcatggtcactttatgccattaaataatcttttatcaaaataaatgatttataatttga

SEQ ID NO: 252228 - DNA, 281 bp, Homo sapiens
aggatcatagctttttttttttttttagacagagtctcactctgcaacctctgcctcctgggttcgagcaaaccgggatcatagctcttgcactgccatgcgtagataattgcagcacacttgtctgtgatgtatgtacaagtcattattttttggatggtggggtgcatttttcttattttctctatctttcctctttctttctttttctttctttcttctgtcttttctttctctctttttctttcactctcttttccttctcccttccttcttttctt

SEQ ID NO: 252229 - DNA, 449 bp, Homo sapiens
cctttttgttttgaaagctttgagttgtgagacttgaactgactcatttcactagaatttgttactgaacatggttgtttttgtttctgttaggcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttgtaagtatattcatattttgggcaactgcattgtgatattgaaagtataattttatacttcactgcag

SEQ ID NO: 252230 - DNA, 5533 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgattcaatctttatctaaaaagcaaatgattaaaaaatctgcatgat

SEQ ID NO: 252231 - DNA, 5244 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagc

SEQ ID NO: 252232 - DNA, 5389 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgattcaatctttatctaaaaagcaaatgattaaaaaatctgcatgat

SEQ ID NO: 252233 - DNA, 5479 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgattcaatctttatctaaaaagcaaatgattaaaaaatctgcatgat

SEQ ID NO: 252234 - DNA, 5483 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgattcaatctttatctaaaaagcaaatgattaaaaaatctgcatgat

SEQ ID NO: 252235 - DNA, 5312 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccccaaatcaggtatgaaatttcatctatcattaaaatagatacgcttttaagtgtactggtattggatgaatccactgtccaggttgatatcagtttagagattaaaaaaaaaaaacccaccaaaaaaatccaaaaacaaaaattgggggcgcaaaaaatggggggagaaaaatgagcgctgtgtcacacggggggacagcgtttacaccgg

SEQ ID NO: 252236 - DNA, 5171 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaaaacagaaccgatggcctttcccaacagtagtacaaccctgaagggaaaatgaaaattgaaagcgta

SEQ ID NO: 252237 - DNA, 3062 bp, Homo sapiens
  misc_feature (21)..(21): n is a, c, g, or t
actctattgatcccctgcctngatgtcgtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgattcaatctttatctaaaaagcaaatgattaaaaaatctgcatgat

SEQ ID NO: 252238 - DNA, 5146 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaaaaaaaaaaaaaaaaaaaaaaacttttggggggcgccgggcccgggaaaagttttaaaccattgggtggggccgggcccctggttatggaacacgggccacagggtaccaggaacccggccgcaacgggtgtgggttccccaaaaaaggccggggccgcgcgttcggaacacccaagggtcggggccgcgtccaccggggccagacgcaag

SEQ ID NO: 252239 - DNA, 2031 bp, Homo sapiens
  misc_feature (3)..(3): n is a, c, g, or t
  misc_feature (15)..(15): n is a, c, g, or t
  misc_feature (24)..(25): n is a, c, g, or t
aanatggtatcaacncagagtggnnattacggccggaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgattcaatctttatctaaaaagcaaatgattaaaaaatctgcatgat

SEQ ID NO: 252240 - DNA, 4316 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcactcatatttggctcagaataaatctcttaaaatata

SEQ ID NO: 252241 - DNA, 1726 bp, Homo sapiens
gttttcacttgccatccttgacataagagaactataaatttgtttaagcaaattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacaattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgattcaatctttatctaaaaagcaaatgattaaaaaatctgcatgat

SEQ ID NO: 252242 - DNA, 3719 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaattactggggggtcctctagagctcc

SEQ ID NO: 252243 - DNA, 3536 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgagttataataacttgggggaatttcctcaggctattaaagcccgtcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcggtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcgctagtgacacattttctatttacccttctacccacattgtccccacatttg

SEQ ID NO: 252244 - DNA, 1153 bp, Homo sapiens
  misc_feature (3)..(3): n is a, c, g, or t
  misc_feature (15)..(15): n is a, c, g, or t
  misc_feature (24)..(25): n is a, c, g, or t
aanatggtatcaacncagagtggnnattacggccggataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaatttttcattttattcatttaaaaactagaataacagatatataaaagtgttaatctttgtgctatatggtatgaaatacaatattgtactcagtgttttgaattattaaagtttctagaaagcaatctattttgccttaatttaaaactaggtatattaatgaatttagttttaaagtaagcaaattaaatatttgtaagtggacagtattagaagaaatgttggaagtaaccattagaaaacactattttgatatttatttgtaaacatataagaacattttgctgaaacttagaaataaggttttatcctaagtctgaactatactcatggaaaacagattatgaaatttcagaaaaaccattgattcaatctttatctaaaaagcaaatgattaaaaaatctgcatgat

SEQ ID NO: 252245 - DNA, 1241 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttgtaagtatattcatattttgggcaactgcattgtgatattgaaagtataattttatacttcactgcag

SEQ ID NO: 252246 - DNA, 1288 bp, Homo sapiens
tcgtgccgaattcggcacgaggggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctgtaagtaatgcaattttagagtttcacagctggctgtgtattttctttctgcgtagtcaacatgcttggaactaggttaagcacagtttcttttagttcaggattaaaagatttaaggagtggccagtgagtagtatgggaggccagagtttgatttaggcaaccctgcatctagattaacaaaagttaaaactctaaataatacgtattctgacctccagtatattacggttgaatgttaggctttttgggtgcctaatgcattggagcaaacccttacttcagttttactggtagggttttgtttctacttattttatagctataagaactttgaattacctgactctaaaagggaaaaaggcttacaagtgctccaaatgttaaaataattttagagctcaagggaattcagatgcctacaatttgtatagccagcgaatggtgaggaaataaattcttggcagtggtcagg

SEQ ID NO: 252247 - DNA, 347 bp, Homo sapiens
tttttggatattttcacagacatttgtatgataatcctctgtcttttgtggggaactcagcatttcacaatttatctgatcttcattccctgtaagtatgtgaatttaaaaacaaacctggatatttatacagttgttttagtggaaaacaagaatttattactggaactccagaaaacaaaatctttaaaatttttttctcccttgggcagaatttataattgttcttatttttgtgaatactttgccacattatcatactttcaagtacattcaagagatgaaactagttttatttttagttatagttgcactgtaattttaaactgtttaaaacataaaatatg

SEQ ID NO: 252248 - DNA, 310 bp, Homo sapiens
tgtgaacatagagttaatattagagtgcttgtgaacatatgaaaattttactttttttggatattttcacagacatttgtatgataatcctctgtcttttgtggggaactcagcatttcacaatttatctgatcttcattccctgtaagtatgtgaatttaaaaacaaacctggatatttatacagttgttttagtggaaaacaagaatttattactggaactccagaaaacaaaatctttaaaatttttttctcccttgggcagaatttataattgttcttatttttgtgaatactttgccacattatc

SEQ ID NO: 252249 - DNA, 685 bp, Homo sapiens
catccctgccacatcgaagccactgccactctggcctccaccactgatctctggcctcctcactgacctctcctcttgcctccttccagtctgttctccccagtgagcatacagagagccttcacaggagtaatctaagtcactggcactcttcagcttaaccttgccaggggctttccacacaataaaagttaaatacttatttataccgcacttattatgtgccgaaggatgttagtgctttacagattgtcagtcttcacaacactcctgtgaggccagctgtggcatgatctacatcctacagctattatacatccacctatcagagagggcatatgactatcctgaggtcttacagctcccatgtggaagagtcaggataagacctccacagattagctctggagtgcactctatgccgtcctgccttgtgcctcacccacaaaagaattcacatttgcgtggcctaaaggactgcagcatcctgccctagtacctacctgaccccatttcctaccactcagcctcctctgtacacattggcatctttgctgctcctttgacatgctaagagcatagcaaaaccctctgcagcagcaccctcctgcagcagcacttccctgcagcagcaccctcctgccaacacccccctgcagcagcaccttagtacctgctcttctct

SEQ ID NO: 252250 - DNA, 584 bp, Homo sapiens
atcaatatgtactctgtgtgtgtgtgtgagagagagagagagagagaagaaaaaatagcttcttttaatggaaggaatgaacaatttagaaaattgctactttgtaatctctctaatgtgaaaattacttcaggcacaggccatcaaagataaaaggctgttagagaacagaatatgtcctttaaccggaatctaattatgacaaaacaagtatacaaattttgactactcatcatttcagaaagtaaagaataaagaagatcatgttatttacaatgcattaagaatcagactgataacaggttgaatacaagaatacaatattttaatatctttaaaatcgaatagaaaacatttggacctagaattctatttctaggaacgttctcaaacaagcttaagagcaaagtataaaaacgatgttcagcatataataatatgaaaaaattttgtcctagacattttatatgaaaatgtatactttagagcatgcttcaggaaaaaaagaaagaaaaattaatcctgggaaatgggtgacattagatacaaggagcagtggcagttgagtatgtcccaaaggaagt

SEQ ID NO: 252251 - DNA, 382 bp, Homo sapiens
gtttcaccaaaagagttctaagcctggaaaaagacttcaaaaaaaatcttagaatacaaaatcagcacaaatgcatagcatttctgtacaccaataatattcaaactgagaacaaaataaaaaacacagctctatttacaatagcaacaaacacacaaaaaaatacctagaaatacattaaatcaagggggtaaaatatctctacaaagaacaacaaaacattgctgaaagaaacgagagacaatgcaaataaatggaaaaatattgctcatggattcaaataatataattaaaatggtcattctgcctaaagcaacctacagattaagtgctatttttatcagactatccatgacgatttttattgaattagaaaaagaaa

SEQ ID NO: 252252 - DNA, 665 bp, Homo sapiens
agaggactgaaaacttagaagaaaggagctctgatgacagacccccttttcccacagctgccaccacaggattcccacccactcacaaacacacacactagacattgacatgtccaccctcctcccaggagtaggcaccaccctcaggaccttcaccacggcgtttttgatcctagtgtttcttgccaagaacccacaagtctctacaagtctcctggcgtatccccacccccagacactaaatctgcagcagcaatctgttttctccaccaacctagcattttgaatcagctgttcataatctcatatgtctgcgtgcacacagtaataaatcagagtacagctgcaccaggacaactatctgtagcaaaaatcagtcctctcacctacattgcaatctctcccacccagggatttaattttttcttttagcttttatttttgttttggggtacacatgagtttgttttggtgcatgggggttttgcgtgcagattattttgtcactgaggtattaagcatagcaccaaacaggtatgttttctgattctcttagtcttccaccctccaccctcaactaggccgcagcgtctgttgttctcctctttgtgtttgtgtgttcttattatttagctgttacttataaataaaaacatgcatttggt

SEQ ID NO: 252253 - DNA, 210 bp, Homo sapiens
gtaactctgcttatcctctgctttctctgttttcccgtatggaggggtagacatggaaagaaaggcagatcatgattaaaggttacagaaggagaagtagcaaggctttaatcctagagcccatcctcccagagaataaatggtaaaaatgtttgcctttgtgccttgggaagcgctaggctcctgctgctctttcattgaaaaaaaaaa

SEQ ID NO: 252254 - DNA, 283 bp, Homo sapiens
agagctcaggctggaggagcctcatacccgcccctctagatgcttataaaaatacttcccacctttgaatcaagtggaaaatgaggctctccagtcaaaagccgcgactgtatagaaagccctgagttgcccaatctgttcacatggcatcaccaacctctgtgtcatcatcaagctgtccaggggactcgatggccacctggccaggaactgcgggctgattggaagctgttgttcccattgtataatcacacacatcataaaataatcagtcttgtctcta

SEQ ID NO: 252255 - DNA, 383 bp, Homo sapiens
agtcttcgaattacatctcatcacttttgccgtaatctgtttgttagcagtcagtcactaggtccagcctgtgctcaggtggaggggattatacaaggtcaggaataccaggaggcaggattgctgcaggctattttagagactgcctagtgtgggtctgttagcaacacatttccttagttttcatttgtttcaacagccttttatttaaccttcagttttgaaagatatttccctaggtaagaattccaacttagcagttattttcttttgatactctgaagatgacattccattatcttctggctttcagatttgtggaaaaaaatctatctttctgttgtttctttaaataaaatgtgcttttttcctctgaattcttt

SEQ ID NO: 252256 - DNA, 509 bp, Homo sapiens
gggcctacctagataatccagtgtgattttctcatctcacatttcttaacctaatcacctcagcagagaccctttttccacttgaagtgacaatcatggattccagggattgtgacttggtatctttgtgagctatgagtcagcctcctataccatctgaacctctctgtcctgtgaaatggcagaaaacatcctcataccacagggctttataagaggtcaataaaagcgtcaaatagaagggccttcagcacagtagctgtctacttcgcccagctgacatgtcatcagggccacatggggtttgtgtgttcctgggtcagtccgtgttgagcccctttctgtgctgaggcccaacctgggtgctgggctccctgtggggaaccagacctctgtcgaggcagagcctccctgcaatcctgtagatcaggccgttgtccaaggacaggctttcagtcttcaccggatgacagtgctctgagtgtagcatttctactgcatgaaaaatt

SEQ ID NO: 252257 - DNA, 181 bp, Homo sapiens
agcagaggatgataccatattgcatgacaaaatgccttcgttttttctttttttccaaatatagtttactttacaaccaggtggtgttcttagtgatggggatgttgctcagacattgatgtaacttcagcaaacactgcagcagggaacattcttctcccctgacaggttttatagctaa

SEQ ID NO: 252258 - DNA, 303 bp, Homo sapiens
tctgcaaggcctgaatgtttatattctcctgaagtccataggctgaaatcctaaccttcaaagtggtggtattagaaggtgaggtctttgagttgtgagggtggaggcctcatgaatgagattagtgccagtataaaagtggtcccagggagctccctcaccctttccaccatgtgaggacacagtgggaaggtgctgtatatgaaccaggaagttggtcctcaccagacgccaagtcagctgggaccttgatcttagactttcagcctctagaactgtgagcaataaacatctgttgcttat

SEQ ID NO: 252259 - DNA, 385 bp, Homo sapiens
ctcaagctgggtcagagagcagggctgactctgccagtgcctgcatcagcctcatcgctctcctaggctcctggcctgctggactctgggctgcaggtccttcttgaaaggctgtgagtagtgagacaaggagcaggagtgaggggtggcaggagagaagatagagattgagagagagagagagagagagacagagagagaggaagagacagagacaaaaggagagagaacggcttagacaaggagagaaagatggaaagataaagagactgggcgcagtggctcacgcctgtaatcccaacacttggggaggccaaggtgggaggatggcttgaaggaaagagtctgagatcaacctggccaacatagtgagaccccgtctcta

SEQ ID NO: 252260 - DNA, 433 bp, Homo sapiens
tatacttatgtaacaaacctacacattctgcacatgtatctcagaacttaaagtgaaaaaaaaaactttggttgggctcattttttctgaggtagaataattaagactcatgatgagtgtgactttttcaagatatttaagaatttagaataaacaaatatgtgaatgaattcattatacctttatacacaaagcatgtaactatttgtgtaaacatactccacttggtggtgtaaggaaagcctctgagtgattttacacaccagttaatagatgggtagtgttggatgagagcccaaaaaaggctctttattgtcattctttaggattacagcacagtttacgtatgtctcatttggccctttgcaatacaaataaggcctatatgtatgttctccctatgttttgctaatgaagaaatgaagactaaaaa

SEQ ID NO: 252261 - DNA, 315 bp, Homo sapiens
agtgctggggttacaggtgtgagccaccatgcctggccaaaaactaagtgccagtctatatattagtattaattagttttacaaaattatgaggccaattcttaaacattgaaggacaaagcaccaaactcctgatagaaaaatggaggaaaatgagcaatttacaaaaaacatacaaagtgtccctaaaatgcatttttaattcaaatgtgagtgatggatacattaatttgcttcactctagtaaccttctatttatgtgtatcccataacaggtatacttttaaacacaataaaatttatttttaaaaattc

SEQ ID NO: 252262 - DNA, 488 bp, Homo sapiens
gctagaataacatcattttatttgatgtcattttgttatcacattgatgaaaaaaaattcagttcccaacctgagccactgtctgtgtggagtttgcatgttctgcatgggttttcatcaggtactctggtttcctcccacatcgcaaaaatgagcacttccagtaaattggggtgtctagatggtgccacagtgagtgagggtgtgggtgtgagcatgccctacagccagataccatcctctccagggttgatgcccacttagtgctctgagccactgggataggctctggccacccacaactctgaactggaatcattgggtgagtaattattatttgtttttagtaatttttttttttttgagacaaagtctcactctgtcacccaggaggtggaggctgcagtgagcagtgatagcaccactgcactccagcttgggtgacacagcgagaccctgtctctaaataaataaataggaaaacatca

SEQ ID NO: 252263 - DNA, 332 bp, Homo sapiens
gatctaccccctggagttttgggtgaagttgcctttctctgagtcatgtagacacttgaacaaatttgagttctgaaaggatggaaagagagggagaaattggtggggtaggcaactcaatgtatccacttcttgtctttcagaacagactccttactgtgcaccttaaaaagttgaaaattgctaacccttgctgagagtactattgtatacaaaatgccttaaataagagcccagacagaaaaaaaaaaacccaaaatgggtgatgatggagcaatggtaaaagcgagatgacatgggaaagtggtctttcattccttccaaaaaaaaaa

SEQ ID NO: 252264 - DNA, 388 bp, Homo sapiens
tttaattaatgagagtttgttttaggggtatgggcccaggtgcagctactgaatccagtgcaagagtggaaataagcttccaaaacagtatcacctgagagagaactgagtccatccctgtagtaccatctgagttacagcttcctgggcaaaggctcagaatcataaaaactttacatatgtgtcatgtgctgtgattcttctgtgtcactgtatgttgagctatatctgtgtggtgccacttacacttaatgagatgagattccttctacttgtttcacgtcactcgtgatctctgaagctacttcagatttctgctttaatatgtaaagagcatgtcaatcatcacccacattcttaccataataaaagtctggaaaattgatta

SEQ ID NO: 252265 - DNA, 943 bp, Homo sapiens
ctgtccaaatgaggatttgaaagtcattctagactagagagtgaagtattttacttctccagactcagaagaatgtaatggtttcacctaaaaaatcaaaacaaaagcattagcaaaaacacttacatgttgactggtgtgacatttttgtcacctcctaaactttttggagattcagcctttatagaagttaattcagttctcaagaaccctcagagacctatatgatttatacatgttctcaacaactggctgtaatgccatagtcatgtgatctgaacttctatagcaggacatttggccagagtccgttgaaactttctgtttaagttccacagatcaataacattagatttctaccttttcgcaactctcaaatgtattccatattcaaacaattgaaacttattactcataaagtagatgattcttttagagtaaaaattttaagaggaaatccatgtctaaggtatgacttacagacctaacacagactataggaactggaagagacccgggaagatgagaaaatagagacacaagaaggtaaagaggcttctggaggccacctagctgattagggatggagctgtgactgggtctgccttccgtagcagctgcctggacagccagcctgagctttcctcactcctttcttcctcttagcactttccctatgcatccctaacatttttctttcccagtttattccaaccgaaactgtatgcagagactccagtgacagtgggatccatatgggacttgctcttcacttgaggccaccttggtgtcaaaagcctttgcagtccctcttagctgcttgctgtgtgagccttagctcttgaaatcactccttattcaactttcttttcaatagacctacgagaattttctctttctgctcttctcaattttccagcctctccattccattatttttgac

SEQ ID NO: 252266 - DNA, 687 bp, Homo sapiens
ctgcctctttgcttcttatttttcaggaaacaagttagtaactgaggggaaaagcaccacgatctcccggtgcgttgtttgcaagagtgcttcagcagtcagtgtctttcttgttgtttgccagataaagatattttgtctgcatatctgcatagcttaacagtaactcaggtgctgacgtagaagtaaagcatgtgagaatgcttttggatcatacacttttcacataataacaaatttttctcgaattggtttaacagtatcgttttatgctttttaaaatgtatctttgatatgagttgtttgtcatttgcacaagttaatgattttacctccccagctgcaacatatttttcaaatttaggaacccaacttaaccatctgaacatccttcttaaaaaaaataaagaagaaagctcacaactatgcctgtgatctgaactagttgattttgttaacggaatgttatttatatagtgatggttagagaaggctctggtcatttctatttatattgtatgtgatgttttactagaaaaacaagttttaccttaacatgaaaaaaatacattgtagaacctaatggcaagttcacctccgaagagggctaggcggggactgtaccctgggttttatctcttcctctccctcctaggacaggttgggggttgggatgcttacttttga

SEQ ID NO: 252267 - DNA, 375 bp, Homo sapiens
caggcaaagagacttaagaagtttatagaccaatttgcatcgaagtttggtttgtcaagacctctcgtggcctttgtgttcctcagagcatcctctgtgctttggcttctgaggccaattgcctgttcgtttcctacctccttttgcgttcctgagagataattggattggcccaggtcctcttttttgttctaggctgtaggtcagaggtcagccggtggactacctggtttgatcatatgtcctcctttgacttactcagctggaggtaaagggccaaggggacctcatgaggaaggggtgatgtgtgcagctgctcaacaccctgaaaggcaatttggggaccaagagggagagttaataaactgacctaac

SEQ ID NO: 252268 - DNA, 264 bp, Homo sapiens
atgaaggtgctgagggcctggctcctgtgcctgctgatgctgggcctggccctgcggggagctgcaagtcgtacccatcggcactccatggagatccgcacccctgacatcaatcctgcctggtacgccagtcgcgggatcaggcctgtgggccgcttcggtcggaggagggcaaccctgggggacgtccccaagcctggcctgcgaccccggctgacctgcttccccctggaaggcggtgctatgtcgtcccaggatggctga

SEQ ID NO: 252269 - DNA, 216 bp, Homo sapiens
agagaaaactgcattcatccacatgtcccagcaagagctatcaccaaaggcattgtgaagcagttgagcagttacatctgctctcctttaacaggaatgagtctttagtacccggttgcaaatgttgacttttaccttttctttaaatgtctgctactctttgtcatatttcttctccttctctccaaattctaccaataaaagtaaaaattactg

SEQ ID NO: 252270 - DNA, 2835 bp, Homo sapiens
ggctggggggaggcggtggcggctgagggaaggaggaggataaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccagtgcagtcgcaacagagtggacttctttccttcaagaagtgtgaatactacctcttgaactggtcactctcaaagggctctggagtaactaatcagaagcgtcttttcttttacctatgatgttgccactgtggacatttttggagagagctatgttgctgcttatttcggaggttgcaaatagattcaagtggtctaatggatatacttggaaaatgccaaaggcataacactgaaagataagctgggagatactgaagatttaaaatcaaaatggataaactctgtggtgctgttggatcaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacaggtaaatagtgacatggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagttcgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttctt

SEQ ID NO: 252271 - DNA, 2939 bp, Homo sapiens
ggctggggggaggcggtggcggctgagggaaggaggaggataaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacaggtaaatagtgacatggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagttcgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttcttatgatggtctgagttggattttcttttccttttgttttttcaaatctgagcagagtgggcatctgaagggaccaccgctacagcaacagcagcatcaggggtggggtaagtctgtccccttagtctagagcctagtgggcatcaccatagttttgtataatgaaactagacttaacgtgattttttttttccgaagaacctcaagacttttatagtgctccaggggcgttaaacgaattcagtggtaccagagatagatagttctgtcagaaatgttggacaaagtgtagttaagagaaagcagagttaagttacctgagagactgttgagatttggatagcagtgcttattttatatacacccccttgacccaaagactatttcaatttatattttaacaacgaaa

SEQ ID NO: 252272 - DNA, 2836 bp, Homo sapiens
ggctggggggaggcggtggcggctgagggaaggaggaggataaggaggaggaacgaggccagcaggaggcaacggcagcgacggggccggggtgatggtgcaggtgttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggacgtgtcaggaaatgctgcatttctggccttcactccttttgggtttgttgttcttcaaggaaacaagagggtccacttcattaaatggaatgaggtgaccaagctgaaatttgaaggaaagactttctatttatacgtaagtcagaaagaggaaaagaaaattattcttacatattttgctccaactcctgaagcgtgtaagcacctctggaaatgtggaatcgagaaccaagccttctacaagctggagaagtcaagccaagtccgcacagtgtccagcagcaatttattctttaaagggagccggttccgatacaggtaaatagtgacatggccgagttgcaaaggaagtcatggaatcaagtgctaagatcaaacgggagccaccggaaatacacagagcagggatggttcccagccggagctgtccctccataacccatggcccaaggctgagcagcgtccccaggacccgcagaagagctgttcacatctccatcatggaaggcctagagtccttacgggacagtgcccattccacaccagtgcgttccacttcccatggggacaccttcctgcctcacgtgagaagcagccggacagatagcaatgagcgagtagctgtgattgcagacgaggcctacagccctgcagacagcgtgctgcccacccctgtggctgagcacagcctggagctgatgttgctttcccggcagatcaatggagccacctgcagcattgaggaggagaaggaatctgaagccagcaccccaactgctacagaggtggaggcccttgggggagagctgagggccctgtgtcaggggcacagcgggcccgaggaggaacaggtgaataagtttgttctaagtgtcctccgtttgctccttgtgaccatgggactcctctttgttttgctcctcctcctgatcatccttaccgagtctgaccttgacattgcctttttccgtgatatccgccagacccccgagttcgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttcttatgatggtctgagttggattttcttttccttttgttttttcaaatctgagcagagtgggcatctgaagggaccaccgctacagcaacagcagcatcaggggtggggtaagtctgtccccttagtctagagcctagtgggcatcaccatagttttgtataatgaaactagacttaacgtgattttttttttccgaagaacctcaagacttttatagtgctccaggggcgttaaacgaattcagtggtaccagagatagatagttctgtcagaaatgttggacaaagtgtagttaagagaaagcagagttaagttacctgagagactgttgagatttggatagcagtgcttattttatatacacccccttgacccaaagactatttcaatttatattttaacaacgaaa

SEQ ID NO: 252273 - DNA, 1102 bp, Homo sapiens
ggctggggggaggcggtggcggctgagggaaggaggaggataaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccagagagatgccaaaggccagtacctgtttgaccttctttgccaccatctgaacctacttgagaaagactattttggtatccgctttgtagacccagataagcagcggcattggctggaatttacaaagtctgtggtgaaacaattgagatcccagcctccattcaccatgtgcttccgtgtgaagttttatcctgcagaccctgctgctctgaaagaagaaataaccaggtatttagtcttcctgcagatcaaaagggatctctaccatggccgactcctctgtaaaacatcggatgctgccttgttagcagcttacatccttcaagcggagattggggattatgactcagggaaacaccctgaaggctacagctccaagttccagtttttccctaaacattcagagaagctggaaaggaaaattgctgagattcacaagacggaactgagtggtcaaacaccagcaacatcagagctgaacttcttaagaaaagcacagacattggaaacatatggagtggatcctcacccatgtaaggtaagaccccctggttggagactgcatgacctttcctcctctagaaggcatcaggagcaagagcccccatgcctgcgctcagaggcccccttcaacgtttacatggctggcactttcagtgagatatcagagaaaatgcctgctttgaaaactcctctggatcacatgctacataattttgtggtgccacatcaatgtcagaggaaccgaggcaaagtcaatctaaataacaaatccaaagctagggccccgcaatgggtaatttg

SEQ ID NO: 252274 - DNA, 312 bp, Homo sapiens
taaggaggaggaacgaggccagcaggaggcaacggcagcgacggggccggggtgatggtgcaggtgcctggggtcggtgcggagctgccgggctgagggacgcctggtccagggtccgcagcgccgccgcgtcgctcccgggcgggcgggcgggaagatgctgagcaggttgatgagcggcagcagcaggagcctggagcgcgagtacagctgcaccgtgcggctgctggacgacagcgagtacacctgcaccatccaggtcagcgccgcgccgccccgccccgcccgcgggacccccttgtcccccaagtc

SEQ ID NO: 252275 - DNA, 381 bp, Homo sapiens
cctttttaaatcatgaggcattttgggtaacattagaatatgtagctcagttatgttctactctaccttgtgagattactgcatttagagctagttgtagcctggtttatatgttgattggcaaaacaaaatgacctggaatttaaatttcattttggagaagcaacagccaaaatcattacgaagtggctgttctttagaagtaaatataactactacgagtcctggtgtagtcatttatatttatttcaaatttcaattgagacaaattctgagggcccttttcagccctctattgagtttacatttctatgcattaaccagggactctgctttcttgttctccaaggatcatttatctaaggccaaattcactaaaaa

SEQ ID NO: 252276 - DNA, 232 bp, Homo sapiens
  misc_feature (1)..(1): n is a, c, g, or t
  misc_feature (4)..(4): n is a, c, g, or t
  misc_feature (8)..(8): n is a, c, g, or t
  misc_feature (12)..(12): n is a, c, g, or t
  misc_feature (226)..(226): n is a, c, g, or t
  misc_feature (228)..(230): n is a, c, g, or t
  misc_feature (232)..(232): n is a, c, g, or t
ncangganaggnagaagaggcaggaagaagaaacactaagcaaataggggtaacaagtatcattaccggtatgtgtcagtgcttggtgctaagactgggagaaagagaaggaagtgcaggggagatggtgatgggtcacagccttggtgacaaaagggtaggaatgatatgtggtgcggacatagaagtacaaggcaaaagagtgacgccgagctgctcagttctncnnnan

SEQ ID NO: 252277 - DNA, 985 bp, Homo sapiens
  misc_feature (926)..(926): n is a, c, g, or t
  misc_feature (982)..(982): n is a, c, g, or t
gcaagactccatctcaaaaaataaaaaaaaaaaaaagccaaagaaaaaattaatgctactgatcctgacactgaccacactctcccgttccctacctcccttgtctgtgtcccccatgggctgagaaggccagaaagcaagagagccattgtcctatcccatacaagatgacttccctaggcacatagctgagtgaagggaagtggagatttgatctggagaagcaaaagatggtacacccagtaccagtgactgcatctgccacactggccatgcctgctggtcacaggcccctgaagtcagcttccttcttcttttacctttttccttcccaagcctgacagccacattaaaggcttctatgcactaagggatatgaactcctgcacaagtgaggccatccatgggcatgagcatgaattgaacccagcactgtgcattcattcagcaaatctgataaatgcctccttgagccagaatctaagccagaccatcaaatggaacccagtgaaacactgattctagggcagtgcccacaccactaccactgtggattatcccttcataatagtatgtgtttatttgagtgttaatagaaaagaaaaactagcacttcaaacatttgatttcacaaatgttaaatttaaataaatatattggaattaatagaagtgagtctagttttaaaagctgttaagaaaacagcagattccgtgggtggttcatgcctgtaatcccagcacttcgggaggccaagacagatggattgcttgaggccaagagttccagactagccgggacaatgtagtgagaccgccccccttcccggttacaaaacttcttaaaaataaccggcatgtaggaacaccgtggccaagtactgagagcttatgcagaagattctttgcgccatagctgaacttcanggacatgccactgactttacttgggcaaaataggacctggtttacatgaaaaaaanaaa

SEQ ID NO: 252278 - DNA, 418 bp, Homo sapiens
ccgcaccaccaccacccaaactagtttattcaaaagacactaagtgtctactctgtggtaagcacagtcttaggttccagatcacgctagaaagtaggagaaacactccctgtctttatggaatcaataggattagatacgcaggaagacaagtatttagagaggaaaactacagtacattgtgatcagtagttctttaatagggacaaatacaggatgcatgaaagcccggagatggaacccctaatgaaggaatagaaagtaagagaaaggagagagacacccaagctgaggcctgaaagattcattccttcattcagtaatttcttgaacatctacatgaaggacagtattctaggcactgtggaccgagcagtgaacaaaataaacaaatctttgccctcagaaaaaaaaaaaa

SEQ ID NO: 252279 - DNA, 476 bp, Homo sapiens
aggcctctggcccattctagtatggtctctcccatcaggaggggaaaggcaaatattgcatgggacctggcaataagattgaatgagacataagcaaagtctgatcgcatccttatccccaccccttaacagccactatatcccttgaggcaagtgaagggccccagaagtgagggatcttattgctaagtagatcagacagagttcttaaagattctaatatgttgcctgtattgtctcatctgtaaaatgggtgttaaaatagcactcatatcttgggttatgaagatgaaagaagataatctatgtaaaggactgagcacagggcctgggacagttagtgatagatacatgttagctactgttgctattttgtattccatgttcaatctatgatattgattaacctgtttattgattgctggattttcatttagtaaattaattttcaataaatgattttcacttaagcattt

SEQ ID NO: 252280 - DNA, 519 bp, Homo sapiens
cttgaatttacttcgatagaggtgaactggtgctgcgtttagtgactttagctgaagaaggctcatggagatagatgatgctttggaggtaggcataactcgatttaaaacccccgctccactgtttactggtcttatgatattgaacaagtcactttgagctctctggcctcagtttcctccagcagcagaatggaatttgttatgaggattagagataatgtatgtaaactcctagcagttcctggcatatgatcatattagagactcaatacatgttaggatatggagcatgttggagtaaaactacagatcattttgtcttatgacaagatttagaagtctggcactgcgatctgcattttttcatttgtgcagatttgggatgaaaaaattgcaaatatttgacttggagcatacctaagtcttgcaggtgcaatgtgcttattggaactttgatttgttgctctatggctggcggaacttggtggggacagtaaaatctagctccaaattcaa

SEQ ID NO: 252281 - DNA, 660 bp, Homo sapiens
gaagattaaataataatccatgtaaagcaataatcatcatgaatatacatagtaaatagtaacttagggttctttgaatccactgattacaagttataggaagaaggcatttctcatgatatattcactagtgtaggccactgtctagcagctatcagggtgtctggtacatggtagaggttcaatagcggtgctgagtgagtcagtgaataaatgcttaaagttttatcctaagtcacttggataatattatatgtaaagtaggaacataaaagatattttgtattaaattcaggcttctttctttctttctttctatcttcctatgtctctaaccaaagttacttgtgttgtattcagatgtggaaaaatatcaaatgaggtgatatttacttagaaacttttaagtgactttatctaccagatgtcacaaaggcttagaagtcaaaaaatatctagacttatacctatattaagaaaagtattataacattctttatgaaaccagattttaaaaaatggttgttcccaacacagaaacttctataaagagagtagaaagattacaaaacctaatattttaaatgtaattcaagaaatcatttacaaattgataataacatagcctccatgcttaaattagaagtaaaatggaaactc

SEQ ID NO: 252282 - DNA, 327 bp, Homo sapiens
ctggtcgtggtccactgcagtgctggaattggccatacagggaggttcattgtgattaatagtcttattgacatcatcagagagaaaggtattaactgcaacattgaccttctcaaaaccatccacacagtgcagtctcagaggtcagggatggcccagacagaagcacagtaccgatttatctatatggcagtccagcattatattgaaacactacagcacaagattgaagaagagcagaaaagcaagaggaaagggcacgaatataaaaatattaagtattctctagcagaccagacaagtggagcccagagccccctcccgcct

SEQ ID NO: 252283 - DNA, 704 bp, Homo sapiens
tgagatcacaccactgcactccagcctgggcaagagagtcagactatcacacacacacacaaaggaatgaactactgaaaacacaacaacatagttaaatctcaaaagcattttgctacctgaaagaagctacatccaaaaggttacaaccatatcattctgtttctttgataatctggaaaactatgggaatggaaattagatcagtggctgccagggttgagaatggagaaggggatgaatgccaagaggcggtacaaagcaatttctgaggtgatggaattgtttggtaactttagtgatggcattaggcaaaagccataaaacggtacaccacaccagtttgcactgtgtaaaaaaataagtaaacatgccaaaaaaggatccccctgcatacccacctaagtgacaacatgtgctgtcaaggacggagagcaaatggaactcacacattgctggtggtaatgtaaattgctacagccgctttaaaaatctgtttttcaatatctgctaaaattaaacatatgcatatcccataaatcatcaattttacctctagacatgtacataacagtaatacatattcaccaaagaaagtaaatccaagcatgttcatagcagctttgcttgtattacaaaaacctgggaacaattccagtatgtacaaatagcagaatgggtaaatatatcatggtatactgata

SEQ ID NO: 252284 - DNA, 307 bp, Homo sapiens
ctcactcccttttagtcaatgtgttttgggttgcatggaatataacatgagaatgccggctagcaaaatgtaactctgggccagtagaattccatagaataagtcaagagaaagtaaaaacgaaggccgttttccccagctgggtatagtaatggagtggaaataggcaaaatcaccctaaagcaggatcctctgtgcctctccctcacccgtggcctgctgtctgccaggcttctgtaatgcagcccgttctgcgtagtgcaaagtgcaagtgactggtggcctctgtttgggtccttcctctgtg

SEQ ID NO: 252285 - DNA, 370 bp, Homo sapiens
caccacgcccggctaacttttttgtatttttagtagagactgggtttcactgtgttggccaggatagtctcaatctcctgacctcatgatccgcccacctaggcccctcaaagtgctgggattacaggtgtgagccactgcgcccggccacttcaggcagtttgactgcacgagtgtcagttccttgagggcaggggcttggtcagttttgtttatgcctgaatccccagcatctcgaagagggcctctggaggctgaggtgggaggattgcttaagcctgggaagtagaggttgcagtgagctgaaattgcaccctatactccagcctgggcaacacagtgagatcccatctcaaaaaaaattttttta

SEQ ID NO: 252286 - DNA, 536 bp, Homo sapiens
aaagcgcagtattagtgtggaagtgacccgattttccaggtgccgtctgtcacccctttctttgactaggaaagggaactccctgaacccttgcgcttcccgagtgaggcaatgcctcaccctcttcggctcacgcagtgtgctgcacccactgtcctgcgcccactctctggcactccctagtgagatgaacccggtacctcagatggaaatgcagaaatcacctgtcttctgcgtcactcacgctgggagctgtagaccggagctgttcctattcggccatcttggctgcccgcaaaagatcaaaattttaaggaaagggcattgctaggaacaatgaatgcctgaaatcaccatgtataaccatgaaattgtactatgtggggggtgtgatatatgtgtgtttattttattctacattagtacttcatttaaaaataactaaggaacataattcaataactagatcctgccttagaaaaccttttgccatgaatgacaaattcatgtaataaagactgtttttaacccaccaa

SEQ ID NO: 252287 - DNA, 412 bp, Homo sapiens
ttagaaaggagtacaattctagctcatgctccaatgtggatgaagcccgaagacatcataagtggaataacctagacacaaaaggacaaacactgtatgattccacctttgtgtacctagaatagtcaaattcagagagacaagaagtagaacagtgattctcaggaactgtgaggaggggaaagtaggctgttatgtttaatgatttcaaagtttgggatgatggaaaagttctggatttggatagtgatgatagttgcacaagaatgtgaatgaacttcatgccactgaactctacacttaaaaatggttaagatggtaaattttatgtatattttaccacattaaaaaatgaatggggtagatttctatgtattgatatgaaaagatttcaaagatgtaatatagggtg

SEQ ID NO: 252288 - DNA, 526 bp, Homo sapiens
tgaacatgttagctcagatttctagtccttgtcttataaatccaccagtccgactcccatgataacccatgaatccattaaccatttaatctattaattcatgaatggattaatctgttcattatggctaaaccctcatgatccaattacctcttaaaggcctcacctctcaaagttgccacattggggagtaagtttcaaaatgaattttttgaggggacatttaaaccatggcagggtatagggtttcagatttgcaagatagaaagtctggagatctgtttcacaacatgtgaacatacttaacactattaaactgtatgcttaatggttaagatgataaattacaggttatgtgttttttactacaatttaaaaaaactatgcctgttttaaataagtagctcactctcttgtaaaatttactaccttatcaaatttttcaaattgaaccagtgactaaactgtggtcttctctagggtacttaaaattactaaaataaaagaataagtatataaaccaaca

SEQ ID NO: 252289 - DNA, 424 bp, Homo sapiens
ctttccacggtttagtgtcactgacgtgcccctccccagcgacgggaacaggtcgaaaggacggggctctagagccagcgtgacttccagcctgggttctgtccctgatttcctagctctgtaccgctaagcatatcagcctctcgccggtctcattttcctcatctgaaaaatgagcttacgtatcagtccttgctgtgaggacgaaatgacaagatacagtgtgtgtagtccgtgtggagcccagtaagcgcttcccggctgttgcgcctccaccaacagcgcgaacaaatctggaacatagcggaacattagacattgcaggcattaaggacggtcatcgttgcctgaccgtgatgcatttttaatccattgaaagtgccccgagcttatctaataaaagattggcaaatgattatatcaa

SEQ ID NO: 252290 - DNA, 451 bp, Homo sapiens
cgtgttaagacttgaaaaattgcctccaaaatgctctagccctgagggaaacaaacgtcccttcttcattgtagggagtcctggttcctgtggccattcgaaataagactcattcgaaaataagactccctcatcttcagggccatcctcagaaacaggacacatgcagaagggttaggttaagagctaggagcacctgaggggcgggacccccttaagagtaccccagaaggaccatcgatgtatgcatacccacaagcctagacaccatttgtgtacctacacgcacgcaagagatgtggagagacaaggcaactgagattcatggtttgatgattaaaattctcatgaaggtttttagttgtattttctgtattttgcattcggcattttccaagttttccatgacatatcttgctattgaagaaaaccatccacttttttccagaaa

SEQ ID NO: 252291 - DNA, 453 bp, Homo sapiens
actttattactgtatttttcttcaggataaaaaaaaattatgggtcaattttcactgaagtgggctggatgtgtgtattcatctctcatcagtgccaaaaggaattatgcacatcattcattggacaacaggatgaaaacttgtctctgattggacactagggatatcagctgtacacacaagataagtgtaaagttgaaaagagaaatacacttagtaattcactcaagctagcatttattaacactttaaaacttgcattaaaatgttcatgatattatttccttcctcatataagaaagctaacattacaattcttaaattgaatgaaacataccatcataaaaattgctttgcagagactgctaatgcaaaaacttttaagctgttcatccttttttaatgaaaaagataataagatcaataaaagcaccattctttaccacttaaaaa

SEQ ID NO: 252292 - DNA, 218 bp, Homo sapiens
ttttgttccttaaagaaagtatgaaagtagtttctttttcacctgcaggagtacaaacaaaattacaaatagagaagcaagctggtgatgtttgtattctggtttgtattccttggtgatttttaactaaggcaaataatatggaatgatttgtagcactttgagactgatttaagttataatgtctgtgaatctgtaatagaaataaactaaattga

SEQ ID NO: 252293 - DNA, 265 bp, Homo sapiens
gcctatttcaatccaaatagtggaacaactttgggctgaatccaacaatgaatcctgctctctggggagcttttctttaggtcttcttatttctctgagttctgtgtcttggcaggtgttttgttgaatggtttagattcttcagggagagaggtaactgagggaaaaagcaggaaaggctgagcttgattaggaaaggatattgtataaaatcaaagggggataatttagacattacatcggtatatattcactcatttgcaaa

SEQ ID NO: 252294 - DNA, 495 bp, Homo sapiens
cagagatgtaatgtgccttgcttaaagccattcagctaaagatatcagactgggacgtttgctctcagttcagtgctcttgagtctggagtaggttgagtttgaagcattgagaaggtacctggatgtataaacttaaggggttggttaggcattaccaactagaaattctattctgatgtgcaagaaattaattaattgtataattgttgctttcttcctgatatctttacccaagcatctatataaatttaactaatatgcaagtgaataacagatgtgcatgtagagatcagttttgggaaattccattcaaaatgtagagaaatgtctagaaatctgagtttaggaaacaaaattcagaaattccagactcttcctaaggaggatacccagaacaaaactgatggcacacggtaaatcgttatctaagcaacagcttgaatcctgtctctggtttatgactctgtatgaaaaaagaaaataaacttggaga

SEQ ID NO: 252295 - DNA, 371 bp, Homo sapiens
aattaagttcaaactgcctttgtaaagttttggggtagtatcaaagaggaataacacccacacttacctgaaaaggttattaaatatactactccctttttcaactacatatttgtgtgaaactggattttcttataatttaaccagaacagcatatcatgataaatggaatacagatgcagatgtgacaatccagttttcttctgttaagctagtcattagagagatttgcaaaaaaaaaaaaaaaaaaagaatcagtaaaagatataaaggagaaaaggacagaaccacaaataggcaacaaatatgttaaaaaaaagtttagcttcacttaaaatgaaataaatgtgattaaaatattaaaaaaaaaa

SEQ ID NO: 252296 - DNA, 453 bp, Homo sapiens
aattttaggtatctttgttcaccactcactcctacagtagccactttctcctagttctcgtggcgatttgttctacacatgtgcaacccagctctataccaaagatttatggagagcctccatgcagacagctgtctccctccatcacatcactcctttctctcttgcccacaaattccagtcacttcaactgtgttgaactctgctctgtcttctagcttgggaagaccaccattttctactggagctctacctcccagggtcaaagtctgaaaaatagtcctaggtagaaggatgaaataatttacataatgcatgtgcctgtgaagcacttagcatgatgtctgcacagagtaaatggccaataaatgttgatttttattatgaaatctgtatttgatacaaattttatctataatattttattaaagaaaaaagtcttataaaatggta

SEQ ID NO: 252297 - DNA, 408 bp, Homo sapiens
aagtcgcgggctggaaacggctgccccagattacagggcagctccctgcttcgctctcgctcctccggccccgggaacgtgcaggggggcgggaggcaagtcccatcagcactttgaactggggctgctttttagtgactcacctcccagacttcctgcaacagacaactctaaatagctcggtcccaccctccagcaggggagacattccggtcgggaagggcaggaggttagaaggtgggtgccccgccagggcagtccagggagacccaaggacaggagacgctggctgcacagcacaggggcgcacgaataggacgttttgtttacaggcttttgttattaaggaaattggtgtcagtcaaggtaattctagctcagatgagcaataaatatgctcccagctaa

SEQ ID NO: 252298 - DNA, 454 bp, Homo sapiens
gctccataatttttttatggcacacctctcggctgtgaacaataatttttaattgttgtgtgattatctcaaagtcagatcaccctgattttcctgctgttgtgcagctgctctgagccctttgtcagccacccatctgaaggactatgtgtttgtcatcaaatgttactaattccacaaatgaacctctgcccactggccttatgttcctgagtgaggggaacactgcccatactagctcgtgcgttctttgctgctctctaaagactggcctgaaacttcagaccctgagacttgaggaagctgagcccccgtgcccagccacgattccgtgatggtcaaagaaatcaaaacgtctgtcagctagtgttcagttcaggctgaggtgaaaaaatttttttacttgtaaaatatacataacataaaacttgggcggcgcgctccgagcccccac

SEQ ID NO: 252299 - DNA, 581 bp, Homo sapiens
tgcagtggcacaagcaactcactgcattctctgcatcctgtgctcaagccattttcccacctcagtctcactagttgctgggactgcaggcatgcacccctatgcccagctaatttttgtagagaccgagtatcgcttagttgcccagggtggtctcaactcctgggctcaaggagatctgcccacctcagcctcccaaagtgcaggcctagcctgggaggggaattttcaaaacgtgagttttgggaaatagtctatcagccttacctggttgattacacttgtaaaagaaagattaaaagcaggccagtgactctggtctgcttgaacatgtgaatgtagtggtttgagcaatctggagtttgccctagtgtcaaattccagactgtccatagtgtccaaaacctgaggcagatactaatgttaacccccagcaccccgtgattggaaacaaacctaaatacgtattgggaacttaatagcaattttaagcattctgatagattttttgtagggatggggtcatgccatgtggcccaggctggtctgaaaactctggcctcaagtgatctcaagctttg

SEQ ID NO: 252300 - DNA, 1179 bp, Homo sapiens
acttacgtggaaccctaggaaagacactaatacagcctcaccacctaggcctgtcatcagctgtcactccccacagcaatagatataagcagtgaggaaaagagaaatgattttcactttttaagctgttccttaggccgctgagagagcctcatcaagacagaagctcataaaaacaaatgggtgctgggtgaggtggcccacgcctgtaatcccaacactttgggaggctgaggcaggcagattgtttgagtccaggagttgagactagcctaggcaacatggcaaaaccccatctctacaaaaaagacaaaaaaaaattaaccaagtgtggtggcatgagcctgtagtcccagctacttgggaggctgaggtgggaggatcacctgagtctggggaggtaaaggctgcagtgagctgtgatggtgccgctgcactgtagcctgggcgacagagcagaacaggaaaaaaacaaaaacaaaacaaatggggcatgttgacatttgctatggtaaacacttacctggtttattttttggcaaatgaagaacaattgtattaaacattttcttttgtgagttttaaagtagtttgttgcatttctagaagaaatgccttgttgaaatagctgatatggctacctcagaagtgccagggagtcaagccagtcctaattcagtgcctggggatggattgcaccgggctggttttaatgcctttatggcaggtcatgtgatggcctatgtgggagtgagacagggaccccagccctgcagctctggaccctggctccctgaatgccataataaggtatatttgagtggcaaagctgtacccctcacagtggccaagagccagttctcctgttcctccaaagcccacactcagaagataaagctggctcggggcagcagctgacccaacttccacctaccactggggtggaatagaggtatttgggtctctctagcctctctctgtaaatgtcatactctcaactaactactgagtttaggggagggggagtatcctggcagaaatatcactgcattgccctggacttcctcctttaccccagtgtcagaggtagaagggtacaagtaagaaggctgaccaacacctttaacactgactttatttatttttaaatctgaaaatgtcttgggaaagttttacaaa

SEQ ID NO: 252301 - DNA, 472 bp, Homo sapiens
acaagtagcccataacatctgaagggacttcattgaaatcacagaggttctttagttctttacctcattagtaggcattagggaagcacatcaactttctaatttaataaggtgcctgttgctttgaaaaactgctcaaaaaaagataggagaggcttacttaaagatatcactataggcgtggcatgctgcttcacacctgtaatcctagtactttgggaggctgaggagagaggatcacttgagtccagaagatcaataccaacctaggtgacatggcaaagccccatctctacaaaacaaaacaaaatcaaaaaaaatatttaggcatggtggcatgtgcttgcattcccagttgctcaggagactgaggtgggagaatcactgagcccagggaggttgaggctgcagtgagccatgatcatgctgctgcattccaatctgggtgacagagcaagagcctgtctcaaaa

SEQ ID NO: 252302 - DNA, 3588 bp, Homo sapiens
  misc_feature (332)..(332): n is a, c, g, or t
agaatgtcatcctcaagggaagtgcagagagatttcttcagtcctcagctgagtataagctggcctcctggagtctgtgaacacaaacgtccaatgtgagtgtgcctgtgcaagcgcccgggcaggtgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaagaactcgaggcctcactgaaacggaaagcaaatacaaagaaactttattttaaaaacntgtcttggtctcccaagaagagggcaattggattgctcagccagaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgcattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagcc

SEQ ID NO: 252303 - DNA, 690 bp, Homo sapiens
agaatgtcatcctcaagggaagtgcagagagatttcttcagtcctcagctgagtataagctggcctcctggagtctgtgaacacaaacgtccaatgtgagtgtgcctgtgcaagcgcccgggcaggtgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaacttttaacagcttagaaagtacagtagacatactgggg

SEQ ID NO: 252304 - DNA, 463 bp, Homo sapiens
ccaggctgcagtgcagtggtgcgatcttggctcactgcaacctccgcttcctgggattctctgttctctattcgcttctctgaatctcaagtgattctcctgcctcagcctccccagtagctgggattaccggtccatgccgccactataagtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagcc

SEQ ID NO: 252305 - DNA, 6495 bp, Homo sapiens
  misc_feature (94)..(94): n is a, c, g, or t
gtcctctcacagaacaagaaggtatctggtctacaagaactcgaggcctcactgaaacggaaagcaaatacaaagaaactttattttaaaaacntgtcttggtctcccaagaagagggcaattggattgctcagccagaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgcattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagccagtaagtgctctgggacctcattattttaagcctggtagttaaaaaaaatcttgcaaaaggatgccaaagaagataaggacgtggaaagaagtttaatttgatgattaaaaacatgcaacagttttgtgtcttagctctcctactaggattatcggcgccttgaaggaattctcattcatctttgtgttacctttggtctgggtcacaccaactggtatactgaatgcatattaacttagtatagtgcctggcatgtaagagattctcaacaatattctcaataaatattcgctgaatatgagataaattattaatagctactgaataaagaaagattatttaaaaccagagaggaaactccatatatgttctttaatccaaacagtttaattcaagcaatctggaatataaaaagcactttctgatattagaaggagatcagactcccaaaaaagatcagcattctttagtcaagcaaaacttggaagtttacaaacagctaaatcagaagcttgaaattcaggtcctctccagtacctgctacattatatgtaattccaaacatgacttcagagattaaagaagaaagggaagatgtttcccattcttttgtaccctatataaactaagggtaccctgccctaatcttttttccaacacttccccaaataacccttccttacaaagaaagaagtctaagagaactctctcatctaaatatatttaagtagaggcaagcctgaaaaaaacacaaaaacctaaatggtgttaggctgtggttcacctattctcatggcacctcaaattaatggcttgggtgttggtgtaggtaacgcttggcctgtatgttgaggtagtcactagataaaattctgggcacaacatccgtttagcaattgggcatacattctacagatttagccataacgttttgaagctgattattttacagatcaactaattaattcctctccctaactttacagatgagaaagctcagatgatttgcccatgggttataaaactacttccttacacagtggcagcatcagaactggaattcagatctcttgcctcctaggcagtgtttttcctattataatatggtgacttcgtaaagcagggttaattacattccacaaagcttacatcctaatcacaaacaatgggacaaatatttaaattgaacttctttctctgtctagcttcaagtgattctgtggcaagatttactagtaaggctgctgcctataggcctatgctgggcaagttccttattttcatatccagaagttagtcagagcttggcaaataagacttctctatataataatgcctggcccaatgtcccctgtaacatcttacatgcaggacgtagggccaattctttcataacccacaggcaactgtgagtgtcctttctcaaatagtgaaggtaggtattaaagcacctttggtgggacagatgcacaggtgttgcctctgaattggtgttgaggaagtaggcataaaacctcacacagaactgtgtttggtacctgaacactttaaaatcctatggggatggggaagacatgcatggggtggcagcacatacctcttaaccataactcaggacacggcagttcagatttcatgcatgaccctaattcacatttagttgagatcaatggaggaagaagaatcatcctgtaatagtagaccaataacagatacagtaatagttggaaaacataagataaaggccaaggaacaggttgccttattacattttacgaagtatcattttccccagtagtcaaggtagtgtaggctgtatttctttagcaggtcacatgcctgaacaggggttgcagatgccaaagacaatgaccaactcctcactaagaaaaaggtatttaggacatggtcacttattaccacagatgacaattctgcttgacagagatggcttcttggatgtttttaatccacagtgaagaaaaaggatttcaaagtgctgctcctatttgaaagtgaatgagttgactgaagaaactgttgcaaaagaaaaacaaaaatcttctctagatagctggctgatggctgggaaagtcataaatctccaggagcattggattccaggaaagttaagtccattctcaaaatcccattttaaaactgttatggaatgcataataaaataaaacaataaaaaaccctcctaggtcatgtgtgactgctgcttgttatactttttggaagtaatactagccatgttagaaagtccttaaactctgcatttggaaaacaactaaaaaataacataatctatgtaattctcacatttcatcacagttaacaatttcccatttttgacaaagcaaaacaaaaagaaactgcccactgcagacctaacaatgctgtattctataatctaaggtccattatgctttggtaaaattatatatgctcaaattctttgtgcaacttgaaaagacatcaaattccatattatgtatggaactccatgtgttttggtaatatatctgatatattttgttaataaaataagaaattaaaaagccaatgaatgaaaatgtgtcaggaaagataaattcattatgtcagtatttgattaaatgtaacatagaaaattgggattctttcactgcatatcaccaaaagttgggtagtcacttaatcaaaataaaacactgagaaccatggactatttacaaatgtactaaaatttttaaaggagagaaactttaacaaaaatcttgataattaaaaattcaaattgtgctagatagaatgtattccaaaatttctgctaaaaatttttgcttttagtttgtaagacataattcaggagaacctcaaagaaaaatttagcaattaagtttggaaaagctataaaagagacctttactttttgaacagacatttttccctttcccaaaatgtgtattattcaagaagcatatttataaatttcattaaagaaaatatcggccaggtgcggtggctcacacctaatcccagcactttgggaggctaaggtgggtggatcatgaggtcaggagttcaagtgatctgcctgcctcagcctcccaaagtgttgggattacaggtgcctggccagaaaacatgttttttaag

SEQ ID NO: 252306 - DNA, 5125 bp, Homo sapiens
  misc_feature (94)..(94): n is a, c, g, or t
gtcctctcacagaacaagaaggtatctggtctacaagaactcgaggcctcactgaaacggaaagcaaatacaaagaaactttattttaaaaacntgtcttggtctcccaagaagagggcaattggattgctcagccagaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgcattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagccagtaagtgctctgggacctcattattttaagcctggtagttaaaaaaaatcttgcaaaaggatgccaaagaagataaggacgtggaaagaagtttaatttgatgattaaaaacatgcaacagttttgtgtcttagctctcctactaggattatcggcgccttgaaggaattctcattcatctttgtgttacctttggtctgggtcacaccaactggtatactgaatgcatattaacttagtatagtgcctggcatgtaagagattctcaacaatattctcaataaatattcgctgaatatgagataaattattaatagctactgaataaagaaagattatttaaaaccagagaggaaactccatatatgttctttaatccaaacagtttaattcaagcaatctggaatataaaaagcactttctgatattagaaggagatcagactcccaaaaaagatcagcattctttagtcaagcaaaacttggaagtttacaaacagctaaatcagaagcttgaaattcaggtcctctccagtacctgctacattatatgtaattccaaacatgacttcagagattaaagaagaaagggaagatgtttcccattcttttgtaccctatataaactaagggtaccctgccctaatcttttttccaacacttccccaaataacccttccttacaaagaaagaagtctaagagaactctctcatctaaatatatttaagtagaggcaagcctgaaaaaaacacaaaaacctaaatggtgttaggctgtggttcacctattctcatggcacctcaaattaatggcttgggtgttggtgtaggtaacgcttggcctgtatgttgaggtagtcactagataaaattctgggcacaacatccgtttagcaattgggcatacattctacagatttagccataacgttttgaagctgattattttacagatcaactaattaattcctctccctaactttacagatgagaaagctcagatgatttgcccatgggttataaaactacttccttacacagtggcagcatcagaactggaattcagatctcttgcctcctaggcagtgtttttcctattataatatggtgacttcgtaaagcagggttaattacattccacaaagcttacatcctaatcacaaacaatgggacaaatatttaaattgaacttctttctctgtctagcttcaagtgattctgtggcaagatttactagtaaggctgctgcctataggcctatgctgggcaagttccttattttcatatccagaagttagtcagagcttggcaaataagacttctctatataataatgcctggcccaatgtcccctgtaacatcttacatgcaggacgtagggccaattctttcataacccacaggcaactgtgagtgtcctttctcaaatagtgaaggtaggtattaaagcacctttggtgggacagatgcacaggtgttgcctctgaattggtgttgaggaagtaggcataaaacctcacacagaactgtgtttggtacctgaacactttaaaatcctatggggatggggaagacatgcatggggtggcagcacatacctcttaaccataactcaggacacggcagttcagatttcatgcatgaccctaattcacatttagttgagatcaatggaggaagaagaatcatcccttcggtcagctgctacaagtctaaattcccgtaacaacttgccaaaaaaggatctttgtggttttcgaaagagatgaattgtc

SEQ ID NO: 252307 - DNA, 3125 bp, Homo sapiens
cggcgtaatttgattttcgggcttctcttgacctccccgtgtaattagtctcccggtatgtgccctctcttgtagtcccttctggagatttgtctcaaggagcccttccggtgtcccccccgggggcgtttttttttttgggtggggaaaactcccaggcgactctttttctctctgctccccggagtttttcctcttgggaaccacgctcttgtggcccactgttctccatttccctacttgggcgccccgccgcgcccaaccggaggggttttaaaaactttttcgcggggcccccggcggcccccacaaagttttttttttttttttttttttttttccatatatgttctttaatccaaacagtttaattcaagcaatctggaatataaaaagcactttctgatattagaaggagatcagactcccaaaaaagatcagcattctttagtcaagcaaaacttggaagtttacaaacagctaaatcagaagcttgaaattcaggtcctctccagtacctgctacattatatgtaattccaaacatgacttcagagattaaagaagaaagggaagatgtttcccattcttttgtaccctatataaactaagggtaccctgccctaatcttttttccaacacttccccaaataacccttccttacaaagaaagaagtctaagagaactctctcatctaaatatatttaagtagaggcaagcctgaaaaaaacacaaaaacctaaatggtgttaggctgtggttcacctattctcatggcacctcaaattaatggcttgggtgttggtgtaggtaacgcttggcctgtatgttgaggtagtcactagataaaattctgggcacaacatccgtttagcaattgggcatacattctacagatttagccataacgttttgaagctgattattttacagatcaactaattaattcctctccctaactttacagatgagaaagctcagatgatttgcccatgggttataaaactacttccttacacagtggcagcatcagaactggaattcagatctcttgcctcctaggcagtgtttttcctattataatatggtgacttcgtaaagcagggttaattacattccacaaagcttacatcctaatcacaaacaatgggacaaatatttaaattgaacttctttctctgtctagcttcaagtgattctgtggcaagatttactagtaaggctgctgcctataggcctatgctgggcaagttccttattttcatatccagaagttagtcagagcttggcaaataagacttctctatataataatgcctggcccaatgtcccctgtaacatcttacatgcaggacgtagggccaattctttcataacccacaggcaactgtgagtgtcctttctcaaatagtgaaggtaggtattaaagcacctttggtgggacagatgcacaggtgttgcctctgaattggtgttgaggaagtaggcataaaacctcacacagaactgtgtttggtacctgaacactttaaaatcctatggggatggggaagacatgcatggggtggcagcacatacctcttaaccataactcaggacacggcagttcagatttcatgcatgaccctaattcacatttagttgagatcaatggaggaagaagaatcatcctgtaatagtagaccaataacagatacagtaatagttggaaaacataagataaaggccaaggaacaggttgccttattacattttacgaagtatcattttccccagtagtcaaggtagtgtaggctgtatttctttagcaggtcacatgcctgaacaggggttgcagatgccaaagacaatgaccaactcctcactaagaaaaaggtatttaggacatggtcacttattaccacagatgacaattctgcttgacagagatggcttcttggatgtttttaatccacagtgaagaaaaaggatttcaaagtgctgctcctatttgaaagtgaatgagttgactgaagaaactgttgcaaaagaaaaacaaaaatcttctctagatagctggctgatggctgggaaagtcataaatctccaggagcattggattccaggaaagttaagtccattctcaaaatcccattttaaaactgttatggaatgcataataaaataaaacaataaaaaaccctcctaggtcatgtgtgactgctgcttgttatactttttggaagtaatactagccatgttagaaagtccttaaactctgcatttggaaaacaactaaaaaataacataatctatgtaattctcacatttcatcacagttaacaatttcccatttttgacaaagcaaaacaaaaagaaactgcccactgcagacctaacaatgctgtattctataatctaaggtccattatgctttggtaaaattatatatgctcaaattctttgtgcaacttgaaaagacatcaaattccatattatgtatggaactccatgtgttttggtaatatatctgatatattttgttaataaaataagaaattaaaaagccaatgaatgaaaatgtgtcaggaaagataaattcattatgtcagtatttgattaaatgtaacatagaaaattgggattctttcactgcatatcaccaaaagttgggtagtcacttaatcaaaataaaacactgagaaccatggactatttacaaatgtactaaaatttttaaaggagagaaactttaacaaaaatcttgataattaaaaattcaaattgtgctagatagaatgtattccaaaatttctgctaaaaatttttgcttttagtttgtaagacataattcaggagaacctcaaagaaaaatttagcaattaagtttggaaaagctataaaagagacctttactttttgaacagacatttttccctttcccaaaatgtgtattattcaagaagcatatttataaatttcattaaagaaaatatcggccaggtgcggtggctcacacctaatcccagcactttgggaggctaaggtgggtggatcatgaggtcaggagttcaagtgatctgcctgcctcagcctcccaaagtgttgggattacaggtgcctggccagaaaacatgttttttaag

SEQ ID NO: 252308 - DNA, 3484 bp, Homo sapiens
agaatgtcatcctcaagggaagtgcagagagatttcttcagtcctcagctgagtataagctggcctcctggagtctgtgaacacaaacgtccaatgtgagtgtgcctgtgcaagcgcccgggcaggtgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgcattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagcc

SEQ ID NO: 252309 - DNA, 882 bp, Homo sapiens
agaatgtcatcctcaagggaagtgcagagagatttcttcagtcctcagctgagtataagctggcctcctggagtctgtgaacacaaacgtccaatgtgagtgtgcctgtgcaagcgcccgggcaggtgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctagttttatagcatcttctacctgcccgggcg

SEQ ID NO: 252310 - DNA, 6383 bp, Homo sapiens
tatgtttcataaaatattgtttttatttttttaattagtaaataaggtcatgacagattttactcagagtgaaggcctactatgctgacaattatccctaaccatctttctctgccaaattctttactttccttaacccaaaaacaagctcctcccttttccaaccagctgctataagatttggttgtggaaaggaggaaacagaaagcaaaaaggggagtggggtaaaggatgctggggaaagggggagcagacagaaccctttgtgccagctcagaactgggaaaggacattacattcaccaatggcagattctcagcctcacccccccgttcatcctcctgaactctaggttttgaggagacacagaattgggtcttctttaacatcacctcttctctaataggtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgcattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagccagtaagtgctctgggacctcattattttaagcctggtagttaaaaaaaatcttgcaaaaggatgccaaagaagataaggacgtggaaagaagtttaatttgatgattaaaaacatgcaacagttttgtgtcttagctctcctactaggattatcggcgccttgaaggaattctcattcatctttgtgttacctttggtctgggtcacaccaactggtatactgaatgcatattaacttagtatagtgcctggcatgtaagagattctcaacaatattctcaataaatattcgctgaatatgagataaattattaatagctactgaataaagaaagattatttaaaaccagagaggaaactccatatatgttctttaatccaaacagtttaattcaagcaatctggaatataaaaagcactttctgatattagaaggagatcagactcccaaaaaagatcagcattctttagtcaagcaaaacttggaagtttacaaacagctaaatcagaagcttgaaattcaggtcctctccagtacctgctacattatatgtaattccaaacatgacttcagagattaaagaagaaagggaagatgtttcccattcttttgtaccctatataaactaagggtaccctgccctaatcttttttccaacacttccccaaataacccttccttacaaagaaagaagtctaagagaactctctcatctaaatatatttaagtagaggcaagcctgaaaaaaacacaaaaacctaaatggtgttaggctgtggttcacctattctcatggcacctcaaattaatggcttgggtgttggtgtaggtaacgcttggcctgtatgttgaggtagtcactagataaaattctgggcacaacatccgtttagcaattgggcatacattctacagatttagccataacgttttgaagctgattattttacagatcaactaattaattcctctccctaactttacagatgagaaagctcagatgatttgcccatgggttataaaactacttccttacacagtggcagcatcagaactggaattcagatctcttgcctcctaggcagtgtttttcctattataatatggtgacttcgtaaagcagggttaattacattccacaaagcttacatcctaatcacaaacaatgggacaaatatttaaattgaacttctttctctgtctagcttcaagtgattctgtggcaagatttactagtaaggctgctgcctataggcctatgctgggcaagttccttattttcatatccagaagttagtcagagcttggcaaataagacttctctatataataatgcctggcccaatgtcccctgtaacatcttacatgcaggacgtagggccaattctttcataacccacaggcaactgtgagtgtcctttctcaaatagtgaaggtaggtattaaagcacctttggtgggacagatgcacaggtgttgcctctgaattggtgttgaggaagtaggcataaaacctcacacagaactgtgtttggtacctgaacactttaaaatcctatggggatggggaagacatgcatggggtggcagcacatacctcttaaccataactcaggacacggcagttcagatttcatgcatgaccctaattcacatttagttgagatcaatggaggaagaagaatcatcctgtaatagtagaccaataacagatacagtaatagttggaaaacataagataaaggccaaggaacaggttgccttattacattttacgaagtatcattttccccagtagtcaaggtagtgtaggctgtatttctttagcaggtcacatgcctgaacaggggttgcagatgccaaagacaatgaccaactcctcactaagaaaaaggtatttaggacatggtcacttattaccacagatgacaattctgcttgacagagatggcttcttggatgtttttaatccacagtgaagaaaaaggatttcaaagtgctgctcctatttgaaagtgaatgagttgactgaagaaactgttgcaaaagaaaaacaaaaatcttctctagatagctggctgatggctgggaaagtcataaatctccaggagcattggattccaggaaagttaagtccattctcaaaatcccattttaaaactgttatggaatgcataataaaataaaacaataaaaaaccctcctaggtcatgtgtgactgctgcttgttatactttttggaagtaatactagccatgttagaaagtccttaaactctgcatttggaaaacaactaaaaaataacataatctatgtaattctcacatttcatcacagttaacaatttcccatttttgacaaagcaaaacaaaaagaaactgcccactgcagacctaacaatgctgtattctataatctaaggtccattatgctttggtaaaattatatatgctcaaattctttgtgcaacttgaaaagacatcaaattccatattatgtatggaactccatgtgttttggtaatatatctgatatattttgttaataaaataagaaattaaaaagccaatgaatgaaaatgtgtcaggaaagataaattcattatgtcagtatttgattaaatgtaacatagaaaattgggattctttcactgcatatcaccaaaagttgggtagtcacttaatcaaaataaaacactgagaaccatggactatttacaaatgtactaaaatttttaaaggagagaaactttaacaaaaatcttgataattaaaaattcaaattgtgctagatagaatgtattccaaaatttctgctaaaaatttttgcttttagtttgtaagacataattcaggagaacctcaaagaaaaatttagcaattaagtttggaaaagctataaaagagacctttactttttgaacagacatttttccctttcccaaaatgtgtattattcaagaagcatatttataaatttcattaaagaaaatatcggccaggtgcggtggctcacacctaatcccagcactttgggaggctaaggtgggtggatcatgaggtcaggagttcaagtgatctgcctgcctcagcctcccaaagtgttgggattacaggtgcctggccagaaaacatgttttttaag

SEQ ID NO: 252311 - DNA, 1489 bp, Homo sapiens
agaatgtcatcctcaagggaagtgcagagagatttcttcagtcctcagctgagtataagctggcctcctggagtctgtgaacacaaacgtccaatgtgagtgtgcctgtgcaagcgcccgggcaggtgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagcc

SEQ ID NO: 252312 - DNA, 502 bp, Homo sapiens
ttctaagcaaaatacctggtattaatgaccttgtgcaaattgctggaaaagctgctgcagctggtgttgaagtttgatgactgtaagtctttgcccttatgggatcttggacatagaaatgatgttattagctcacagttccttctcctccttaaggggaacaggcaaatagaataacacaacaagcgatgtcaaaatttcatttccttctaagataaaaggcctgtatgtaaagattcagctgagtggcaatggctaaaagagcaatttcaatgagctatcattaaatgtgggattccatggctactgccaaatacactggaattccatttttcaaatgcgatttatgtttgatctttagacaaccatcttcccaagatttacttgtgtgtaatttctcagtgaaaaacttctcagtgaaaaggaaactcctttccccttccttttgtcgaattgtctctcatccctgatttacttgtattaaaaaaaaggaattggaaaa

SEQ ID NO: 252313 - DNA, 311 bp, Homo sapiens
attgctgcccctttggttaactagcagaaagctccaagttagagtctacaacagaatcacttccttcatgatgcctgtagcatactataaatgctctaaatactcaggaatgggatatcatgtaacttagtggttaaaacatgaatgttagaggcaggtggacctgacttatcagctgtacaactggcaacttatcaaacatctcttcagttttgttacctggggattatcataatttactactaagattgctttgaacattaaatgagctattcaggccatttgattaaaagggcacctggcatacagaa

SEQ ID NO: 252314 - DNA, 431 bp, Homo sapiens
aacatttgctaaaagtactcagtaaaaatttgaggcatttatcgaaagttacgtattttatgacttcaattttgtgttttaatcacaacatcaatattttgctaattattactcttggtttattttatcactgaattgtcaggattattctcacattctttccaaaatcattccatgtcatcatttactaagtatttacaaaattctggctacttgtactaggcaagtgggttcaagatgagtaacactgaccttatcctcaagggtctcaagtcttttcgcatcttaaaatattccatacacatgcatattccatacatacacatagagttttctagatgactgaagcttgtcccttaaaatattaaaacttaactttaaaatgaaaatccgtaaaaaatgaaaaatgtcttgaggggctgttgctgtga

SEQ ID NO: 252315 - DNA, 735 bp, Homo sapiens
cgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacgg

SEQ ID NO: 252316 - DNA, 446 bp, Homo sapiens
ttccaagaaggacttatagagatttaacatgctgcataataaagcattgaaaatgcttctgcaaaacccacattccatcagactactttcttgttcggagactttcatgtacctattgtacacagtagagtctaaactctagacctggcatttgagactctgtctgcaagttatgtttctaaattcatttcatactacatacttttatatattttatatatttgcacctccccaaaagcatatctgttacttctttttatgtcatgcacattttcctggattttgttcaaactgtttcattcactgtgaatgctttcatctccatatagcataagatatatttcaacttccaacatcaccccctttatttataaggtctcctcagattcccagatgacagtggccctctcttctctgaacaataaagaggttacctcaggactttt

SEQ ID NO: 252317 - DNA, 179 bp, Homo sapiens
ccttctccttctttcctttctactttttttcctttattccttcatctctcctttctttattctttttttttcttttcttccccctctttctcctttctttcttgatgagtacaagcctcccgggagcacagctctcatcttccattgtatgccctccttggcccttctgtcgtcttctc

SEQ ID NO: 252318 - DNA, 308 bp, Homo sapiens
cctttactgggcaataattagcatgcaataaactgcacatatttaaagtatacagtttggtaagtttcgacatatgtatatacctataaaaccttcaccaccatcaagataatgcacatatctactgcaattagtttacctattcacttgttaatgacattaagattgtttgaaattgctgactattaaaaataaagctgacatgaacgttcttgtataagtgtttgtatggacatattcttccttttctcttggatgaatatgtagaagtggaatagttgggtcatatagctttttaagaaaccaat

SEQ ID NO: 252319 - DNA, 354 bp, Homo sapiens
cgatttcagtcatcaggagtaagagttttttggtagaatctttaggtttttctgtatataagatcatgtcatctgcaaacagagacaattttacctactctttccaatttggatgctttttatttctttctcttgcctaattgctctgggaaggacttccactactatgttgaaaaagagggtgagagtgggcatatttgtactgttctagttcttaaaagctgaaactggtctgagtgcgacggctcatgcctgtaatcccagcactttgggaggccgaggcaggcggatcacgaggtcaggagttcgagattagcctggccaacatggtgaaacccatctctactaaaaata

SEQ ID NO: 252320 - DNA, 471 bp, Homo sapiens
aggattggaagaaatgttatgtaatttcttcctcaaatgtaagactaatcatataaactatagcttttacactgttggttcagttagaaacaatgatacatctctagaattcagttaaagagggattcttggtctagcccagtagttctcaaatcaagatgcatattaccactgcctggaggctttttaataaatactaacagcaggtttccatcttcagataccctaatgtgtgacctagtcatcaatattaaagcttctcaggtacttttaatgtgcagcaaaggttgagaacttttagtctagactatatctgaagtctgtagccatctaacacagattttaattctcatttatcagcatcatctagaacaatcttcttaatctttattccatatttttctttcatgtagtcacaagtctatgacttttgttatagttaattactacattaaattatatctttggtta

SEQ ID NO: 252321 - DNA, 444 bp, Homo sapiens
gctgaagaaacaggaaagctggtggtgtgattcagcctgagcctgaagctctgggaacttgtgtataactggggaggctggcagtggaggatggaactggtataaatgccaaagtttaaaaatgtgagaaccaggagctgtgttatccaagagaagaagaagatgaatgtcctagcgcagaaagaaagagagatcttcctccacctttttattctcttcaggcctttaaagattggataatgcctgcctacatttgggaggaaggatttttgccttctcagtctactgattcaaatgctaacttctttccaaaaccctctgatagacacaaccagaaatattatcttaccagctatctgagcagccttagcccagtaaagttggcacataaaattaacatcacacactatgaatgaaaaacctcaaaattaaacccacactcag

SEQ ID NO: 252322 - DNA, 349 bp, Homo sapiens
gctttgggctgtcaatttccttttctactcaagagttccctcagataacctgccttctgtcttatcttgtcaggccttcaccctctccaagttagaaaggggtctttacaagttagtaaatagactttacatgttaagagaaggaagatttttgtttatagcggagccttgaccaaaatctcctttgaagtaagattgagatacaatgttttaccccatgatgctgatgctacatcaagtcagcattttatttatccactaacttaacaaccattggttgagctccaagaattgcatgcaccactctagatcctgaatctacaccaataaatgagagttcagctgcctc

SEQ ID NO: 252323 - DNA, 322 bp, Homo sapiens
aaatgaattatttataagaaattcacaatattaatatgaatgactcagatccctttaaatgttcagacttaactctgtgaccatgtaaaactctatctataaagtgtgctttgagtgaaattgttatttttcaacaaatgcttccaatgcttctatcacattgtaagtggtctgtatgacattaagtcagatcccgtgtatagtaagctggatgttcaagttgtagaagaaatgaggtttattctttaatataataaaacataatttgtgaaatggacagatacatgtatccaacgttcaataaaaaatagttgttgcatga

SEQ ID NO: 252324 - DNA, 275 bp, Homo sapiens
cccggcctaaaagtgaaatttttaagaaataattttacttaatgtgggaactttttcataatacaataatttttaccccaaaaaaagctgcaaaagtgtttttacttggaattttcagcaattggggcattttatttgtttttttagagtcagggtcttgctatgttgcctaggctggtctcgaactcctgggcttacgagctcttcctgcctcagcctcctgagtagctgggactacaggcgagcaatttttcttttgaaatcttagcaaaaaa

SEQ ID NO: 252325 - DNA, 404 bp, Homo sapiens
catcctcctgactttacttccttctctacccaattcttgccctaccaggtattctcatggaaccgtagcttcccctcaccaactgcaagaatagtgttcttgaaaagtaccacagcagccaggcatagtagctaatgcgtgtaatctcagcctcactttgagaggctgaggcaagaggattgcttgagcccagaagttcgagaccagcctggacaatatgccaagaccctgtcttgacaaaaaaatacaaaaattagctgggtgtggtagtgcacacctgtagtcccagctacttgggaggctgagatgggaggatctcttgagcccaggaggttgaggctacaatgagctgtcatcacatcattgcactccagcctaggcagcagagtgagatctcctccaaa

SEQ ID NO: 252326 - DNA, 459 bp, Homo sapiens
gcggcagttgctggcctagactcacttcttcaggagggaggttcgccctggaaaagctgatttgcatttctgctgggatcgatgccgtggagactgaatacattgaggtctccaggtgaaagaagaaagcttaacctggcttctgaattccaagagcacacggcaaagtgggtctaaatcaacgtctggttatgaagggcctagagccagataggagcttcttacagcttttggcagtttctggtggaggccagctctccttgtcatctaccttggcctgagaagcctgttcccctctgcagaggatgagctcagggctacacctttccttccaggctctcatggtgtggtccaggctccatttctttctctttgaacctcacttcaacatgattagagtgactgaaggtaaagaaataggaactgttttaccgtaaataaattagtccctgctacaaa

SEQ ID NO: 252327 - DNA, 416 bp, Homo sapiens
gtctgggtgacagagcaagaccctgtctctaaaaatgaaatatatatatatttcacaaggagcagtgggatttaatctatgttcttcctggacccatagaatagaaagtcatggaatcaaagaatattaagccgataggaactgtaataatcacctggtccaatccctttaatcacgggtgagaaaatggtctccaagatgttagaagtgattaatctgggattgtagaaatgttccatttgcctttaaaataaaaatacaaaaataagaaagcataaaagtgacttacctaaggttccacagccacacagacaaagaatttgtctagaccctgaatctgttgacttccatccctctactggtcctaatggattccatctgaggctagaactgagtttccaaaaatatcctttacc

SEQ ID NO: 252328 - DNA, 536 bp, Homo sapiens
gcatcctttgctcagaatcaggaatcagcaaagcagcagagaggtggggctgccccttgagtaccggttgtagctggggcttctctggtgctcaggcggtcacatgtcccttggttttccttcatggccctgccctcttctgcttggcactgggtctgcttgcctctccttctgcagttggctccttggggttttgtgaccacgttacattctacaaagccatttactgcccaacaattaaggcagtcatgtaggaggaaggctgactgctaggatccctctttcagtaggaggaaggctgactgctaggatccctctttcagggggcttttctgcctttgcatttctgttggggaatagtgtttccacttgggcttgtgctaggatttttcatgatggattaaaaagcgtctctgtttttccactatcgttgaagttttccaggtttttttaggagtgagccatcttatacaggataataatgtccatcataccttaaaattttgaaaataattttacgtaacttctctccctta

SEQ ID NO: 252329 - DNA, 530 bp, Homo sapiens
aaacaaccctatagaaggttttactgcatgcttgtatgttgctgggaaggatccagcacgctcagaataatggacaatttaggagtgagggcaagtaatgtatgtcacagtttctgtctaaatagacatgctgggtttccacctagatagattttgtgcatgttcagccttaatgtgaaaatttgatctcccaagttgtggttctgatttgtactcctgcaagcagtatgtgagttcagattgattttctggattttagaggtagtacagtgatgttaaaagagtagataggttctagagatagaactatctggattcaaattcaaggttttccttcttaacatgaacaagttgcttaacttctctggatcttgtaactatctggattcaaactcaaggttttccttcttaccatgggcaagttgcttaacttctctgaatctttctcttcatctgtactataggaataataatgctgggtacaaatgggggtgtaagggttaagggaggagtaaactggaaatattaga

SEQ ID NO: 252330 - DNA, 466 bp, Homo sapiens
gtaaaataatgtctatgacactgcaggaatagactcttggcagggcctgctgaaactgatgacctccccagccacaaagtctcagcaagaccgtgggctgctttccggacttcatttgtcccctgagcacctatcagagcccccactacacccacgtggaaaaacaagccataggcacaaacctcctggaggcctccactgtggggagaatcctgatgatgtgcctcttgtacctggaccacaacttgatccaaaggaccaccatccccacgggggggtcctttggcaagcctgcagccctgtcttcatctggaacatcccaggccaatccctgctttatccagatattccctgagtttcctgtccttgttatttaaaaaaatgcacatcttccacagtcttctgccatcttcctaacacatcatggttctgtggcaatgaccacatgatacctgcatcctccagg

SEQ ID NO: 252331 - DNA, 439 bp, Homo sapiens
gcaatttaggacctatcccagtgtggatgagagatattgagttggcttagaaacatgttagatagactagatgtggcaagaaagcccattctggggctcaaaagcctgcacatagagttgctggcacataaatggtatgtataaattctttctcagcccatgagatcaggatgtacttcatcagtataccatgctggtatgaagagattcttgcctccaaagggactcagaatatttcagggaacctgtattagtccatttttacactgttgtaaagacactaccccacactgggtaatttacaaagggaaggtgtttaattaatttacagttctgcatcgctggggaggcctcaggaaacttacagtcatggtggaaggcaagacagaagcaggcaccttttttcacaaggtgtcagggagagaagtgagtgcacaga

SEQ ID NO: 252332 - DNA, 331 bp, Homo sapiens
ggaccaagatgcaaactcagcagtctcatttcaaagtatgtcctacacgtagacttgaattcccctaggagtgccccctgacttgaggaattctcaaaaatatacctgccccggaacactttggccctaacctgtggctgatgcctgagtgactgacattggtgcgtctagtacttggagttaggcaatgactattgcagttgtcaatagagagaccagacatccctacttgtcttggccagtcctggttaatgctaacaatcaccacatcattattaatagctctccaaattgttctggtttggccaataaatgacatggtcaccccacc

SEQ ID NO: 252333 - DNA, 310 bp, Homo sapiens
actagctttcactcaaatttttccccactttaaaactatggggcaagcatctatgtcattcacccacagagaagacgatacagacttcagatgcaccaatgaaagaaatccctcccttcagccctttcacaagtatggaaatcaaaagaagcaaattcagccacaccagctgacctctgatttagagagctgttaggctgtgtcttcaccaattagaagccgttatcatattcaacttcctggctacccagagtgagtccacacaatagaaacacatactttcaattttcagagggaagttatatttaac

SEQ ID NO: 252334 - DNA, 395 bp, Homo sapiens
aactttggtaatagtccattgttatacagttcaggaaaagtttggcacaagcgagctagaatagcaggactgtattattattagattttgggaagaaatagaagatacactgatggaatttcattttctgtctcagtttcactatttttctgatcagtatttgggatttatttgtccttaatagaaatattatgtgaagattaatgaacttttgtacatgaattgctttatgttaattatgaacaattttagtatgatgatatgctaattctttcatttccattttgaatatcccagtgccactttcaccagctctcaaggtaccttcaaattctgcccaccataattctctttcttttaaaagtttaccttggaaatgaatttattctgtggta

SEQ ID NO: 252335 - DNA, 358 bp, Homo sapiens
ccaagtttgttactgcctgagaaggtgtttacaaatcatggtagagaagaagtgtagaaataaggtattgagttggaattggaggcatatatacacacaggtggacataaaaacagttatggatggatggatgtgtgtccaccaagaggcttagaaccaatgacaccccaatggcaatgagcatatcaagtgcccagatcttggctcctaaataccatattccattactactttactagaaactagggctccatgaataaatagatgattccagtgatagggcaagaaaacgcaagatgatcctaaatatgttgttctagaaaataagggaatgctcaatgaatggctggggacgtta

SEQ ID NO: 252336 - DNA, 434 bp, Homo sapiens
attcccttacagttctggaggctagaattccaaaatgagtcttccgtgccaaaaatcaaggtgtctctggtgccacattgcctctggagagatgcagattctctaagggagaatctgttttcttgctttttcccatgtctagagctgcattccttggctcatggcccctttatcttcaaaaccggcagtgtagcatcttctgtctgaccctgcttccatcacatgattttctgcttatagtcaaatgtccctcagcttcccccttacaaagatacttgtgcttatgcatgtggtgcttaatacctaggtgatgggtggataggtgcagtaaaccatcatggcatgtgtttacttatgtaacaaacctgcacatcctgtacatgtatcccagaatttaaaataaaataaagtaaaataaaatttaaatttaaaaa

SEQ ID NO: 252337 - DNA, 427 bp, Homo sapiens
gtaataggaagggaattgagatgtatatttgaaaatataaataatccatcctgtccctcagctcagagttctttttaccagacttttaccagactggttcacttttaccagacttgcttgggttatgtcattttagtcagtatatttggcagaactatcagggtgtgttgcagagtgctgtagaatgaaagtcatgagaaatgacttctaatggtagtttcccattcatttacttatatgaccttgacatttctcattccagtgatctctactagtttataaaattacttagttcaagtagttatatgctgacaatacatattctagagaaaatactcattgagattattataaactaagtttttgacttttcagaagttttcaatgcttatgtaaactgcttagaaataaatttatcattttatga

SEQ ID NO: 252338 - DNA, 444 bp, Homo sapiens
agatcggtggttaggggtggaatggggaagagtgtgcctgccaaggggcacacagaacctttgtgctgatggaatagtattcaatgcagggaacagaccagttcatcatggaggcattccatcagagcgtctagttagagaagatatgtcatggactgcatcggcacagaagtggggtttatgtgagagaggagttggaagtcacacctgagtggagagcaacgtgaaaaggtgatgtcagcaagaatttaggatgtatggaaaggatggtaaaggcaccaactggatggatcagggagacatggaatgcagaatgcaggaaatagatgatcacagtcgtgttaaactgcaaaatgctgagaatgattatattaatgccagtttagttgacatagaagaggcacaaaggagttacatcttaacacagggtcaagtaatacgata

SEQ ID NO: 252339 - DNA, 528 bp, Homo sapiens
cccacaatattttatgcaataaagtatcagtactcagagtcacggcttaatataatttcttttttcctttttaaaagcttcaaacaaataatgtcttacctttagatccctataggttaaaatatgtttgttgactaaaaattgtgtatgattgctgaaagtattcaatgcagggaacagaccagttcatcatggaggcattccatcagagcgtctagttagagaagatatgtcatggactgcatcggcacagaagtggggtttatgtgagagaggagttggaagtcacacctgagtggagagcaacgtgaaaaggtgatgtcagcaagaatttaggatgtatggaaaggatggtaaaggcaccaactggatggatcagggagacatggaatgcagaatgcaggaaatagatgatcacagtcgtgttaaactgcaaaatgctgagaatgattatattaatgccagtttagttgacatagaagaggcacaaaggagttacatcttaacacagggtcaagtaatacgata

SEQ ID NO: 252340 - DNA, 504 bp, Homo sapiens
caggtcaagggatggagcaggaaggcttgagatacacaacccatatctttaaggcactttccatctggtagagaaacggaaatgtatgcacatagcggcacatgcgatggcaacagaacccagggcctgtgccaggcctaccaaggagtgagctgatgcggctgagagttttggaatgtgaggctgggatgacaagcctggggcctggctcttctgtgctcagtgaggactgctccagcctcagccccaactcccagcaaagcccagtttacagaggatgaaactgaggcacagagaagtcaagcgtcttgtgcagggccaggattgggacccacgcagcctgctccagagccgggctctgaccctccacaagagccatcactaaagttccacttaccgctgcaccttcaatctcttcctctctccatccctcccacatgttcacagacaaaatcttcttccttatttaataaaacaatataatgaccagcctggcaaaaaaag

SEQ ID NO: 252341 - DNA, 320 bp, Homo sapiens
caggtcaagggatggagcaggaaggcttgagatacacaacccatatctttaaggcactttccatctggtagagaaacggaaattttacagaggatgaaactgaggcacagagaagtcaagcgtcttgtgcagggccaggattgggacccacgcagcctgctccagagccgggctctgaccctccacaagagccatcactaaagttccacttaccgctgcaccttcaatctcttcctctctccatccctcccacatgttcacagacaaaatcttcttccttatttaataaaacaatataatgaccagcctggcaaaaaaag

SEQ ID NO: 252342 - DNA, 435 bp, Homo sapiens
agcttctaggtgatgctgatgatgctggtccatggaccacactttgagtaatactgtgctaggctaatcctggctaatcttgcctggttgtctaacacaggaaggctttccttatcattttaaagggaggcataaaagctattaccattggctgtgaagcttgattagtggttttctgatctgtgtgtaggagaagcattgttttaattcatgagctctgctccttaatttgctctctttgaaagttctcctggtaattgcaaaggactctttaaatgtttcatgtttattgaattaagcaatggcctttatctcaagtagtgtttacttccaggatcattcagattatccccctccccaaacatattaagattaaaatgtaataagtaattattattttccagcctgggtgacagagcaagactgtctgaaaca

SEQ ID NO: 252343 - DNA, 250 bp, Homo sapiens
agagcctcacacagtttaatagattagtaccagcacaaaatggatgcttcttccctctatcttcacaatactaacagccagttagtagaaaggtgctgtgtatgtgcctgcccgcacacacatacacacaacagctcactccatacttgccagctgacaacagcagaaactacaccaccacctcttctgaactgtcttttcccttgttctggaatctgtgaagacgggcaggtggtgtattagcattctc

SEQ ID NO: 252344 - DNA, 423 bp, Homo sapiens
ggataatcgccagaagtcaaatgagctctgaggatcaggcattagcaatgggtcagtgttgactttctgactttggtggttgtcttgtgctatgcaggagaatgtcctggtttgcagggattactcatggttgcatttggaagtgatggaacatcaagctagcaatgtactctcaaatagtttagaatttttaaagtgctttgtactagtcatgcaagtttagttcaagcttgaaattataatagaaaaaaatctgaacgtaataatatttttttaagaaaaagaagcagcagcaatggccagcccttgagagtctctgggtctgcctattcctctgacccttctataaatattggtgttgacctccctagggcgtcagagcaaacctctccagggtggtccacaaaagtccagctctacaag

SEQ ID NO: 252345 - DNA, 441 bp, Homo sapiens
tggccattcctaggatgacctgggaatttatcccctctgcactgctccccaagcacttggataatgaagctgagctgtcttcaactgtattatatgtagacagaaggtcaccatctacagcctggtgaaaaatgagtcagacctttccactgtaaagacaaacacatgagctgagctaagaatctctttaaaatggacatagaagactgcaatggccgctcctatgtgtctgtaggaccaatgaaggaattattggcatgcactaaaggagatagcaagatgggtcagacacacatatgagagtcattggcaacacccgggtaatgtaaggaatccacgcttcctggaaggtgagtggctgggctcacccctgcctgccactgagacgcagacatgcatacaccacccgcactccctcgccgtttccaaggcggcggccgc

SEQ ID NO: 252346 - DNA, 415 bp, Homo sapiens
cctcgcctccctctcccccaacactgtcccctctccccaacccctcacagcctgcgcgcgcgcggagacacctcagtctacatggggaggacagagaagcgcaaagaacaagagaaaagatgcatccatctgagatctaaaaggagacaatgagaatctctttaaaatggacatagaagactgcaatggccgctcctatgtgtctgtaggaccaatgaaggaattattggcatgcactaaaggagatagcaagatgggtcagacacacatatgagagtcattggcaacacccgggtaatgtaaggaatccacgcttcctggaaggtgagtggctgggctcacccctgcctgccactgagacgcagacatgcatacaccacccgcactccctcgccgtttccaaggcggcggccgc

SEQ ID NO: 252347 - DNA, 5383 bp, Homo sapiens
  misc_feature (1443)..(1443): n is a, c, g, or t
  misc_feature (1475)..(1475): n is a, c, g, or t
  misc_feature (1597)..(1597): n is a, c, g, or t
  misc_feature (1679)..(1679): n is a, c, g, or t
  misc_feature (1683)..(1683): n is a, c, g, or t
  misc_feature (2085)..(2085): n is a, c, g, or t
cctcgcctccctctcccccaacactgtcccctctccccaacccctcacagcctgcgcgcgcgcggagacacctcagtctacatggggaggacagagaagcgcaaagaacaagagaaaagatgcatccatctgagatctaaaaggagacaatgagaatctctttaaaatggacatagaagactgcaatggccgctcctatgtgtctgtaggaccaatgaaggaattattggcatgcactaaaggagatagcaagatgggtcagacacacatatgagagtcattggcaacacccgggtaatgtaagatcctgaaccggctgggggctccagagaggaacagtagggaagaatgtctgtcctgaacatctgtcccttctgcagcccccattttcctctccgccctggcgcacccagcctcagccctgcttcctgtggacgtcaggcagtgatgctcttgccctcaggcctagataaaggtagggtaggcaaggcccagccactgagctcacagaaggcagcaccaggcatccagactggcgggggcacaaggtatggtgcccagcatacaacactgctttgtacatggctatgaaggaaatgtttgtgaaatttaactgaatttttttaaaagattaggcaatggacagtagatatctccagctccagctttacctgccctcttgttctctcctccaaggtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggncaactttcatcgatcgtctggccaatagcctnaccaaacgcaagcgttccacaccccagaagtttgtaggcgaaaagcagatgcgcttcagcctctcagacctcccctatgatgtgaactcgggtggctatgaaaaggatgtggagttggtggnacaccacagcctagagcctggctttggaagttccctggcctttgtgggtgcagagcatctgcgtcccctccgccttccaccnaccnattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtngtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacacctctggt

SEQ ID NO: 252348 - DNA, 5235 bp, Homo sapiens
  misc_feature (1295)..(1295): n is a, c, g, or t
  misc_feature (1327)..(1327): n is a, c, g, or t
  misc_feature (1449)..(1449): n is a, c, g, or t
  misc_feature (1531)..(1531): n is a, c, g, or t
  misc_feature (1535)..(1535): n is a, c, g, or t
  misc_feature (1937)..(1937): n is a, c, g, or t
cctcgcctccctctcccccaacactgtcccctctccccaacccctcacagcctgcgcgcgcgcggagacacctcagtctacatggggaggacagagaagcgcaaagaacaagagaaaagatgcatccatctgagatctaaaaggagacaatgagaatctctttaaaatggacatagaagactgcaatggccgctcctatgtgtctgtaggaccaatgaaggaattattggcatgcactaaaggagatagcaagatgggtcagacacacatatgagagtcattggcaacacccgggtaatgtaagatcctgaaccggctgggggctccagagaggaacagtagggaagaatgtctgtcctgaacatctgtcccttctgcagcccccattttcctctccgccctggcgcacccagcctcagccctgcttcctgtggacgtcaggcagtgatgctcttgccctcaggcctagataaaggtagggtaggcaaggcccagccactgagctcacagaaggcagcaccaggcatccagactggcgggggcacaaggtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggncaactttcatcgatcgtctggccaatagcctnaccaaacgcaagcgttccacaccccagaagtttgtaggcgaaaagcagatgcgcttcagcctctcagacctcccctatgatgtgaactcgggtggctatgaaaaggatgtggagttggtggnacaccacagcctagagcctggctttggaagttccctggcctttgtgggtgcagagcatctgcgtcccctccgccttccaccnaccnattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtngtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacacctctggt

SEQ ID NO: 252349 - DNA, 3574 bp, Homo sapiens
  misc_feature (769)..(769): n is a, c, g, or t
  misc_feature (801)..(801): n is a, c, g, or t
  misc_feature (923)..(923): n is a, c, g, or t
  misc_feature (1005)..(1005): n is a, c, g, or t
  misc_feature (1009)..(1009): n is a, c, g, or t
  misc_feature (1411)..(1411): n is a, c, g, or t
atggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggncaactttcatcgatcgtctggccaatagcctnaccaaacgcaagcgttccacaccccagaagtttgtaggcgaaaagcagatgcgcttcagcctctcagacctcccctatgatgtgaactcgggtggctatgaaaaggatgtggagttggtggnacaccacagcctagagcctggctttggaagttccctggcctttgtgggtgcagagcatctgcgtcccctccgccttccaccnaccnattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtngtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagaagcaggaagcagcagaagcaggaagcggcagaagcaggggcagaagcaggaag

SEQ ID NO: 252350 - DNA, 4709 bp, Homo sapiens
  misc_feature (769)..(769): n is a, c, g, or t
  misc_feature (801)..(801): n is a, c, g, or t
  misc_feature (923)..(923): n is a, c, g, or t
  misc_feature (1005)..(1005): n is a, c, g, or t
  misc_feature (1009)..(1009): n is a, c, g, or t
  misc_feature (1411)..(1411): n is a, c, g, or t
atggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggncaactttcatcgatcgtctggccaatagcctnaccaaacgcaagcgttccacaccccagaagtttgtaggcgaaaagcagatgcgcttcagcctctcagacctcccctatgatgtgaactcgggtggctatgaaaaggatgtggagttggtggnacaccacagcctagagcctggctttggaagttccctggcctttgtgggtgcagagcatctgcgtcccctccgccttccaccnaccnattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtngtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacacctctggt

SEQ ID NO: 252351 - DNA, 1445 bp, Homo sapiens
  misc_feature (587)..(587): n is a, c, g, or t
  misc_feature (1079)..(1079): n is a, c, g, or t
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggcataagacctacctgtgctacgaagtggagcgcctggacaatggcacctcggtcaagatggaccagcacaggggctttctacacaaccaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcnctgcaaatgctgcgggatgctggggcccaagtctccatcatgacctacgatgaatttaagcactgctgggacacctttgtggaccaccagggatgtcccttccagccctgggatggactagatgagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggngtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact

SEQ ID NO: 252352 - DNA, 645 bp, Homo sapiens
gtgatccacctgcctcggtctcccaaagttctgggttcacagacgtgagccaccatgcccacgtagaatgaagtttcttaaatacactagttaattattgaaacatatgcagtattgagtgctcctacacaaacacgctcagcctctgcccccagtgtgctctgtgctatccacagccttagtagaacatgaggctttttgtcatttcaccagtcattcaataatgactcatttgagtatggatcatgcactagctaaataaccagttgcgctcatgtaccctgaagcaaattgtttagcctgacccatgtgtaagaagatcacagagattcccaacctttcagtgtcaaaaagcctttccatatatattactttaaaacccattttcccccatgtgtaatagtctatgttaatgacggttcgggtttcttctacattgtttgtgacctgagaaagtttaaaagagcctcagtttctttcatctataaaaataaaagagatagaaggacagtttacctaaggaataaatctggtaacatgtaaagtactgaaataggctgggtgcagtggctcatgcttataatcctaatactttgggaggccaaggcaggaggatcccttttaggccaagagttcaataaatag

SEQ ID NO: 252353 - DNA, 354 bp, Homo sapiens
tgtgtagtatcttttattcttttccatataaagtctttactagaaaagtcagcaaatataataaatttatacagagttcccgggtttggtttaactggttccaagctactgtatttcaaattgtatttccaaacttttaccacattttgaatgaataaatgagaaagcttgccaatatttccagtaaactgcattgtgttacttttataaaggacgacttttgccttctatttgtatgtttgctgtttggaaaaatttttattttattatgatgaaaaaagctatccatgaagtaaataagtggactaaaatctttttcttaccctcataataaaattacttattttaaatcta

SEQ ID NO: 252354 - DNA, 570 bp, Homo sapiens
  misc_feature (145)..(145): n is a, c, g, or t
gaaagaactacagagggacgatgtccaaacaaaaaatggcatcacctgtcaaaaatggagttccacttctccccgcagacctagataaagaaatgggggctcagagcagtcaagaacatgccccaagttattcgtcagtgaggcngaaattgtggtgtccttgtgtttgttcacatattgtcattacataccagagcacaccttcatttaaaacacatcaagactccgtgaaatgtcaattgctccaagtggaagacttacctgaaatgctatgagatagcacaatgcagccagctcagaaagagctcgccattgaacattattaccatgctgacccatcttcaagagcagagaaccagcatgcatgtagaaatgtcctttcatttctaagaaagtagctgacagttcatcatttccacccaaagaagatttcgcagactgaagagcactatcaaaactgtaatatgaaaatatcaaacagatgatacacacttactgcactgtgaataatcatggttcatttaattcaaaacaaaataaaaattttatttcaagcttcaaaaaacacat

SEQ ID NO: 252355 - DNA, 779 bp, Homo sapiens
ctgcagtgagccgagatcacgccactgcactccagcctggcaacagagagagacttggtctcaaaaaaaataaaaaaataaaaaataagaaaaggttttatgttttcaaagattaatagatatactgttacatatacacaatacagtcataaatgttatatacatgtgtttcaattaacatgttaaactgcaatcatattcttctatcataggctataaagccattgccctacatctacttattaggattttgtccaagtaacacatctttttgaatcaagtttacccatcatacgagattacatctttatcatgttcccaaaaatggcagagtaaaaagatcaaactcttcaaatttgtctacaaacaaatcatggcaatgcaggctttcgacaagagtgcactcaacatccctgtttcaccagcctcaccagtattgtgtatgcttagttattttccactgtatcaaattgactatttcatttcaactttaattccacaggtttgttcacatattgtcattacataccagagcacaccttcatttaaaacacatcaagactccgtgaaatgtcaattgctccaagtggaagacttacctgaaatgctatgagatagcacaatgcagccagctcagaaagagctcgccattgaacattattaccatgctgacccatcttcaagagcagagaaccagcatgcatgtagaaatgtcctttcatttctaagaaagtagctgacagttcatcatttccacccaaagaagatttcgcagactg

SEQ ID NO: 252356 - DNA, 303 bp, Homo sapiens
tgcttattcgaagtaacaacactgatctttttacaacttttgaatcctgtgtatatatttaattatttgtctttatatttcagttcttgattagtgattcgaatatataatatttttaaaagttggaattggaagaatctgtgatgtggagggggaaaaataatatatcacaaagtcttacgtattatgttacttggatttacgtggaataaacttactaatttcctttaaatcacatttcaggccaagtgcggtggctcacacctgtagtagtctcagcagtttgggaggccgaggctggta

SEQ ID NO: 252357 - DNA, 435 bp, Homo sapiens
tgcaatttgtggactttactctgtgatttcaacaggactgtaaaatatatttgagaaaattggggacatttgaacacggactgcgtaataggtgaaataatagaattaatgttaattttgtcaggtatgataatggaatggtgggtttgtggtttttaaaaatgctcatctgttcgatttatatactactgacttaattatggataaaacaatatgacatcaaaaaaggtgaataatagataaagcaagatggacaactggggctggacctgtgcttggtgggtccttggtgtacctggtgggtcctgagcaccaccccggtggttctaggtgtgccctgtcaaattcctgaaaactcctcttataaatgtgcaaatatttataatcagttttttttttttaataaaaagagtctaacattctatggcgacatta

SEQ ID NO: 252358 - DNA, 535 bp, Homo sapiens
cttcagacaaccaacggcctatcaagtagtgtcatttatggagaaaaaaaaatgttgaaaaatgtaaaggatgagggtgaagataatttgatagcatgaaaaatattagcctccctttcttattttaaagattgtatacttaaagtagtggccatttcactatattaaaatatttcttgcttaaattctgtgaagaagctttgatgtaaacatctttgcaattagaaattaaagccaaaaataggggagcaaatataaaggaatcggtcagagcaaaacaaaatgaaaaaaaccaaaaagtgttgaaaacataattactagttataactttaatggagatttttaaattatgaaagttgagttggccattcttacttgctaggacagaaactgctggggaaagaaactggattctcaatttcagacaccatcatatgttatagaaaatgttattcttttgttctaatggaaactttattatgatttccagggatgctaaatatgcacacatcagttcctgcagataggaacagat

SEQ ID NO: 252359 - DNA, 379 bp, Homo sapiens
acggatgtgtccgtggcaccggctgtctctgaggatgtggcctgagaaccctcgggtcaccaagccaagagctgagttggcaggagttcctacaatcacagaggctaggcctccatgtggcataaagaagagcattgtcttggcaacctaagagatgattcaatgaataaggctggtagcaagactgcttattattacctgacctcagttgattcggtgcccaagcagtgaaatataggcaattcatggaattcctttctttctttcacactaattatacaacacaaaccatacaagtctgttaccagtggtatttacaaatgaatgtcttgtagagcaaatttcacattaacatttttttctgcattgaaaaaccatc

SEQ ID NO: 252360 - DNA, 537 bp, Homo sapiens
ctgctcccctccccaagaaaaggcacgcccttgagagtcttactccaacccccaataaaaaacaccccccaataaaatatccgtgtagatttttaaccaccaaccccagctgactaccccgtttagacgatgttgaggacagaagccagactttggaatcaccttttccccctcttgtccctcactcaccttctccaaacttaccaattattaaatcctggaccaagttggcaagaggactttagatgcagtaagatttgcttattaacccagcatgcgagctgccaggctgaccctcagagcagtgccaaaagatggcagaaaggggtctcccagcccctccaccaaagctaggtgctggtgcattggaactgagtgaacagagggtctctgaagaccacttggactttctgggcagtacagcccagaaagtgatgagagcataggctctggactctggcagacctggattccagttttgtctgtgcccctccctggctacgtgaccttgaactagtcatttgaccacttggagtc

SEQ ID NO: 252361 - DNA, 424 bp, Homo sapiens
ccgagatggcaccactacactccagcctgggcaacgagcgaaactccgtctcaagaaaaaaaatcaggagagtttatgggaaaagcctcacttccgacttatcttggaaactggaagatttggtgcaaattcccttaaggccataactggctgaaactgaccatggcactggggacacggcgtggcctgcccctgccagcctgctctacgccaccacagccatgcacgagtccaactcctgcgtgggaatcggctggaatccctggagggggtctgtcttttcaccacggggagcttcagaagtaaatgccctgtccagtggggtaggatgaacggcggtgggcagggctccccctggaaacggccgtgaaaacagacggcttgttctgcaagatgctctcggtcgagagggactcaccagggg

SEQ ID NO: 252362 - DNA, 369 bp, Homo sapiens
cccagtcatagggacagagtgtgagcacctgcttccagggcggcccaatgaaggctgttttcactcaaagacacactcccatcagatgcttctgggcaggtgcatggaacagctaccaagacacagccatggggcactcactacgtggctcttcgggaaggcagtttggccccatcaagcacaattcaggaagaacaagtacattaacgacagcattgcacaagaggagaaataacctaagtgtccatcaagaggggactggttggaaaaaagaaacacagtggaattctacacaaccatttaaaagggtaaggcagatcttcatatacttgcaaatatgcccattaaatactgttatgtaaaaataaa

SEQ ID NO: 252363 - DNA, 331 bp, Homo sapiens
ctgagagtgcggcatcacgaaagccaaattaggagaaagtttcaaaaggaaagaatagccaaagcatcaaagggactagagccatcacaggaggggattgaagagtggccataggagatggtgattctgtcattagcaatctcagagctggatcactggactgtcagatggaatctgttggaatgttgtagtggctttaggagttagaaaaagctgacgaagcttggctgaaaaaggaaaggaagacatgtctttcaattacctatgaaatatttccttgccttttttttcaactttatgtacatctttattaaagtaaaaattcagaaaa

SEQ ID NO: 252364 - DNA, 527 bp, Homo sapiens
tctcctaagtttattaaatgacactctaataatgtagaatgaatgcaaatgtggaatgaatgcatttatttatttctaggtttccctctgtgtgagttgactgttgaggtttcagtcctaaaatgcagtgaactccctatcatcagctttgtggcctctgctgtcaccctgtctccctagccccaactcctgcacactgttttagtttgtgactttaacatcagatgtaatttctttcaagatcttctttttgttattttatttgtttgcttatacatatataaacaatacatacatgtgtaaataaaataaatgaagtcataaaccaaaatatgaatgtattaatgcataatgtttatttgggaatgtgcttatttctttcatttgcttagtgcattttctacatgtattattttttaaaaatcaaaatattttttaaagagagggatgtttagttttttgtttgtttgtttttggagacagggtctcactctgtcactcaggctggagtgcagtggcacaatcat

SEQ ID NO: 252365 - DNA, 364 bp, Homo sapiens
agagtcatgtttccaaaagccctgacaaatggagccagggaagtccatgaagagagggattttacgcactacctcaaagacccagaagaaaccacgccagcttgcacaaacactattcgcaaccttacacagaaaatacttttgggacatctgcctagaagccgattgtccaaacccgaactggcagcatccttgttattaatccttgtagccaagaataattatttcaagacaattatataatctttatctgtcctttaaaaacctgtcttcctttaccttcctgaatacacacagtttactatggcatgcatattgccttcacaatgccctattcccaaataaacatcattttcttttagaa

SEQ ID NO: 252366 - DNA, 422 bp, Homo sapiens
aaaaaggggctgaggttctattcatggtgagcaagtcttttttttgtttgtttcttcaagctctaacaagggtgcctactacatggcttttcagttaactccaaaataaaatgtaacaattttttttctattcttaggctttatctacaaagaaatgaattggataatcttcataaacaaaaaactggaaaatttatcaaccagaatatgcagtagagacatattttgatgagaaatgacttaagttatgttgtaactggtagctgattaagtatagttccctgcaccccttctgggaaagaattatgttctttctaaccctgccacatagttatatgttctaaatcttccttgctggtacatctatattgatatatgtatacacatgttctttataaatctattaaatatatacagataaa

SEQ ID NO: 252367 - DNA, 832 bp, Homo sapiens
atggacacgtttatttcgacttctacgacttatcattctgataagagtttttcgtctggctcatctaaaaagacaacttggaaagctgataagaaggctggtttcaggaaacaaaaggtgatacgaaagggatggatttgacctagacctcacttatattacagaacgtattgtcgctatgtcatttccatcttcgggaggccagtctttctatcggaatccaattaaggaagaaccggaactatggtttgtgcctgcctgattgccagtgaaatatttttaactgcagaggtgttggaacaggcgatggatatgatctaaaagtccaaatagtaatgaagaaaaagattgtcttttcctgtacttccttaaacagttgtcgggtatttcatgacactgaaacagacagggtaataattgatgtgttcaactgtccacctctgtatgatgatgtgaaagtgcaagcttcctcttcggattttcctaaatactatcacaactacccttttttcttctggtttaacacatctttaatacaaaataacaagctttatctacaaagaaatgaattggataatcttcataaacaaaaaactggaaaatttatcaaccagaatatgcagtagagacatattttgatgagaaatgacttaagttatgttgtaactggtagctgattaagtatagttccctgcaccccttctgggaaagaattatgttctttctaaccctgccacatagttatatgttctaaatcttccttgctggtacatctatattgatatatgtatacacatgttctttataaatctattaaatatatacagataaa

SEQ ID NO: 252368 - DNA, 796 bp, Homo sapiens
gaataggaacagctccggtctacagctcccagcgtgagcgacgcagaagacgggtgatttctgcatttccatctgaggaagaaccggaactatggtttgtgcctgcctgattgccagtgaaatatttttaactgcagaggaaagattgtactattttggagaacggcgaacagataaaaccaatggcactaaatatcagggagtagaaactccttctcagaatagatatgttggatattttgcacaagtgaaacatagctacaactggaatctccctccaagaaaaacactgtttataaaaagattagttatttattcgattcatggtgttggaacaggcgatggatatgatctaaaagtccaaatagtaatgaagaaaaagattgtcttttcctgtacttccttaaacagttgtcgggtatttcatgacactgaaacagacagggtaataattgatgtgttcaactgtccacctctgtatgatgatgtgaaagtgcaagcttcctcttcggctttatctacaaagaaatgaattggataatcttcataaacaaaaaactggaaaatttatcaaccagaatatgcagtagagacatattttgatgagaaatgacttaagttatgttgtaactggtagctgattaagtatagttccctgcaccccttctgggaaagaattatgttctttctaaccctgccacatagttatatgttctaaatcttccttgctggtacatctatattgatatatgtatacacatgttctttataaatctattaaatatatacagataaa

SEQ ID NO: 252369 - DNA, 640 bp, Homo sapiens
cagtgttgtcctgctctcagtccaggtttgggaaaatgcctgcagcttttccttgtgtcctttcctcacaaagtctccaagtctctcgttaaattagctccaggacttgggagaaacagtgcccctcctcggtccgggttgcttggatccccagtggaaaggaagaaccggaactatggtttgtgcctgcctgattgccagtgaaatatttttaactgcagaggtgttggaacaggcgatggatatgatctaaaagtccaaatagtaatgaagaaaaagattgtcttttcctgtacttccttaaacagttgtcgggtatttcatgacactgaaacagacagggtaataattgatgtgttcaactgtccacctctgtatgatgatgtgaaagtgcaagcttcctcttcggtgagtaatcaagaaacggcctctgccactgttcttatctgaacttttgaatggttttatttaaggtttcctttactacagttcccaacaagggagatgatagatgtcatcccatagagggagggggagaaaataaatcagatctataacaatttttttaaaagaacatatgtaatttgaataatttttgttcatttgttttttctaaattgtacattttctaaatttttct

SEQ ID NO: 252370 - DNA, 277 bp, Homo sapiens
cattacatgttattgtgtttataaaatacttatcacaatgcatggcacatagtgagtcttaaatgaaaagagggtgttattaagtgtctgaggcgaaggaagactattgacactaatggcaaccctaaattcttcagaaataacaataatttcttgtgtgactggctgatattttatacccaattatgatgcaagacagtagtgattatgcacaccatttaatgtgctcaaaattaattttgtttcatgtggttaaaacaaaattcacaaaagatgt

SEQ ID NO: 252371 - DNA, 310 bp, Homo sapiens
ctcgagttataaaaataatatcaaagattagggcttaaaaatgaggtcttcaaatatcagatatttttgttatcgcatacatgttggagaaactgtggtaagttaaatatcagtcccttccctttggtttcaaattctaaatttcctactttttctttctctctctcaggttaactcttgttatttgaaccgaaggaaagaaagcaaacttcaaaatattgttgcttctgatattttctgccttgtgagcaaaatagagcagatgagcaaatggtccgttaaataaagcaaatagtccatcaaactaagc

SEQ ID NO: 252372 - DNA, 537 bp, Homo sapiens
tggtgagccagccaggagtgaagacgacaggtttgctgtctcctttgcctgtgggtctggggccccagcctgggggagacccgtgactccaggcatgctatcaggacaacttcaacccgaggggagatcagctctcccgcaacctggtgccgctctctgacagcacaacagaacctaaggggctacaggatgattcaaggaacagtgtgctacaggacctcgcaagaagaccctcaccagatgcagcccctctatgttggacttcccagcctccggaagttagaaatgtgctacaaccactcaaggtctgcaaacagattcctatttagatgttgttgagagctgaatttctggaacaagagatatagattaagactgttgttacatgttgcctacatgactttcaaaagcttgattcccagtggcgctctcaacagcagtcataaacaatggtaattcaatgtatatttatattcaactgatatattaattggaatatattaaaaatacgtatatttatattcagaatatttatat

SEQ ID NO: 252373 - DNA, 484 bp, Homo sapiens
tggtgagccagccaggagtgaagacgacaggtttgctgtctcctttgcctgtgggtctggggccccagcctgggggagacccgtgactccaggcatgctatcaggacaacttcaacccgaggggagatcagctctcccgcaacctggtgccgctctctgacagcacaacagaacctaaggggctacaggatgattcaaggaacagtgtgctacaggacctcgtttcgctcttgttgcccgggctggagtgcaatggcgcggtctcggctcaccgcaacctctgcctcccaggttcaagcaattctcctgcctcagcctcccgagtagctgggactacaggcatgcagcaccactcccggctaattttgtatttttagtagagatggggtttctccatgttgaggctggtctcaaactcctgacctcaggtcatccgcccgcctcggcctcccaaagtgctgggattacaggcgtgagccaccgc

SEQ ID NO: 252374 - DNA, 802 bp, Homo sapiens
cagcctcgcagcactgctcttctgcttgctactccagcgaagggacatgcctgctggccaggacgcttagtgggcctcgtaacctggcgagtgtgtgcccgcgcgtgtccaccctgcccccggccggtgcgccccgcgcgcccaaacccggccggcgaccactgcgcgccgggcgcttccaaactgctcctgtccagaggcatccctctttcggctttctccatcccgcgtccgcttccgcacccgagagcgacaagcaaaaaagattcagtgcaactcaaggactggtttgttatactcaaaatgtaccaggaacaggaacaaaagtattttataaaataattaatttttatgggctatgagtcccaaatggttatgtaatcaaagtggaagcagaaaagcatggcttagaaaataattggtcatgtcatgtcacgcttaacacatgtgcagactctgccctccaggttgcagtgcgatggtgtgatcaatgctcatagtagcttcaaactcccaggatcaagtgatcctcctaaataaacctcctgagtagctgggactacagcttccaccatgggatgatacagcatgaaggccctcaccagatatgcaccccttgattttggacttcccagactccagaactatctctgtggttactctgtgaattggtctgtacaggcccacttgagtacagatgagccatttcagctaagcctacaagacacttccagctaaacctagcccaaattgccaacttgcagaattgtaagctaaataaatgactgtaagccgttaagtt

SEQ ID NO: 252375 - DNA, 524 bp, Homo sapiens
cagcctcgcagcactgctcttctgcttgctactccagcgaagggacatgcctgctggccaggacgcttagtgggcctcgtaacctggcgagtgtgtgcccgcgcgtgtccaccctgcccccggccggtgcgccccgcgcgcccaaacccggccggcgaccactgcgcgccgggcgcttccaaactgctcctgtccagaggcatccctctttcggctttctccatcccgcgtccgcttccgcacccgagagcgacaagcaaaaaagattcagtgcaactcaaggactgcttccaccatgggatgatacagcatgaaggccctcaccagatatgcaccccttgattttggacttcccagactccagaactatctctgtggttactctgtgaattggtctgtacaggcccacttgagtacagatgagccatttcagctaagcctacaagacacttccagctaaacctagcccaaattgccaacttgcagaattgtaagctaaataaatgactgtaagccgttaagtt

SEQ ID NO: 252376 - DNA, 385 bp, Homo sapiens
atgcttggctaatttttgtattttagtagagacggggtttcaccatgttggccacactgttctcaaactcctgacctcaagtgatctgcctgcctcagcctccgaaagtgctgagatgacagacgtgagccaccacacccagccctattctcaattttattcccagactctgccctccaggttgcagtgcgatggtgtgatcaatgctcatagtagcttcaaactcccaggatcaagtgatcctcctaaataaacctcctgagtagctgggactacagcttccaccatgggatgatacagcatgaaggccctcaccagatatgcaccccttgattttggacttcccagactccagaactgtaagaaataaatctctgttctttat

SEQ ID NO: 252377 - DNA, 460 bp, Homo sapiens
aaatgcagactctggtgcagtaggtcctggcgggaacttgaaattctgcattttgaccaaggtccaaggtgaatgtccagtgctgttgtccttggcctgcagcaggaggagcagggatctaagacttggagagcaaatgtcaagctcagaagaaagactggaagtttggggacaaaacccaaatatggctaaagaaagcctgtaggtaagctttgagttgtattttccatcgcatctgaagctgtgctggccaacatggtagtcactggccctgtgtggctatgggctagtcctaatggacatgtgctctaacatgtaaaatacacactggattttcaatacttggtaccaagaaaataatgtaaaatatctcaatactttaaaaacattattgcatgttgaaataatattttagatatattgggctaaataaaatatacccatattactgaaattaaca

SEQ ID NO: 252378 - DNA, 354 bp, Homo sapiens
tcatttttttccctccctcttccatctagctctcccctccatggcccatctcatccacctctgccatctccatgtccaagttcaggggcagcagtggtatgtgatgttggcagcagtgcccaaacatcagcaatcagtctactgctgtcccagcaccaagccaggggctgtgaagggtgaaggtgaaggctctttgggtcatctgacccttgtctccactcaaaatgagacaccagggtgttctccacccacatacattcaggattgctgtctccagtctctatttgagacatcagagatgtcatcatttccatatgcttctcctaataaagtaacatccatttaaaggcaaaa

SEQ ID NO: 252379 - DNA, 369 bp, Homo sapiens
ggacatgacataatttatttaaccagtctaatgttgatgtacattgttgttccttatttcttaccattgcagtaattttactgtagttaacatttggatttatttttcatagaatgaattctcacaagtccaatcgctgtgtcaaagcatatggccttttaaaaggctttggtagcctgttgcctaattgtcttccgaaaagattccccacatcctggtcaattcttcagcatatacacggccatctctatattaagacactttatattaagatttgtaaacctgttgactactgtcacaggccaccaccactctgggcatcttcaggtcatgctacatgttcaccagtccttccagcagtgggcagtg

SEQ ID NO: 252380 - DNA, 294 bp, Homo sapiens
acatattttactagttttcttgcttgggatccaaaagtgaatgaattttagaggcaggtggaattatgtctatataattagtggcagtaattaacttttgacacaatgcgactatttctcattctcaaagagacttaagtatgaattttcctcagaacttcttccgcaagatacatatttgtgactgtctttattttcgacaatgcctctaatggtgagcaagctggtttagatgaaacgtgctgcaatgtctttaagaggcagaataaatacacaacgacaattttaaaatca

SEQ ID NO: 252381 - DNA, 357 bp, Homo sapiens
gttttatgtattacaaaaccacataaacagtgcttcttggtctgtaggcccacctgtgcagtggacttctggatttctctgtgtgctctgaggaagggatccaagtggccattgttgacaggccattggcctgtgttgacagcttgtttctgttatgcctttgctcagtatagtcttgctggtggtagcgacaggcgggaagtgaaagaccactgagtgcctcttaaatcagttgtcattttggcagattcaatctaaaccaaggatgacttccatatgcaatggctgtgcaggatgttttggcccaagcaaataatacttaatcagcagtgtggttcatcttattactctaaggag

SEQ ID NO: 252382 - DNA, 499 bp, Homo sapiens
tcatgtacatattaggttaagtggcatgtttcttttattaatttttaggttcataacaaatttatgtgctctgttttcactccggtagctaggaaataaaaatggtttgaatctgatttggtttcccccttactcactatagtgcattggcaccacaccctgctgagctccagctttactctcccatctttttattcctgttcccaggcagaatgctgtctgcacagtgcaagttctgtcccctgcactcacacagagcatgggatgaccacaaggccaggtgctgagaatacatctcaggcttgcctttgtaactgtgctgctgagaggacatgtatttgtgttcatcaggcagaaagggaggaaggctaccacttaaggaaagcctacaatagctttctctttgtgtgtgtgataaggagcatttgggataaatacacagcaggtctttgaattacatcgtttcattcaatatcatttctttctaacaccgatgaga

SEQ ID NO: 252383 - DNA, 431 bp, Homo sapiens
gatgtaaaccttgacattctgtgcacgtaaaaatcatgtgctcaatgtgtttgtctcaactccctcagctcgtgatgccctcagggttctgtgggcatttatgcactgaagaaacaggagttcacacatccacctctggactgtgaaatgtgtattgagaaatactttgcaagagagaatttttttaagtgaacaaacaacaagtctgtgccacacacatcttccatatgccctgactcaggtcacttaatctccaggatttcatttcctcacctggaaaatatggagtttgaggtagattctcatctatcattaaatcaacactttaactaaaacgtaagctccttcagggcagagaccgtatcttcagtatcaaaaacaatgtttgacacatagctgctcaataaacatctgtccaatgaaggtttatt

SEQ ID NO: 252384 - DNA, 443 bp, Homo sapiens
gttgtacaggttatttagtataaaatgaaaaaggaaaaacaaaaagtaggtagaggtttttccatcttctgtttttgaccctttcctccttcttggaagcgtttagtattttttctccttttcttttttttttttttctttagagttcataccatttttattccttaccgatattttagtgggggttggagaagaagaattggagttaaacctatgttcagtgggccatgtttatctggaaatttgttatttttgtctttccaaataattcatcatgtgtttgtttttagttaagccttacagttacatgtcgagatttgagaaaagtcctatcaatacttcagttagcctgagtaactgagtaatagaggccgcccatatgctatgcatccagtcattgctttacatttagttttggttctctgaaatgctttggctaataa

SEQ ID NO: 252385 - DNA, 360 bp, Homo sapiens
gagagggagtctcactctgtcacccaggctggagtgcaatggtgcaatctcagctcactgcaacttcagcctcccggatccaagcgattcttgtgcctcagcctcccaagtagctgggattacagtcacttaccaccacgcctggctaatttttttgtatttttagtagagatggggtttcgtcacgttggccaggctggtcttgaactcctgacctcaggtgatccacccatcttggcctcccagagtgctgggattacaggcatgagccactgcgtccggctgtgcttttgagttctcatccaaaaaaatctttccccagatcgatgtcatgaagtatttcccttatgtttttttttc

SEQ ID NO: 252386 - DNA, 576 bp, Homo sapiens
tcctttaaataattgaactgttacaggaaacattgttaaaatcttaaggttagggcatgctttcatttttttttgtctaaagattactctgcaccctagacaaaggaaatatttaaactgttaaatttgaacaaagatacagtctgcatatgacttctctgaagccctataaaaattctttaaaattgcctattcactcaaatttactgagtgtagcaaaaatgtcaaaggcataaagtcagagaagattgaataaaataatgcagaaagacagattagtcatgcacagacccacacagcctttcagagcacacaataccgctctttattaccgttctatctttacaaagactacgttcaatacatagaagatgatacatggccagccatgtcatctgcctgtgattccagaactcatctatctgggcccttttcacaatgacattgatgagagatcgcagtgttttcagagcattgttttatttatcatatataatggctggtgaaagaaataggaattatgtcaccgatagcacataaaagagttgcatagaagattctgtgacaaagtttggt

SEQ ID NO: 252387 - DNA, 648 bp, Homo sapiens
agccatttcggctagcaattaatcagttcaagtctggatgccaattttatttatttatttttaatgtgaggcatcccatcttttccaaaccctaagaaacaatgcctaatcaagcaccaatttaccacacataatgccctacaaaaaagctgacaaaattataatcagttcattctctgactatgcttcacgcatattagcaaggaatgacatctaacaagtcacaacttagtgatgaaaacttgctggaccagagaacagctccagggaaagcggcagggagaggtggtcaaagggaaacaaggaggagaatatcggcacccggatccggctagacaagctggatggcaggaaacgggtaggtacttcccaggccaggtaggaactggacgccgggtcgaggtaggctgtgtttacaccccctcccacctcagcggccccgaccttcaggaaaccccgggggtctccaccaggctggtcgcgcccctccaatgctagtcagctggggctcaggggcaaggcgagaagaagccgttgctgctgacaggctcgcagcccagggcttcggcaggcaggtaccaccagcagaccccacccgcccctcacgcctacccctgggtcggagctcgcaggcctcacggcggccgc

SEQ ID NO: 252388 - DNA, 425 bp, Homo sapiens
actcacccatgcagacatcgcagagcgactgcaagggcttcaggagctgtggagggtggggcctaggggaatcagctctgaggtcagagcagactttcgttccatgccctgagggattctggaggttattctgcaacctgtcactcaccgtagagtgtgctgcgaagcatttggggatctgcaggccccacccccagtagtgcctcactttccttagtctgcttgtccagggctgtgggtctagggggaagcagcagtaggttcttcatcttgagccaccatgagctcctcacctccaggatcccgaggagctctgttttgatccagctggccctaaaaggctgcaaaactaattgggaaaaaaaatacagggacttttggcctccagaattgtaagagaataaatctctgttgttttaagcaaa

SEQ ID NO: 252389 - DNA, 425 bp, Homo sapiens
cgggcatgggtttggatgccatcaatgatgctatgcttctggaagtatgtatctaccacctgctgaagctctattcctggagcagccctattacctggacctaatcgagctcttcctgcagagttcctatcagactgagattgggtagaccctggacctcatcacagccccccagggcaatgtggatcttggcagattcactgaaaagaggtacaaatctatcgtcaagtacaaggcagctttctactcctaccttcctgtagctgcagccatgtacagcaggaattgatggcgacaaggagcatgctaatggcaagaagatcctgctggagatgggagagttctttcagattcaggatgattaccttgacctctttggggaccccagtgtgaccagcaaagttggcactgacatccaggacaac

SEQ ID NO: 252390 - DNA, 463 bp, Homo sapiens
ttgacttagatttttcagctttacagtgatatgaaagggatatgaattcagtagaaaccatacttcaaattttgaattttcatctttttctgggcttgtgatgtactctttcatgatgctgagcgatgtcagtgagctacagctcccagtagctcccagtcagccacgtgatcatgaggttaaaccaatactgtacagtgtattgtacagttgattgccatatgatgttgcccaaccataggctaatgtcagtgttctgagcacatttgaggtaggcttggctgaggtaaaatatttgctaggttaagtatatcgcatgcatttttgacttaatggtattttgaatttacagtgggtttatcaggatgtaacaccatcgttagttgaggaacatctgtatttcaagatacattatattttaaataggcttttggcattaccctagttttgtagccaatttagg

SEQ ID NO: 252391 - DNA, 467 bp, Homo sapiens
ttgttctttgttttctttaaaacagttcctagaatttgatgcttctggtcttccaaccagcaattaattgggaaccaccatattgtaagataaactctagactttttagcctgacattcaagggtgccttacaatcagacttaatttatcatttgtcatctttcgctcatgcaggtgtcttgctctctgactacattgagctataaatataccaaccctttctttgttttattcctttaccctagaatgctttttttttgcctaatagtatttgatttttcactttaagcccaaatccggtttttgctactcccttctcccctgtaaagccccaccagtgtctatatttctactctcatagcaacatgacttgtttagcatttgtcttattatatatgctttttatatcatattcatttgttaatatgtaacttatatacaataaaatttaccaatcaagcatacaa

SEQ ID NO: 252392 - DNA, 474 bp, Homo sapiens
atgagtttatcctctttgctagacttctgttaagataaactaaatgctgtaagaaagtttcctgtcatcacccttgttaaggttcttgctattgtaataactttctgaacagtctacccttctcttaccttgtccacactccagttcctcctccctgccactgccagattgactttcatgaagtacagttttgattgtgtcattagtccacatactacatctccgtctctgctttggtgaattagaaactcagagctgactctatcctttactgttaataattgtgcaggatcttctttaaaaatttttgtacacaacctactcctgatgtcatttgactatcttattattattttaaccattcatcttggactctttacatatttttattctattacattgtatttttgttagttgcctcaaattccttttgaaatgtggagaggtgaaaataaacagatgcagaaataaata

SEQ ID NO: 252393 - DNA, 1558 bp, Homo sapiens
gtcttacaataaaaacaaaaataaatttcctgaaccggtataaaacaacatataagccatcccagagcaacttgtgttttccaaaaaaaagaaagaaagaaacaacatcaaactagattcctttcatctatgattgacacattaaatgtttacgcatgaagagaatctggaattttacccttcattagaagttattgttaaatgttgaaaggaatcaaccactttttataactgactctgtgatcaataatgctaaaaaagagacagagaaatgatttaatcaatgactgtcactcatgactcagacataacttcgtgtatttccagaagttaaaaaatttaaatcaattctgaactaattttgtttcaagaaattcttgttgctctttaagagaatacgaggcatactggttcccaaagccaagacttgggaatcactgatttgggagtatgacttaccaccacatgctgatccatacatggtgggcccaataaatgtttcaaggcaaaggagtaatcatcccgctaaggaaaagaccagcttccctgagccctatttcacatggagcaggccaagaataaggttacgtttattataaccaaaattgactatgttttctgccatccctttaccaaaaattatatccaaattaacactacataccatataacaaatttcttcccaaaaatcacgtagctctatcaaatacttaatactgctagtaaatctcatatattcatgcttttaaatcaaataagggtactatggtctgaacactttcagaattaagccatgtatgaactgaagtcttacatacacatgcatacatctgtaaagtaatgagagctacacgtaagcaggagccaattattcacagatggtcacatttttcctcagatggtcaaataaggcttattgagactctttcaagatcaaaatgttagactgtgggaatgaaagctccaagaaatgcaaatactatgtctgaacacagctaagcaggaaaatacaattaatgcaacagaaatacttgaaagtcacaggctttgaggactttacattgcaatgttcaaactgagcttctccttagcctgttaccttactttcaattatgtctagcagtccccagtccttcagaacttaacagccactggagagagagagagagagagagagtgtgtgtgtgtgtgtgtgtgtgtgtgtgtgtatatgtgtatgagagacagagacagaggcagtgagagacagacagatgagagagggagagagggaaatgaatagccaaacacatggaaaactgtccttcttgaaattggcacactggacctttcaagtacaaagaaaaatttgaacgttgcagcttaaaattcagttaagagaattaaaaagcaagtcataaatgccacatttttcctcaataaaaagttttgactactgtgtttatctgttgtcttgagtaacttattcatgaagctctcctattcttccccaagaccattttgaagaaagaaaatacaggttgttcttggggaagataggagagtcctccgtcgaact

SEQ ID NO: 252394 - DNA, 1504 bp, Homo sapiens
gtcttacaataaaaacaaaaataaatttcctgaaccggtataaaacaacatataagccatcccagagcaacttgtgttttccaaaaaaaagaaagaaagaaacaacatcaaactagattcctttcatctatgattgacacattaaatgtttacgcatgaagagaatctggaattttacccttcattagaagttattgttaaatgttgaaaggaatcaaccactttttataactgactctgtgatcaataatgctaaaaaagagacagagaaatgatttaatcaatgactgtcactcatgactcagacataacttcgtgtatttccagaagttaaaaaatttaaatcaattctgaactaattttgtttcaagaaattcttgttgctctttaagagaatacgaggcatactggttcccaaagccaagacttgggaatcactgatttgggagtatgacttaccaccacatgctgatccatacatggtgggcccaataaatgtttcaaggcaaaggagtaatcatcccgctaaggaaaagaccagcttccctgagccctatttcacatggagcaggccaagaataaggttacgtttattataaccaaaattgactatgttttctgccatccctttaccaaaaattatatccaaattaacactacataccatataacaaatttcttcccaaaaatcacaaatcaaataagggtactatggtctgaacactttcagaattaagccatgtatgaactgaagtcttacatacacatgcatacatctgtaaagtaatgagagctacacgtaagcaggagccaattattcacagatggtcacatttttcctcagatggtcaaataaggcttattgagactctttcaagatcaaaatgttagactgtgggaatgaaagctccaagaaatgcaaatactatgtctgaacacagctaagcaggaaaatacaattaatgcaacagaaatacttgaaagtcacaggctttgaggactttacattgcaatgttcaaactgagcttctccttagcctgttaccttactttcaattatgtctagcagtccccagtccttcagaacttaacagccactggagagagagagagagagagagagtgtgtgtgtgtgtgtgtgtgtgtgtgtgtgtatatgtgtatgagagacagagacagaggcagtgagagacagacagatgagagagggagagagggaaatgaatagccaaacacatggaaaactgtccttcttgaaattggcacactggacctttcaagtacaaagaaaaatttgaacgttgcagcttaaaattcagttaagagaattaaaaagcaagtcataaatgccacatttttcctcaataaaaagttttgactactgtgtttatctgttgtcttgagtaacttattcatgaagctctcctattcttccccaagaccattttgaagaaagaaaatacaggttgttcttggggaagataggagagtcctccgtcgaact

SEQ ID NO: 252395 - DNA, 383 bp, Homo sapiens
gcggaatcatcatgccgtactctgtaacgtgtgcctcacatcctcagcaacacctggtgttgtgggtctttttaaggtttagatattctgagaggcgtgtggtgatttcatactgtggatttaattggtgtgtccctgatagctgatcatgttacacgtttccttgtgctgacgactggccatatctttctctcctaagtaaatgttcaattttttaaaaattatgttatctttctaatatgcagttggatgatttctctatatatcctggaaactagtgctttgttagacacatgcttttcagatattttatctttctctatggcttacctatttatgaatgatgtgttttaataaacataagttttacattttaaaaatgt

SEQ ID NO: 252396 - DNA, 571 bp, Homo sapiens
tttgttttttttctatatttttactttttgtagagacttggtctcactatgttgcccaagctgatcttgaactcctgggctcaggtgattctactgcctcggcctctcaaagtatatgcacatatttgtctccctgcatttttcttcacattactggtaacctgccatccacactgttcgctacttctttttttcatttattaatacacggtatattttgttgtccattgcccaaaaataacacatggatctgcttcattcttttcccttttttctggtcctgatttataatttaatggctgtgcagatgccagtccctcctttctgccgttcacaagcccactgctctgggatgagggttttctgctcaaaagcatggatgtgcgagagcctccagctagccacatatttacccgccagtgtgtctgaagcagcagcttcccctcaaacttggccgacaccaccaggactcggaagctgcaggcacgacggttgagggtcacgtcctccacctccatatgcttcgcctccgggtcccactgcagcttctcctggagttatttggtgctga

SEQ ID NO: 252397 - DNA, 415 bp, Homo sapiens
ccttatttattcctaggatcctcaatatgttcataggacctgtcatgtagaagtgcacagtatatacttatgaattgaatgaatgagtctcagggctggaaaatatcttagaagagcccaggtctatccccatcctataattaaatgcccttgaacagttttgagacccagtccatggactggtacccagctcatgagggtgtttttacctaaactgcagcaaaacaagactagtaagaacaatgctttttcattgttctaaatctattcaacttaaaggactttatgctaagattctgctcttcctgttttgggaagtattaaagtatcttctattacattgtggtgatgataagtggtatttaactgtttaatgtccttacttggaaaaataaaaataaaaccttggtgactt

SEQ ID NO: 252398 - DNA, 803 bp, Homo sapiens
acagcacacttggtctgtgtggtggtttgaggggttctgtctgtacactgtgctttggctgtgttggaggcgggcaggtgggaaggaagaaatgtattcttggggagatttgtttttagagacatgagacatggaaaatagttaagtaataatataatatgggaggcatggactatcagaggaggcaggcaggactgcccaacctcctcactgggcacgttacgctacttcctcctgacctctatagtcctttgcatttatcaagcactgtcatacgtgttatctcatgcaatgaccagggtgtcaccccctgttttgtaagtgacaaaactgtcactcagagggatgaaatgacatgctaaaggtcatctagttagtaatggtggaatcagggctggagcccagtcttctaagcctagttcctattctgctcttcatcatctgtctcaggatggtaaactgaggcctggaaaggagaaggaactcacccagcctaaagattaagggttttatgctggccacggtggctcatgcctcccaacattttgagaggctgaggtgggaggattgcttgagtccaggagtttgagcccagcctgggcaacatagtaagaccctgtctgggctcaaactcctggagcccagtctgtctatagccctagttcctatagctgtcttcgatcatctgtgctcgaggatggtgaaagggtggcttgggccggcgaagggaactcactccagtcctgacagataggggtcatatggctggccagcggtggcccatgcgttccacgatttcgaga

SEQ ID NO: 252399 - DNA, 788 bp, Homo sapiens
acagcacacttggtctgtgtggtggtttgaggggttctgtctgtacactgtgctttggctgtgttggaggcgggcaggtgggaaggaagaaatgtattcttggggagatttgtttttagagacatgagacatggaaaatagttaagtaataatataatatgggaggcatggactatcagaggaggcaggcaggactgcccaacctcctcactgggcacgttacgctacttcctcctgacctctatagtcctttgcatttatcaagcactgtcatacgtgttatctcatgcaatgaccagggtgtcaccccctgttttgtaagtgacaaaactgtcactcagagggatgaaatgacatgctaaaggtcatctagttagtaatggtggaatcagggctggagcccagtcttctaagcctagttcctattctgctcttcatcatctgtctcaggatggtaaactgaggcctggaaaggagaaggaactcacccagcctaaagattaagggttttatgctggccacggtggctcatgcctcccaacattttgagaggctgaggtgggaggattgcttgagtccaggagtttgagcccagcctgggcaacatagtaagaccctgtctttacaaaaaataaaaaaaaatagccaggtgtggtagcacacaccagtagtcacggctactcaggaggctgaggcgagaggatcacttgagcctgcgagatcgaggctgcagtgagccgcaacggaatcattgcgctccagcctaggacagagtgagactctgtctc

SEQ ID NO: 252400 - DNA, 462 bp, Homo sapiens
tgagaaataaatagaagaaatttaaaaacatattaatcacatcatacagaaaaaaatcagttaatattttgatttttaaacctctagactctatttatgttgatacacatatatagagtctgaatcaccacttgggctcgggtcttccatggtctgctctgcagataataggtcccaattttattggcagttgctaaaacaagaaggagttctattctcggggaatttggggaagtattattaatagattgaatattgtcaagtttattttcagtgtatgcatttgtttttttgttatcatctgaacaacaatgtagtcacattatacgtttgttatataatctgctttccctcactaattaatatatatataaataatatatttccttgtcaagaatatagatttacattataacttttatggaataagtatttaattgaattaataaactatactttctt

SEQ ID NO: 252401 - DNA, 404 bp, Homo sapiens
tgcagtgagctgacgagctcgtgccgattcggcacgagccagcctgggcgacagagtgagactgtctcaaaaaaaaaaaaaaaaaaaagaaaaagtcctttcagtgggaagtgacaaagcttgaaaaaaggttcactggggccaggcatggtggttcacgcctgtaatctagcactttggaaggcagacgcgggcagattgcttgagcccaggagttcgaaaccagcctggccaacatggcaaaaccccatccctactaaaaatacaaaagttaggccagcctggtggtgtgcacctgtgattccagctacttgggaggctgaggattgatgctcgggagaatgagtctgcagtgagtcgagattgcaccactgccctccagcctgggtgacagatatcctatc

SEQ ID NO: 252402 - DNA, 416 bp, Homo sapiens
acagtttttaatgctgttaagaaggaaataaaattggctgcaagggcgcttccaatctagttgaagcaaaaagggcgtaaatacatgaaaagatgcaaacatgatgtgaattacaacaatgcaaactaggattaattgccaaataaatgagatagataaacaagtgctcttaataggaaggaaatggcagggcgctgtggctcacgcctgtaatctcaacactttgggaggctgaggtgggtggatcacctgaggtcaggagttcaagaccagcctggccaacatggcaaaaccccgtctctactaaaaatacaaaaattagccaggggtggtggtgcaggcctataatccaagctactctgaaggctgaggcaggagaatcacttgaactggggaggcagaggttgcagtgaacc

SEQ ID NO: 252403 - DNA, 469 bp, Homo sapiens
ataaaatttctatgactttttagtccgcattcagtaattaatatcaaatgtttaaatattcaaaagaaagtaattgcctatcattattttttttaaaaaaacatttcatatttctttttggcctttcaaaatccaatgttttctactgaatttcctgacataataccccagcctcatagacacacccaacctgatagtcttcattctctcctgcccttgccctgttctagcaggttcacataaattaatctcgtctttcttttaaccctctcttcctctcatgtggtttaatatattacgtttacttttcttctgattaaatttgaaggaggaatttaccttatttttgtggcatatattccaggtttcactattagcaacttgttgctattcaataaatacatttaattaagtgtccttttcacccatttcaaacccatttaacccataaacatttatcaagtactta

SEQ ID NO: 252404 - DNA, 1115 bp, Homo sapiens
gagaaaaattagcctcatcaactgtccagcattcatccttaaagtagtcttgttatcctttactctgtagtggttttcctaaagtacccctgcatgaaaaacaggattagagtgctagagaagactagtgaaatttgaaaaggcagttcacttgtgatgtggacttgtcttagaaacgcaagactgtacagaagtgtgatgagggagacagctgggtgtgtgtgtccaggtagttccatgttggcgagtttggagatagaaagtggcctaaggaagtttacttcctgaatgtgaatgttggccactttggagatagaaagtggcctaaggaagtttgcttcctgaatgtgaaggcctcagtgtagagagatatcatccactgggagatcactgaaaagtaaaccaaaacatttttattaatacatgggatggtagaatgtcactccagttttgttcctaaagttcgtagctctctaagaaagtgaattttaagcaagttaatctattttaatgcatcactgctctttcggtgtttttctagtagaattaatgataggtagcttgctttattagcttactgcccagagagaacattggtgaaattgttttggcttcagctctctggactgagtttggctgcctagctcagttttcagttggtcaccaaaacctgtcattgtttttgtgtggtatggggtctgctggagtcatgtggtagtgcgtttggcccttcattgagtggtggagccaggagttgagctgagggctgtggcagaattttgaattcaagtgaattcgaatgtgaaaataacaatgtctggccgggcgtggtggctcacacctgtaatcccagcactttgagaggccgaggtgtgcggatcatgaggtcaggagtttgagaccagcctggccaacatggtgaaaccccatctctactaaaaaatacaaaaattaggcgggcgtggtggcgcacaagtgtaatcccagctacttgggaggctgaagcaggagaattgcttcaattccctgcttgaacccaggaggtggagatttcagtgagctgacatcgcaccattacactccagccttggcgacagagcgagactctgtctcag

SEQ ID NO: 252405 - DNA, 549 bp, Homo sapiens
atggggctctgttctctccttgccaagaccacgatgataacgcagttgtgatggccacaggactaggaaggaccatggatataggcagcaaagtctaaggaaattttcttagacagaagtctgaaactagcatggagaataaatggttaaggaaagagagagaaagagagacagcgagagagagcgagagtgagagagaaagcgagagcgagagagacagatcagagatgggacctccaaagccaggatgtagcaaggttaccagcagcagccctgtaagctctcccttgtaacccagcaactatgttgtgaggaagcccaggtcgcctggaaaagtccacatggacaggaacccaggaactcagctgacagccagcaccagctggcccacctgtatgcatgggccctcttggaagtagaccctccagccttcagtagaacccctccaactgattcaatgtgatacaaagatgaaccttccctgccaagccctgcccaaattgcaggtttgtgggcaaaataaattattgttgttgttgtaatctacta

SEQ ID NO: 252406 - DNA, 657 bp, Homo sapiens
aagttattgattcttttaatcaatgtattactggattgaattttctccttataacttacccattgtttgcagcgattgtgtttaagtcatccagaagaatagaatacctgaaattatggaaatacttgtttgtccctctcctcttgaagttgttttcccataatctggcaaaagtttatgtgcaactgctacaataggaaagcagtctatttgctgttatatttttccccttcagaaaaaagataaagcataaggtttacaatgaatcttgttaacaagggattatttatgagtatggattttacccagtaacagtgctaagatttacccaatacctggtttatacttgctatttaaatacaggcctgcagatctgaacacatttttaaattagtgtataattcatgtatcataaaatttactcatatattttaatctgtagatttgtatccaatacttcacccttttaaagtgtacagtttagtggtttttagtatattcataaaattgtgtaactatcatcactaattccagaagatctttttattttgccgctttattttaatatgagaatttgattcattctcctgataaaaattgagaaaaaaattaaaacccttttatagttaagcgtacataggttctgtgtgtttctaa

SEQ ID NO: 252407 - DNA, 454 bp, Homo sapiens
gtggaatttctcaatgagcgttgaggtcgacattcccatagtcagctgtatcttctataattcgttgtcgcatctaaatttcacttacagcattataactttttgttttcttgctgtgctttcctcattgctgacaaagtccctctttgaattatccatttttgtaaaatgtctgtggatttatcactggagacaaggaggcaaaacaagtatgctttactgtctgtgttgtgaagtgaatagcaggtgctcagtgaccagtcactgacagaccttgaaagaactgacgtgagtcactgatgatgatgcgcatgtgttattgtgtagaaatttgtgaattgaagagctagtagcaggtttgtgccttatgcaatcactcatacttaatatattgtggtagctaaagtttgaattgtgttgttgggggactggaactactcaaatcatggtaatg

SEQ ID NO: 252408 - DNA, 248 bp, Homo sapiens
gccttatcactagagaaaatactccgaaaccagagtgaggatggagaatgtgttaccagcattctcacttcgtttctctgtctagcatgcttctggcatgggctcctggcaaaataattctccttttcttcacctctctaacctgattgaattagaaccctcatgagagtttcactctcccaggataccaaatcaataatcattttccttgaaattcttctgctggcttttgctttttgaggcaaagc

SEQ ID NO: 252409 - DNA, 521 bp, Homo sapiens
ctagatacttgtgaaaggatattgtggaggaggagctgggggtagtaagtatgatggaaggcagacgagttttggaatcttgtctccaaaacactctcatctgttagaatgactcctaggctataggattgactatggcttagagtggattcatagttgttaatttcatcatgtgacttgtgacttatccttttcttttcataatagaatgaaaattgccatctgtctggcttcttccccatctttttgccttctttcattacaccacacacgtgtcctaattattccaaaggtgatacatttgcatgtttccctttaaactcctttccctctgtcactctgtggagggttcacatgctgcaatatttctgttccaagtaaagatcacaggttttgatcctcagtcctcagtatacacacctcttttagggatttctgggcttcttgactagctcaagctcttcagaggcatgcactttatcttggtgttcagtcttgactggtttaaacttttgatgtcc

SEQ ID NO: 252410 - DNA, 426 bp, Homo sapiens
aaaggctgcaagtttttttccacttggtttagctgtttgctgagcctccccgcccccctccccctgcgcccccgtccctgaggtgtctgctgctccaggatggccatgtccccttgtgcaggtgcacctcgcctcccctgacctcaccaagtcccgcttcacttggctcactcccggcagtctcatctcactccaggcatcccttgctgcccccttctcttacctgccatcctccttaaactcgcctcaatgtcttctgaccccatgtgatcagtggtatctcaagtgttaatcacaaaaggttataaatgttttaagagaacttcataaaagtgtgtgaatatagagtgcggaggactcgaggagggaggccggggaagggagcagggtcgtggtatagaatctagccctaaaatccaggcactc

SEQ ID NO: 252411 - DNA, 738 bp, Homo sapiens
  misc_feature (108)..(108): n is a, c, g, or t
gattcgcgtgaatggcctctccagacataagcagatcaggttctcccctgcaatctcaaagcacgccccgtgataaagagcttgtcttgtagtacccttccagtgcanctccaagatagcaccctcattgggcttagcatagcctacagcgtgagtctgtattaactgcttgaagcagttaaacagactcaggttctaaaagcttcaattagaattgatccacattgtttctgctcacatctcattggccaaagcaagtcacaaatcacacctaacttccaagggggaagggaggtaccctcccactatgtgctcaaaggaggagaaatggaatatctgtggctggccctagtgactagcaggcaggaagctccagtgaaattccctgaatgccttcctcgttaagtccaggtgacttttattaggttgtttgcaagaatagtagatgttgctccagggaatattaaaggtgccaccacacagtctgatatccacagagccctgagccacttcagtcaagatctaccccttgtgtgcttctgactcctccaccaatccagcagtctgccccaacacagacgccatggtggggcatgatggggcagggggcgctgtcagataaaaacatagacaatattatcagaactgtaagatatgagggagggaggcttgtgactaagtgctggtggacctggaattagagtgttcgtgttttactgaagcggctttattcatagg

SEQ ID NO: 252412 - DNA, 441 bp, Homo sapiens
tgctgagcaaattcaccattaccaagccaccactacaagaacggctaaaaggagctccaaatcttagaaccaaaacttggaagcacatcaaaacagaacctctttaaagcataaatcacacaggacctataaaacaaaaatataagctaaaaaagcaaaaacaaaaaaaccaaagtacactggcaacagagagcatggtgaatgcaacagtacctcacatttcaatactaacactgaatgtaaatggcctaaatgctccacttaaaagatacaaaactgcagaatggataacaactcaccaaccaactatctgctgccttcaggaggctcacctaaaacataaggactcacataaacttaaagtgaaggggtggaaaaataatttcatgcaaatgggcaccaaaagcgagcaggagtagtcattcttatatcagacaaaac

SEQ ID NO: 252413 - DNA, 448 bp, Homo sapiens
tagcctgaaggacggggccttactatggaatgtgagaacgtgaccgatgctctcttcacacctcccagattcctctagcgtttttaacacctctgagagacagaccccgtcctgctttcatggcagcacagctctgtggcatgagaccaggcggtctgctatgtaggaccttaggggctgacaggtgggcaaatctcatttatctatctttggaaaatgtggttctcatgagttaagaggaccaactaggctgatgatgtcttcttgggggacagattaaaaaccaattgtgagtttgtatataacaggtatgttagccaccatctgccctaaccacactgatgtcaagcttctcttggctacatcaccttcttcttgctgcttcttcccatattaatgggagaaaaagtttttttcattcattccatatttaacttatgattagtaa

SEQ ID NO: 252414 - DNA, 411 bp, Homo sapiens
acctacaaacctttcgccaagtacaagaacatgacctgcttcctgcatctgttgatgtgtttctttcctttcccattcctatgctgcctcccttgcatacatggccactttaagatttgttattccattgcttattctgtaggaagattcaggtttttttcataaatataggctattcagatgttctgtttttgtttgtccgttttggtaatttgagtaatgtaaaatatttgcctactttatctttgtcttcccattactttttaagattgtttcatctcataatggtaaattttgtattttatcacaataaaaagtcagaaaaatatatttaacatatctacatatctttttataatgccatttaaaactgataaacctcaaaaaaataaaaggttgttacattgtaaa

SEQ ID NO: 252415 - DNA, 552 bp, Homo sapiens
cagaatgatatacatatccaggtacaggcaggtcagagatcaccaaacagatgcaacccaaacaaaactaccccaggcatataattctatgtgatccagtttcttgaatatttcttacgatatgtcatgtaacctgttacttgggaaagttttccaagtgttacacatacatagtagtcagcaatgctatttaacaagtgtttctagatcttctcagttgtgatgaagcttatattgcctgtatcccttgtctctataacgactgtgacacaatgcttaattgcattggcatgtggcagtagcatgaaatatattttcactaacccagtgagagtttgggtgtttttgtaactgcaggattatcagccaatgctaatgtggtggatgtggggtaatattagagtcctagtggtgagaaaggtgacaatccatgttacacatgagcaacacttatgaagctgttatgtgctataacttgcttaaacatgtatctaataaacttgtagcactacaagaagtatttgaaaataaaaacaatattggcacataaaa

SEQ ID NO: 252416 - DNA, 1880 bp, Homo sapiens
ttcagtattatcaacaaatatagactattgtaagagttttttatttaatttgaatatgcatttctgaattgactactatatcctgtattcagctcatgaatcatctcttactgtgctcatgaaaactatacttgattccaagttttaaaaatacccatcattctttttgtgaagaaggacctgtgactaacagttctcacttttgtggctgtcagcatgcctgcatcagtcaatacctgcaacactgtccattgtccaggattccaatcctggatggaatgcacataaacaagcctgttagaaatggccctaaaataaagataaataggatctctatgaagcccctcctagaaaatctacttctaagaatcctaagaaaataagtaaggcaaaaatttagctattatgctgggcgtggtggcacacacctgtaatcccaacactttgggaggctgaggcgggcagatcacctgaggtcagaagttcaagaccagcctggccaacatggtgaaaccccatctctactaaaaatacaaaaattatccgggcgtggtggcacacgcctgtaatccccacactttgggaggccgaggcgggcagatcacccaaagtcagaagttcaagaccagcctgtccaacatggtgaaatcctgtctctactaaaaatacaaaaattagccgggcatggtggcatacgcctgtagtcccagctactcaggaggctgaggcagcagaattgcttgaacctgggaggcagaggttgcagtgagccaagattgtgccattgcactccagcctgggcgacaagaacgaaactgtctaaaaaaaaaaaatagctattaggtttttcgttttaccagttgaagaaacttgggtggaatcaatataaatgccccaaaataaggaactgcttaaattatagtacatccttatattccataagaaaatacttatttagatgttaaagtgtacaactgaatattgctaggaaaaaaatatatgaacaacaaacagatttaagcaaaaagtttaataacaaagggtgttgggggtaggtatttctggctgatgggattattttttcctacatcctgcttatttgtattttctttaatatcgactacttataataagaaaaaaacaagttttctgaaatacttattcaacatgagtttatcattcacttattaattcaacaaatatttgcatttgttggattaattcagacatagtccttaccctcatgtctcttaatttacgaggaaaaaaaaaaggcatgatgaacaatcttgggaattttttactcctttctttcattcttattaattacccagtcattccattttgttgaggactctggccctttgctgacagtatctgcctcccctgcattttctgccatcacctcccacttcagtgtccatatggaaaacccattgaaaaactatgaactctgactctataaaaccacttcattcagtaatccatacccaaagctacaccctctatcttctgataaccaagaaattattctacagccttaagagtccaatatattgatctctgactacaactacttatccttgcagtttttttactccattactccctaaatacctgctttcttacctagttttgatacccattcctcatttcttcaaactacaatctcatttcttcaaactacaatctcccacatgctttgtgtcttttcctatccagcctaggttctcaggtacatcaccctcttctgctaacaacctacctccctcattaattccctctcccattacctagagcatatattttgtaccatcttacttcaactcaaacttgctacttcagctctacccttacctcttttatgactcctttatcag

SEQ ID NO: 252417 - DNA, 853 bp, Homo sapiens
  misc_feature (15)..(15): n is a, c, g, or t
cagaggatccccgantgtgaataggtaggtatttctggctgatgggattattttttcctacatcctgcttatttgtattttctttaatatcgactacttataataagaaaaaaacaagttttctgaaatacttattcaacatgagtttatcattcacttattaattcaacaaatatttgcatttgttggattaattcagacatagtccttaccctcatgtctcttaatttacgaggaaaaaaaaaaggcatgatgaacaatcttgggaattttttactcctttctttcattcttattaattacccagtcattccattttgttgaggactctggccctttgctgacagtatctgcctcccctgcattttctgccatcacctcccacttcagtgtccatatggaaaacccattgaaaaactatgaactctgactctataaaaccacttcattcagtaatccatacccaaagctacaccctctatcttctgataaccaagaaattattctacagccttaagagtccaatatattgatctctgactacaactacttatccttgcagtttttttactccattactccctaaatacctgctttcttacctagttttgatacccattcctcatttcttcaaactacaatctcatttcttcaaactacaatctcccacatgctttgtgtcttttcctatccagcctaggttctcaggtacatcaccctcttctgctaacaacctacctccctcattaattccctctcccattacctagagcatatattttgtaccatcttacttcaactcaaacttgctacttcagctctacccttacctcttttatgactcctttatcag

SEQ ID NO: 252418 - DNA, 376 bp, Homo sapiens
gcaggagtattctaaaggcaaaatttcccttgtccactcttcacggagtcaggacacattactgttcttccctggcatcagtgtgtgacagtatgaatgaagtatttccaacaaggaatgctcacctgagcttcattttcggtttttattggggctccattatatggcttgattggttgtccatgtggttgatttcagtctccaaatacatgatacctggtgacccaaagctcccactctaaatagagactcttttatcaggaatatcttagattacctacctccctgaagccaggggcaaaggacagacctctctttgggagaggtcagattctttactacacactaatcatataaactattcccttatttatta

SEQ ID NO: 252419 - DNA, 309 bp, Homo sapiens
tgcccagaagaccactctgataattaactataaaaacctctttgtgcctaacctcctcatctgtaaaacatggacaataataacagctgcctcgtgggttgttgtgagggttaaataaagtgtgtatgtaaactgtgcctggcacgtggtaagggtactttttttttccccctatttctgctttcttcagcccttaggtttataaaaccaacttcttctgcatggctcactggaatacacaattctgttttatggaatgaggtgttacctgattctaaagtcacgaataaaagtcaatcaaaatcttta

SEQ ID NO: 252420 - DNA, 151 bp, Homo sapiens
gaataaatgtatttgtatgtgataaggacattagttttggaaggccagtgccagtgccagaatgctatagtttgaatgtttgtctccctttttcatcatccttgatcaactccagctgggcctcaagtaaagcacctgtcaagtaaagcac

SEQ ID NO: 252421 - DNA, 543 bp, Homo sapiens
agtggaaaaagcactgaaccctgagacttggttctagttgtgcctttgccactagctaagtagcctcaagcaagtcatttggtcttcccaggcacagctttgtttcttgtaaaacaaaggaaagaatgtccaatccactgcctttgtatagaaaaggatataggatagagttatctggaaattttggttatggtaattgttcttataattttgtatattaataatagaggttaaacatgttcaatacagagcctgaaaaacccagaaaagcattaccatctattgataaagaaccactgttacatttaggcaccaatcactagtgatgggtgccaaaactcttgccagataaccagtttcatgaactgttagtatggcagaccatgttctcataatgccaatgctcagttttaaaaaatcagaggcaatattgacatatcagtaattgtttttataatatggggatttcatgaaacataggtatgcatttattaggaaaaagtgaatttcccaacaggtgaactgaaaagttattttaactat

SEQ ID NO: 252422 - DNA, 860 bp, Homo sapiens
gttaccattctgatgttgggatgacctttctatctcagaaggaactagacgactctgtagagatggtggcggaggcgggatctatgtctggaagggccatgtaaaaaacatggacctggcgtgtttctggtccttatcacttctgagttgtccgattttatagaagaggccttaaaagatgtaagatttggccaagaactcatcgtctgcttctgctccaaaaccacattctactaaaaaaaggtccttacactgaattgtttgaaggttttttgttgttgttgttgtaaaggatgcagacttaaaaattatttttggaagacagtttgcaagctattagtagagaatgctaagaaaaagctttttggggtggatttgtttaaacaggcccctaactgatgagagaatggctgttttcatgttccttgagaaccgtcgtcttttaataagacagcatcgattctggagtcagaagactagattgggtctcaactctgacaccgggtttgtggctttgggcaagttctttaatatctctaactctcagttctaattctgagaaatgggataagtatcatattaaaatctacttcctggtgtcaggaagagtagatgaattaatgcacatttatgtacttggcattcttctttgcgcttaagcattcagaaaatagtcttacaaaaatgattacgcctgtttgatattagtgaagagttaatgagaaaagatcaaattgtgcttgagtgttaatttttttaaagcatattctgtgaataatatttctttaaaaagcattttgctaatgttgtctatgtttagctgtttaataaaaagttatatttgtatttttaaaaggaaa

SEQ ID NO: 252423 - DNA, 167 bp, Homo sapiens
tcaatcattcattcgacaagctaatcattggctatatgctgggccctgggccaggcatgaactcagaggagaaagcacagacctgtgttcaaatcttagcctcttccttactaggctgagtgaccttgaacaaattgcttaacccccctgggagcaatagtaccagc

SEQ ID NO: 252424 - DNA, 406 bp, Homo sapiens
gctgcagcttccttcgctctggtgaggtgaaccgcagtctgaggaagacttcgctcaatcgtccctttccacacccagggtactggtttaagacctgtatttccttctgccttgaggacttcgtttaacatttgtcaggcaaggctgctgcactgcagtgagaaatagacaaatccacaagtacagttgaagacttcaattgaatacaagcaaaagacatctacatcatttttacctttcttcctatgtaatgggtattttttctttgggttcttttagaattttatccttatcagtggatttaaacaaaacaattatgctttgatgtagttttcctcatatagcttttgtttggggttcactgaccatcttggatctttgggtttataggtttcatcaaatttgg

SEQ ID NO: 252425 - DNA, 363 bp, Homo sapiens
aagcagtaactaacatggcccaggatatgacagagtgaacaagaaggccgaagaattcaaaggcttcctgatcatcatatctttagggatgcaatgatttacactgactatcgccaacacttttctaagcaccttgtgtgtattaccttctttaatccttatgacaacctccagtgaggtatatattgtgatcccatattttacagatgaggaaagtaaggcacacagaggtctttctcaaaatcattcgtgcttgtaagtggtgggaccagaattcaaactggggtggtacagtttcaaagcctagtgctctgcatgattggatgctgtattgtcccctgatgagagaagttggggctgtat

SEQ ID NO: 252426 - DNA, 345 bp, Homo sapiens
gatttataagcaattgcaatgtttaacgtaaaacgtattcttgaaattgaattaagtttaaggctgggtgcagtggctcatgcctgtaatcccagcactttgggaggccaaggtgggtggatcacctgaggtcaggagttcgagactagcctggccaacatagtgaaccctcatctctactaaaaacacaaaattagccaggtgtggtggcacatgcctgtagtcagctactcgggaggctgaaacaggagaatcacttgaacccaggaggcagaggctacagtgagccgagatcgtgccactgcactccagcctgggcgagatagagcaagatgctgtctcaaa

SEQ ID NO: 252427 - DNA, 452 bp, Homo sapiens
cgacccagagctgatgttcaaattagcagatgagggcattaaaacttattattactgtattccatatgttcaaagagctacaggaaatattaaatacaatgtatttaaataaatacactgagtagaattaatgatcagttagactttgcgtaagaaaagattaatgaacttgaaggcatagcaagagaaactatccgaaatcaaacctacagagaaaaaagactaagaacaaaaatgaacacagtgaaagtgaactgaagaaaaacgtcacacaactgaatatacatgtaattggagtccccaaaggagagaagataaggtgggggcaagggcaggaggtgggaacagaaaaaattttgaaaaaataatgggcatcaaattccaaatttgatgaaaatgataaaatcacaaatccaagatacccaaggaacccttggcacaagaaacattaa

SEQ ID NO: 252428 - DNA, 440 bp, Homo sapiens
catttgtcagccaataattttatattcagcaagattatccttcgaaaaggaaagtgaaataaagacattttcagataaacaaaaactgagataatatatcgctaatgacctgccttacaaaaaatactaaacaaaatccttcaagatgggaatgaaaattactccagttgataacttgaatccacaagaagaaatgaaaaatactgaaaatggttaacatatgggtaattataaaagacttaatgagtatacattttttcttctattatttctttaaatggtatgatatgcaaaaaaactgtactttttggtttaaaatataaatagatgtagtaatgtacgatactaacagcacaaaagtgagagtagggtagggaggaaattgagctggattggaggaaagttgctatattttactggattaaattagttttagcttg

SEQ ID NO: 252429 - DNA, 435 bp, Homo sapiens
cacccctttccttgaccaggaaagggaactccctgacaccttgtgtttcctgagtgaggcaatgcctcgccctgtttcagctggcgcaaggtgcgtggcacccactgtcctgcacccactctctggcactccctagtgagatgaatccagtacctcagatggaaatgcagaaagcacctatcttctgcgtcactcacgctgggagctgtagaccggagctgttcctattcggccatcttggctcctcccagaatttctctttgcgtcttagtatctcgatgataacaaccatgcctaactcatattgtatgctaaggattaaatgagttaatatgtgttaagaagagcaatagcttacatgtagagccataaattaaactatcatttttaacagttttcaagacttaaaattacaatttggcttttccattctta

SEQ ID NO: 252430 - DNA, 430 bp, Homo sapiens
taatgtttctcccagtgctggatgctgggaagcctcaaatcaaggtactgacagattccgttgtctgggggaaggctgcatcctcagaaggggaggggatctgtcttcacatagcagcagagcagaagagagcaagcaggagatgaacagcatgcagccttgtttgtaaggccttagttccactgatgagggcagagccctcttgaacaaatcatgtcttaaagccacacctcttaataccaacacatggacaacatcagaattttggaagagacatattcaaacaatagcattctgccccagccccccaaatttatatccttcttatatacaaaatgcattctttctatcccagtagcccccaaaagtcttaactcattccaacatcaactttacagtctgagtccaaagtctaatctaaatcagatat

SEQ ID NO: 252431 - DNA, 600 bp, Homo sapiens
tcagtgctatcagggaaatacagggttttacaggaacatgtaggagtagtacctcagcatagatttgaggactaatcagagaagacttcttggaagaggcagttaggcagaacactgatgtatgtttagagttgaaaaaattgggtggaggagtggataaaagagagatgtgtgttccagataaaggaaccatacttgtgaagacttgggcgaaaagaaaaaacaaaacagaagtaaaccgtagggcccttttgaggaactgaatgaagttcactgtagctggagcagagagcaccaggtcaggaagtgatctggtgagccatgctaagaaatttgaccatgtatttagggtaatgggaagccatcaaactattttaaatatgttagtggtttaatatgattttaaaaggtcgcttgtcaaatggagaatggagtttagtgggacatgggcaggagcagaagcaaagctccacattgacctctattctgtgacgcctcgtttctgtactgtcctttcccttgttcttaaatctgtgaagatgggcagcttgtgtattagcattctcatgggtggacatggttatgagacaaagggaaaca

SEQ ID NO: 252432 - DNA, 482 bp, Homo sapiens
catactgttatattatagaaaaggctgtaacttatagaacagataactctggcttctacaacaaattacaaatattgatttttagcctttatcctttagtgttacacagaaaaatgtaaaccgtagggcccttttgaggaactgaatgaagttcactgtagctggagcagagagcaccaggtcaggaagtgatctggtgagccatgctaagaaatttgaccatgtatttagggtaatgggaagccatcaaactattttaaatatgttagtggtttaatatgattttaaaaggtcgcttgtcaaatggagaatggagtttagtgggacatgggcaggagcagaagcaaagctccacattgacctctattctgtgacgcctcgtttctgtactgtcctttcccttgttcttaaatctgtgaagatgggcagcttgtgtattagcattctcatgggtggacatggttatgagacaaagggaaaca

SEQ ID NO: 252433 - DNA, 696 bp, Homo sapiens
aatattttgtttctgatcgtgtttcatgtttaaaacttgaaataatgatcctgttccaaagtcatatagtatagtatggtggaaaaaattttggcttttgagtcattcagatctgggtccagatattagctcttatattttcactgtgtgcccttggacactttgtctaacctctctgatggttttctcatctataaaatggaactaagaaaatccttatttaggactggagaaaatacatatgtaaagcatctaatgtctgttacagtggtaacatgcaagtttttatgtctaggctaaattgagtttgttataaactgaggactatacgtgtatctcccatttacctctgttgtcagtttacattatttcttttctagcctaaggctgtaaatattttccctaggccaaaatctgacctgctggttttaaccattaagctgaaaccaagatactcattgtcacatgaaccattttgattaataacattcctttgtcctttcttttgaccctagacatcttcctgctttgtatgaaaataattgcataatttgttatgttaaagcaatataggaagcagtcgccccagactttaattttagcctcactagtaaggaaaggctcaaaatcatttccctgactgctttataaccaaggaaaattataatgccaaacaaatagagttggagaatatgt

SEQ ID NO: 252434 - DNA, 329 bp, Homo sapiens
ttagagcaagtggatcaattcctcaaaaatcgcaagctgccagagctgctggctgaaaaatcacaagaaatgttacacaagttagacaatgtgaccttcacccattatcttcatgctcctggaatctgtgatgcaaagaaccatctacagccagtcaatagcttatgttattttaatgaaccagtgtgggaacttgccccttctttctttctttcaaacccactgtaactgctgctaactggagcatatgttcagagccacctgaatctacgtcccccaggatgccgtcctcaaacgtggcccaaataaaccctccacgtgtactaaaa

SEQ ID NO: 252435 - DNA, 403 bp, Homo sapiens
aaaagatattcttattgctctagttacttaggaaataattacagggggtcagagtcagggatcctggataaaacgccaaatccatgatcctagttccagccacagatcaggaggaaatgaggctggctgaaaaatcacaagaaatgttacacaagttagacaatgtgaccttcacccattatcttcatgctcctggaatctgtgatgcaaagaaccatctacagccagtcaatagcttatgttattttaatgaaccagtgtgggaacttgccccttctttctttctttcaaacccactgtaactgctgctaactggagcatatgttcagagccacctgaatctacgtcccccaggatgccgtcctcaaacgtggcccaaataaaccctccacgtgtactaaaa

SEQ ID NO: 252436 - DNA, 386 bp, Homo sapiens
tgaagctgggagtgaagtttctcagaatgcccttctcagtacgaatccagttgagtctagagacaaggaggaagacgccattgctcccacatgtcaagggcctggctggctgaaaaatcacaagaaatgttacacaagttagacaatgtgaccttcacccattatcttcatgctcctggaatctgtgatgcaaagaaccatctacagccagtcaatagcttatgttattttaatgaaccagtgtgggaacttgccccttctttctttctttcaaacccactgtaactgctgctaactggagcatatgttcagagccacctgaatctacgtcccccaggatgccgtcctcaaacgtggcccaaataaaccctccacgtgtactaaaa

SEQ ID NO: 252437 - DNA, 426 bp, Homo sapiens
gtttacttgtctgttgtccagatagctttatattctttaagattcagctcggattcttatcctatttttgccattaactttcattatgattttggcaaagccattttgtttgcttacatttttcacttttaatgtggtgtctggcctccccctctgaccgagacaagcatggctgcagagtgcagacggggaggtggccccgggcagcagccatgaacgtggcctccccactgacgctgagccatggctcccttttttcagtaaaatataagcagtaatagagccgatctccttgagtttttgtgagaattaaagaatacattttaaagaattgaggagaatttttgggacagtgtgagcattcagtaaattttagttgtagtggccatcacaacgtggcttttaagctctcttacaaaaaaagaa

SEQ ID NO: 252438 - DNA, 466 bp, Homo sapiens
tactgtgatgtccatcatttcccaagccctttgctaaatattcctgtccttctctataagcctggggttgaatactattatcagccccattttacaagtgaggaaactgagggctacagatgttaaatgtcgtgcccaaaaccacacagctgtgagtggatagtaaagccaggattcacaccctggcctgcccgactccttcctgtgactggaatcccaactctcctggaggtcacggcctattgctccagtgcctgcatttggcctacacatatattttgtttggcctgcaagataaggggtgttttttgatttgaggtatggtttagtaaggtttggtaatttggctgcttttaaaaacactgggtccgagttgctatgtagtgactgtcagctggagccaggtagctgctgtcctctgtggactgcttggaggttcccactctgcctggcttcactcattact

SEQ ID NO: 252439 - DNA, 377 bp, Homo sapiens
ggccagggaggctattgttcacaaccccacatcctttagctctttatgtttatttgtttatgtttctgtacactgcttcatttgaaaggaaggattggatagccactatccaatccttaaatgattgtctaatgccagaattaattggagtatgaaaaaatctctctgggtgcgggttgatatgctcaaagttcatttatattatctgttgtgatgcagaagctgcgctttcactgaggaagcctgtaacagcttttggctctgggaagcttgcaatctactgaaatttctagatcttttattgcataaacagctaccaagcctgaatatttatgtgtttccaattaaaatatagtaatataaaaatgtgaaaaata

SEQ ID NO: 252440 - DNA, 528 bp, Homo sapiens
  misc_feature (29)..(29): n is a, c, g, or t
ctactgaacagaatatatccttagtacanaactgatggtgatttgcatgttgattacattttctaggttaagatcaccagtcatttctttaaggccattgatttcagatactctcatgcattgccctgtgttagcctctctgttgtttcgctcagaaaacattgattatgatctgccgtgcatatggaggacacagtgagggacaagagttggccctggtgcctgaggcactctaggcagccctccattcctgaacactgtgagccccataatggtgtggaccagcccctggaaactgtaagccatgtagcagtgctgttttttaaaagatgttttgcttttctgcttcactgaacatgaaaaacattagcagacaaacaaagaggtctgtcaaagcaagagtgtatgtttggaatagagcaaaatgggaagagcagggcttgaggaatgaatattttaaatatgaaaaaggaagagaaaaacagccaaaacaccaaaaaggttggagaataaaggtaaactattaag

SEQ ID NO: 252441 - DNA, 390 bp, Homo sapiens
taatagggcacgatgaagaaataaaaggtataaagattggtaggaaagaaagaaaactatcattattcacagatgataagttgcagacatagaaaatcctaaataataaattcttaaaattagcaagtgaattaaacaacatggtctcatatagagacaatatataaaaatcaattgcatttctagtaacaagtaattggaaaattgtttaaaatgtaaatactattcacagtttccataataaacatcaaatactcaggtataaagctatcaaaaatgttactaaaaatgacaaattggtaagagaaattaaggatcttaacaaatgtcgacatataccatatgtactatagattgaatattgatgtcaattctcccaaaatgaacaca

SEQ ID NO: 252442 - DNA, 522 bp, Homo sapiens
ctccatagtttttgttgaagatagagccaattcctttgcaaagtctatcagtcagggttcctcattaaaacagagcagtaaggtacctttttttttcaaggaattggcataaatgattttggaattttaagagttggcaatctgaaatctgtagagcaggccagcaggctggaaactcttgggtgggaactgatattccagtcctgaggcagaatatcttcaaagaaacttattgcagatattaatcacgtctaaaaaataacataagagcaacacatagattaggttttgatttaataactaggtacaatggcatatgtcaaaaaacacagttttatacaactcttctatagcatactgggaatatactaactcttccccagagtggaggtccttgggtgatgttcactcttattcttgatattctgtaacataaatactgtgaagtaatatattagattttaaggagataaagtgagaagaatacgatagtattctacacacacaaattcataacaaaat

SEQ ID NO: 252443 - DNA, 513 bp, Homo sapiens
aaggcatttgggagcctgctcctccctctgtacctccaccagccgtccctgggatgctccaggaagtgctgcgcttgacacacgcccccatccgccacctcccagagaagggaccattgtgtccgaagggttaacgagggatgtgaggaaggggccctttagccatgatgccctctgacctttcataaatcagaggggcttaggggcgagggggctgcttggcaggacttggtggggtgggggcttagaagcagctgcgcgcgacgttgacattgttcccaccattctaagtgcaacaaatccctctattgtgttcctggtttatctggttcctcttgtttatgagcagggctcctttggcagcggttccagccctgggcgggtggaaagagtgctggcacgcaccgcggggggagggggcgggagggggccgccgtcaatgcccgcattgtccccgcgctttttgtttctactgtaatgacatgttggaatagagagagagagagaaggaaa

SEQ ID NO: 252444 - DNA, 156 bp, Homo sapiens
catcaaacaggccaaaaaaaaaaataaacagcaacttcatagacaaaaaaggaaaaaaaagaaaccttttatctttggcctttttaaccatctcatacaaaccaactacttatagtacagctaagtacatacacaaaaaagttactggaatgctcg

SEQ ID NO: 252445 - DNA, 409 bp, Homo sapiens
agtcagcaggaaggtgaaactccccaccccgggcagactccttcaaacagaaggtctctcttagcccacaggggaccacaggatctaacctagcaaaggagatttcgatataaaatttcctttcctgttggtctgtcctcaaagatttcacaaagattcacataaatgcttagggaatctatgaacaaaatctcaggattgtgtaggcaaagacctacatctctaagagtgaatggtgtaaatgaagacccatatgaggaatcgaagcaaattactttcttcaaagtagcctcagtgcaactaactcacacagagaaaactttttgaagaactttatattctcaaagatgtttaagaaaatgttacttcatttcaaaaaaaataaagcacaggccatcataaaatagaa

SEQ ID NO: 252446 - DNA, 779 bp, Homo sapiens
gagactacatcaacagttcttcgcttagcgctgttagaacttggcatttccagcctcacggggcccacacacattttgtcttgtattgtgctccaagcacacatcttatcttgctcgaggagaaagggaaaccaggaaagtaatgattggcacatgggatgaggagctggaatgactggggttccaccatttaccagctatgcaactaagcaagtgacttattctttctcagcctcagtttcttatccgtaagatgggaaactacaattaacctcatatatttgttgtgaaaatctggagatgactatacaaagcacctggtacataacatggatgtattttattattgatttattatttaatttctctttgtatctgccagagaatattgcagaaaggatacattattcacctcataaatgtttgggataaaagtgaattgtggttttgcacccatttttaagataaagattgctatgaaactggtgtttcccatacattcctgagcataagaatctcctggaaaatttgctttggtgggtctggagtaggatattttaacaggcaccttagggcattctgacatctgacattgggaaaactgctgtaaactcaaatgatgcttacacccctcaatgattatgtgagagtgtctgttttgtgaaaaggatggacttatacaggtctcttaataacggacacactgctgcccaattgatttgggcaaagcaatcaccgtaaagtgtgagcatggtggagaagccacatcgccatttagg

SEQ ID NO: 252447 - DNA, 766 bp, Homo sapiens
cgccctttgtgctgaggtcctgggccggtgtgtgtgtgtgcgtgcgtgcgtgtgtgttgtagtgtgtgtttcttttgttattttctcccctaacaccgcagaaatgaaacacacatgcagctctgtcgcctcatattttcagatgtttttcacactattgtctgctccagcccgttgaaagtgcaaagtgaaaacagatgcatccaaaaaattttttttgaaagggacaatcctaggatggagactaacccctcgaatacagataagcaataaatattatatcagatttataacgtgcatcgagcagtcttgattagcaccaaggtgagctttggtgagatttttatcatttccatgtgtctggactacaagaagaaatcactgggggaagagctctataaatcagcgtccatgtcaagacaaatcaaaataatgcctctattatttcaatcaataaaccatttttattcccaacatctgatacacacagtgtgtgtccgtctgtttgtatttggaattggcagccttgccttataccaaaacaaacctttcaagacgtgtcaatgaaattaaaatttttaaaaggagaattcaatgtgaccctccttccctttcgagctactccattctcccctttttaagccgcacaccccaagtcagtaggagagctttgcaactctgcaaaggatgaaattgctttgagaatttcagagaaaaggggtggcgggtgctattagggaagagaaaccgaaagcggcgacaggca

SEQ ID NO: 252448 - DNA, 370 bp, Homo sapiens
ttttttgagacggagtctctctctgttgcccaggctggagtgaaatggtgcggtctcagctcacggcaacctccacctcctgggttcaagtgattctccttcctcagcctcctgagtagctgggattacaggcgcacaccaccacatccggctaatttttgtatttttgtagtagagacggggtttcaccatgttggccaggctggtctcgaactcctgacctcgtaatctgcccgcctcagcctcccaaagtgctgggattacaggcatcagccaccgcacctgactcatgtttctctttcttgtgagctttcatccctgcacacatgctattccctctgcctggaatgtcctgccttcttgatgtctg

SEQ ID NO: 252449 - DNA, 418 bp, Homo sapiens
tttttttttttagacagagtctcgctctgtcacccaggctggagtgcagtggcgtgatctcggctcagtgcagccttgacctcccaggctcaagcaatcctcctgcctgagcctcccaaagtgatgagattacagacatgaaccaccacagacggctgatgttctcttttggtcaaagcagttttcacgttatcctactgcattttctctaacacaaataaaacaacaaacaaacatataaaaatcctcatcagctcttcacataacttttgtgttttctgagggtgaaggcattccagagaaccttgtccctccatccactgcttatgacactaatttgcaagggttagttaacaccaagtaatgtgtattgaaaacagtaaactgacctgccagctgataaagtgaagaacattat

SEQ ID NO: 252450 - DNA, 364 bp, Homo sapiens
taatattgactggtctcttagaggtaattttacatttctcagaagctcttaagcaagacaatgatatgtgactcacttcccacaagatttaagaaggccacagccctggtaagaagtgaaaaaaaaaaaaaatgagtggtcgccttaacatgtaaaaagtgtgtaattattggttaggatagtttcagaaagtttagtggttacaggcagcaacctttgagtacataaaatcagaatttatgaagtggctgctgctatgactctaataaaacaaggaagcaatttaatagttttaagaaaatggaaaagagcacaggaaggaagaaaagataggcttgagtaaattactctgcccctgaagata

SEQ ID NO: 252451 - DNA, 1696 bp, Homo sapiens
ggcacgagcacggcagccctacactcggcctggaagaattgtttttcttctctggaaaggtgaacatttatagcatttatttcccaaatctgttaacatggcaaaatatgtcagtctcactgaagctaacgaagaactcaaggtcttaatggacgagaaccagaccagccgccccgtggccgttcacacctccaccgtgaacccgctcgggaagcagctcttgccgaaaacctttggacagtccagtgtcaacattgaccagcaagtggtaattgggtatgcctcagagaccagcagcatcaaacatccctgtggtaggaagcccaaacccacccagcactcactttgcctctcagaaccagcattcctactcctcacctccttggggcggggcagcacaacagggaaggagagaagaatggcatgggcctgtgccgtctttccatgaaggtctgggagacggtgcagaggaaagggaccacttcctgcccaggcaagtggtgggcgagctggtcgccaagttcagagctgccagcaaccacgcctcaccaaacgagtcagcttatgacgtgaaaaacataaaacggcgcacctacgatgccttaaacgtgctgatggccatgaatatcatctccagggagaaaaagaagatcaagtggattggtctgaccaccaactcggctcagaactgtcagaacttacgggtggaaagacagaagagacttgaaagaataaagcagaaacagtctgaacttcaacaacttattctacagcaaattgctttcaagaacctggtgctgagaaaccagtatgtggaggagcaggtcagccagcggccgctgcccaactcagtcatccacgtgcccttcaatcatcatcaccagtagcaagaagaccgtcatcaactgcagcatctccgacgacaaatcagaatatctgtttaagtttaacagctcctttgaaatccacgatgacacagaagtgctgatgtggatgggcatgacttttgggctagagtccgggagctgctctgccgaagaccttaaaatggccagaaatttggtcccaaaggctctggagccgtacgtgacagaaatggctcagggaacttttggaggtgtgttcacgacggcaggttccaggtctaatggcacgtggctttctgccagtgacctgaccaacattgcgattgggatgctggccacaagctccggtggatctcagtacagtggctccagggtggagaccccagcagttcgaggaggaagaggaggaggacaacaacgatgacgacctcagtgagaatgacgaggatgactgacgtcctctcgccttaagattcagcttcaggaaaacatttagggaaaagaaacttttttttttttttttaatgtgaggttttctgtttcttttttgcctactccccaagaagatattggtaagctatagaatttagatatgcacctctgataagcaaggattgtttcccgtatgattaagacgtgctgttgatgtgtgttttgataccagtgtgctgacacagaatctttatttactttttaggattttgtgttttcattttctatttttctttaaatgcagagttcattgttgccccttaacagtttttcctgagtttactgaagaaattgtacttcatccacatccatgaaaataaaatgctctccttttgtgc

SEQ ID NO: 252452 - DNA, 847 bp, Homo sapiens
actccagcctgggcgatagagcaagaagactctgtttcagaaaacaaaacaaaagaaaaaagaaaactaaagatcactatctctcattagtatagatgcaaaatcctacacagtattttagcaaattaattcaagcaatatatttaaaaggataatgcttcataatgaagtagatttcatcccagaaatatgagatttgtttcaatatttaaaaatccataaatgtaacagtttctcaaattttgcttgtttcgatgacctaggcagttttgagaattaccagttgggtattttttagaatgttctttaattggaatacatatgaaaatttttaaataattagtctggaattatgggaataggaagaagaacacagaggtaaagtgcctttttttaatcacatcatttcaagtggacatgacataaacgtcactatcactgttgatgttgacctgggtcacttggccaaggtagcaattgtcaggtttctttactgtacagttattctttttccctcttttcatattgtactcttttgaaagaaatgagtatgttcatgtccgacttaaagagcatagagttatgctcttcctcattgaggaagtagtatctacataaattctttcaaatttttctgcacaaaaatttgactcttcttcctcatttaattatttttttattttacttatgctttaagttctgggatacatgtgtagaacgtgcaggtttgttacatagctatacatgtgccatggtggtttgctgcacccatcaacccataatctacattaggtatttctcctaatgctatcccttccctagcccccgaccctctgacaggccctgg

SEQ ID NO: 252453 - DNA, 892 bp, Homo sapiens
ccattccaacactatgtgggtttttagagggaggcagagcagttgtctaaaggaagacaagcagcagcgatgtcacgcaggtaaaagagcagatgaatgtccactccaagcattaccacctttgtgcgataatacagttagcacaggcggtcattgctggagtgggatggtgggtctaggtagtaatgatcagaccttacaaggttttagaccttgagcaaggtttttaacccttctgagcttatctcctctacaaagtaattaaaacactaactacttcactgtgctatttgacaatccatggtaggaaaaatggaagagcattttgttaccctgagtaatatagcacaacagtggcagtagtagacagcaactagccttagaaccagaaaactgggaatctcctggtgtttctgagggttctgtgggagctccttgtatactatgccaagcaggtgtcagagctgtcctccctgagctgaatttgctgttatagtcctcatgcccagaatagagcctagtacaagataggtgttcgataattttttgttgaacgaatgaatagtcagctgtgtgtagagtgaatgatgtatccttgtccagatcatcttcaaatatacatgcagattcctaagtggtgacctcatggtggcagaggctgtgggagaggaggaaggcttgagcaagccccagatgtacacagggatatcaccgcccacggtatgtctgtgatggaagcaggtggtgtgacattgatgtctgaagttcccaaggttgcccatcaggtactggtggtgtggagctggctgccaggagccatgtggagcacccacgctgtctaagagtagaaagtcattccctttctacacatagaatttgaatgtcaacttga

SEQ ID NO: 252454 - DNA, 309 bp, Homo sapiens
gcgtgcaggtcagcgtgatctccgcaggtagaagcccaggcccagcacctcaggttggcctcatggtggcagaggctgtgggagaggaggaaggcttgagcaagccccagatgtacacagggatatcaccgcccacggtatgtctgtgatggaagcaggtggtgtgacattgatgtctgaagttcccaaggttgcccatcaggtactggtggtgtggagctggctgccaggagccatgtggagcacccacgctgtctaagagtagaaagtcattccctttctacacatagaatttgaatgtcaacttga

SEQ ID NO: 252455 - DNA, 768 bp, Homo sapiens
attacatttataaggtttctctccagtatgaattctctgatgttcagtaagggaagagttcaccctgaaggccttcccacattcattacattcaaagggtttctctccagtgtgaattctctgatgctgaaggaaacttgtactctgattaaaggcttttccacattcattgcatttatagggtttctctccactgtggatattctggtgtttggtaaggtgtgccctgcacacaaaggctttttcacaaatgttacatttaaaaggtttctctccagtatgtattctatgatgatgggcaaggtgtatatttcggataaaagcttttccacataagttgcattcaaaaggcttctctccagtatgaattttctgatggtacgtaagtgaggagctcactgagaaggccttgccacattccttacattcatagggtttctcgccagtgtgaattctttggtgatggataaggtgcgtactctggtgaaaggctttcccacattctctacattcatatcttttctccttaatatgaattttctgatttgcatttttttcattatgaattttctgatgtttattaagagttgaactcttagagaagacttttccacactcactacactcaaaggcatttttgctaggttgaaatccctgactttgatcactgtgaagagatgagctcatagtgctcccggattcatcacattcctgtgatggggtgttggggtgagtgagtaccactcgctgcaaactgatctcctggcc

SEQ ID NO: 252456 - DNA, 428 bp, Homo sapiens
tttctgcccagttacaaaaactatagtagaatgctgcttttcttgaaactgggccataggtcattgcaagcttctaagcaacaattctattataacttttttttttttttagctatggcattcttctggcatctaactttcctttgacaagttcttttcaagttttttatgcttcttttcttacccttatccccatagcaaaatctccttgtaaaaaattcactttttaaatcagtctgccctcttaacatctcccagttcttccattttagccattttaccatttctcctccgaaatgcccccttaagttcccaaccttcactttagctttttgggtctagtaatatcctctaatatacgacagtcattgagctacagaagtttcacaacagcttaagcttgtggatttaatgatagcagtagtaag

SEQ ID NO: 252457 - DNA, 492 bp, Homo sapiens
gaaaattttatccaggaaaattacagctagtaaatgtgaaaggaatggtaagatgagagaaatccaattttgatacttctactgaaatagtttattctaacaatgagttatctttggatattaacactattaatgaaaagtggatggctttacaaaaaagttgtcaccaccacattttgtgcctcctgaagtgataaaatacaaagtatatggcaccacctagggagtggtctttctaaaaaactgatggaggccaatgtgggaggattgcttgaggccaggagtttaagaccagcctaggcaacacaatgagaccttgactctaaaaaaaaaatttaaaaatgagccaggcatggtggcacacacctgtagttccagttacttgggaggctgaggtgggaggaccacttgagcccaggaggttcaaggctacagtgagccatgattgtgccactgcactccagcctgggcaacagagcaagaccctgtctc

SEQ ID NO: 252458 - DNA, 542 bp, Homo sapiens
ccaccacgcttgatgacaccaccgcaactggtctgtctcatatcacgaacagagaagcgaccaaaggtggatagtttgaaagctctcacacctcactaagcatccatgaaaaattgatgtcagtggccaaacgtggtgactcacacctgtaattccagcattttgggaggttgaggctggtggtttgcttgaacccaggctggtctggaactcctgggctcaagtgatcccaccactcaggctccagaagggctgagattacaggcatgagctactgctcccaaactagctgcctaattttttagtttttttgagacagagtctagtcctgtcgcccaggctggagtgaaatggcgtgatctgggttcactgcaacttctgcctccaagattcaagtgattctcatgccttagcctcccgaattgtgagaattacaggcatgcagcaccacacccagctaatttttgtatttttagtagagacagggttttgccatgttgaccaggctggtctctaactcctggcctcaagtgatcctccca

SEQ ID NO: 252459 - DNA, 460 bp, Homo sapiens
ccacctactgttcccgagtccagcctctctcctgactcagcccgcaggcgctctggcctgcttctgaactgtgtgtagatggagccatacagtgggtgccgttttgcgtctggtttcttttgctgcatattatgtttgtgaggtttgtcagtactctcacaggcagtcaagggctgttcgtacccattgctggtggcttgccattgtgtggctctgttaaaatgtattcacccatgttactgctaatggacatttggggaggttccagttcctggctatggtgaatagtgccactatgaacattctagttcctgtgtattgtgaacatatgaatgcatttctgttgggtgaatacccagggcagggatgacggggcccggctgtgtgtctgctcagctttggaagatacaggaatgttactttttaatcatttcagtaagaatgatttttcaaggtaagt

SEQ ID NO: 252460 - DNA, 333 bp, Homo sapiens
catatttgaacagtcaaaacctggcaaaactgctgtttagtgtcatattttaaaaacatatttccattatcaattattttggtattgaatgcattttgactgaaacaatagggatcaactttcgtgactgatttcaaacccattatttgtgattatactgtactcctatactgtaggagtacagtatgtaaccaaatgtaattggtagtagaatttgaccagttcctagttaggtagttaatatgttctgtttaaggaatttacatttagttatatagtagtttcttatcagatgtagattagtgggaaagttgttttgaagtaattaaacat

SEQ ID NO: 252461 - DNA, 235 bp, Homo sapiens
ctccagtgacttctcaatcccagccatggggattgggcccttctaagttttttcttcttgggtactcaccttcagccctagagcattctttagcactcacagtttctcttctcgtcgggttattctttatattaatcttttcctgtccaaattactctctatgtctcctgatcagtccttgactggaagcatcaagccttggattccagaagccttatgaacccccaggcaggat

SEQ ID NO: 252462 - DNA, 294 bp, Homo sapiens
tagagttggagagaattccctgttaaatccatcaagtgaacccagctcctttttgggaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagagatgcggcaagcccgtattaaacaaatcactaataaaaactggaataattcaa

SEQ ID NO: 252463 - DNA, 298 bp, Homo sapiens
  misc_feature (248)..(248): n is a, c, g, or t
  misc_feature (261)..(261): n is a, c, g, or t
  misc_feature (269)..(269): n is a, c, g, or t
tagagttggagagaattccctgttaaatccatcaagtgaacccagctcctttttgggaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagaaaacctngatcggccgaaanccccaacncaaacccactaaccatatataactagaac

SEQ ID NO: 252464 - DNA, 297 bp, Homo sapiens
tagagttggagagaattccctgttaaatccatcaagtgaacccagctcctttttgggaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagaatgagatgcggccggaccgcacaagccgactaacacgacccgctaaacgaaaaatt

SEQ ID NO: 252465 - DNA, 296 bp, Homo sapiens
tagagttggagagaattccctgttaaatccatcaagtgaacccagctcctttttgggaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagagagggatgcggccgaacacccacttgttatcaccaccacagcgggaaacacaaca

SEQ ID NO: 252466 - DNA, 585 bp, Homo sapiens
gctgcattgtgtccagggtttgcagatcagcacaccctgtggaaaaaacagggtagtttaaaatattactttagtcaactttgtagaaaatagacatttgtcagcagatgtgctgggtttacaaatgctgctttgaaagaatgacgcagccttaaaaaggacgctgctaacttctgcagagcagcatgcgtacgcggagagttggcattaatgagccggcactcacagctccaaagtggcaaatcagcaatgtctgtaacatttcaatgtgctcctaatttcttttcagaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagagaaattaccatgcatatggctttggtaaatattgtgaaatgtttagttatgtatgtattcgaaatgtaaaatgtatttctcactgtgagctactgttaaaaaaatgtttgag

SEQ ID NO: 252467 - DNA, 264 bp, Homo sapiens
tagagttggagagaattccctgttaaatccatcaagtgaacccagctcctttttgggagctgctccattaagctggcagctgcagaacctgatgtaagcctgcatgtgggacagctcagcggccaggatgtccccaatcatctgcaccggcatcttctcgcccccggtcttcttccgcacccgcaaagccctgccaagaacacactctcattttgtgtttctaagtgaatgacttaggtaaataaatgacgaatcccatggcag

SEQ ID NO: 252468 - DNA, 543 bp, Homo sapiens
tagagttggagagaattccctgttaaatccatcaagtgaacccagctcctttttggggcagagacagcatttggaggatgtgagagcttccgtcactatttgtgaattcacacatcaaaagtgatgccttgctttgactctgcgtggaggcagccctgagtctgatgcccaccatctctcatgagagacagcagataccccgagagctagccagcagcagcctcctcacctcgacgacgagctgaagaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagagaaattaccatgcatatggctttggtaaatattgtgaaatgtttagttatgtatgtattcgaaatgtaaaatgtatttctcactgtgagctactgttaaaaaaatgtttgag

SEQ ID NO: 252469 - DNA, 694 bp, Homo sapiens
taagactgtttgacatgtaattgatacttagtatttgaatacatgaaatcaatgaataaagtgggctttatcttgcatgcagaagagagacaccatcagaaacatatctgtggaaaatgatttggtgtaaagagggagatctgtaagaaaagaagactgcttggcttaataggaactttaacaaatgtgtgctgaatggataatagttagcatttattcagtacctactttgtgccagaggtgacccactgattggcggattaaattcggtaacttggtaccgaacatggaaggtatctgctggctaattctctattattaataggatcagaatctttagatacttaaatgctgcaattcagctttctggtaattctcaggtctcctattaaactttgggattatgctttctctcttaaggatcagagggaattgtgggtataaagtggggcgtgaaacctaattggggaggaacaatcttaggggtgaaaaaaggactttattattttgaacattacttgaccagagtcgggttaggacatgacgacatgctcacctgggacaagggactttataaaaaaaaaatctgggggccggcacattcccttggggttaaaaatgtgccgttaaaacgatgggaaaccggccacaaatatgtgaacccttttgccgggaaataaaggcccacgcttct

SEQ ID NO: 252470 - DNA, 1189 bp, Homo sapiens
aaagcttgcaaagactgcttttaacggaaagttttcatgggcaggattgagaccaagaggaaagaaacttcaagttaatggactaccttgaaattttaggcaaaacctgtacctgtgtcatgggagagactgggattatggccacacttgatctgaagttgaggtcaaacttggtgatgttgccttgaaaatagagattttcatagaccaggacgaagatagaagggaaagttacaagggacttcagcttaaatttagtctctcttatcttggcacagagggatgtatctgttaatctgaggtggatcaagttcaggcttgagagagggagtaatgcatgagactttgaaagtagtttgattgtgagtaagcaagagatggtgaaagagatgccttagatcatgggcatacttagatcttacaattttgatgatgaattcacgctagcctgagaactgaagtggaaggctacccctggttgatgatgggtagcagggatgtagaaaagtgctaaagtctttaagatcttgccctttaaaagaatcatcaggtggggcagatgattaaagatcattacttagggtttaatgcgttcagtgtgtttagatttgcgtggcagttatacccataaactcatcaagaaccagtggattttctgtatgtcatgttctgtggtttttggttagtagcattgatgaacatactctacactcaataataaacatgaagactttgctgagaggttttttcatttcagctcatagatttgcaacttatgtaaagaattgttaggcagtttaaactagaaaatttggctcagccaaatctgaggtaagattaaaataaggcatgctatcagtttgagggactgagttacttaaaaccatgaatagatagaaattcattctaatgattacacaggtgtgtgttttttattttagattatattaaaaagtccagttgttaaaatgctgggaaatatttcaactgtggccctagccctgttagctttaccaaaaaaacaagtttttttttttttttttttttttaataggagacagggtctcactctgtctctcaggctagagtgcagtggtgccatctcggctcactgcagcctctgcctcacaggttcaagcgagtctcatgcctcagcctaccgagtaattgggattacaggcacccgcca

SEQ ID NO: 252471 - DNA, 468 bp, Homo sapiens
ttgtcatgtgactggtgtggcatgctcacagcagcatggacagttgtcttgtagctaagctaggcaagctaggctcatggcatagtggacagctgtcatgtggttggtgtggcaggctcatggcagagtggacaatcatcatgtagcttgtgtttcaggatagacagctatgatagtcactccttcttctctcccgtgccctttccctctctctctgataacaacacccccatccggcttcccaggaaccagctaccctctacccagatgaccatgactaaggcccagactacctagaattccgaggggcagattgatatgggctggagtggtcagagaaagcttcgagcagacccaggaaattgagctataccttgaaaggcagacaggattgaggcagtcctgtctcacctgaggagaaggcatttcagatggtggggtcagctagaggtataattaaatgtgggc

SEQ ID NO: 252472 - DNA, 327 bp, Homo sapiens
agggcttctgctagtatgttcagggagacagatgggccgactgaaggcagacaggttggtgagtgcgttcacgggacatgctggtttccagtagtgaaagattctttctgctcctgggactcaagaacctgctcgtagttgttaactccagggtcctggggaggccacccatgccccacagggaagaaaacttcttcactcacttactgatccttgaaatgtcttttaaccagagacaagtcttgtatttcacagtcagagggagtatgcaagacccccagaagagggcgcacggccacaattccacgctggtggaaggactggaat

SEQ ID NO: 252473 - DNA, 622 bp, Homo sapiens
tcggtcccaaacgctctcacaatgaaaactaattacacactttgacatcaccatagtcaactatactcttgggaagacaacatgacagaggtggtgtgtgttgagggggtgggtatatgtatacacgatattccataagaatatgtacacctaaggtcagacatacctattggtttaccttcatcctctgttctctgaaggaaaaaaaatgtagaaaggactattaatttagttaattaaaatgaaaaaatgcagttctttgttaggaagggtctccctattttagcgttcttcctttgtaatatgaactgagagaaccagcaatatctgtgagcagcgttgaatatctcgttattttgaatattattttggcatggtcttgttatcaatacatatattaacatatctgactattatcattacgtcttttgcaaattattttttttttacttagctctagatttttcattgacatctggttatttgagagctaatcacttcatttattatgtaaatctctctattgctatttttctcttttgatggcttttagccattttattgtctctgggcctgtagacctatggaagatttgagaaagaaaaggaaactaaaaaaaaaa

SEQ ID NO: 252474 - DNA, 363 bp, Homo sapiens
cttcgggacagaaaatagcacatgcagtccagggacctggcttcctttgtaatacgctgcttgtcttgcattgaccacagcactgtgtgctgtggcaggagcactaggctggcttagaatttaaatattcactagcctgccagcctcgctttcctcccctgggctcctgggtcaggaggaagataattgctttcctgtgagcttttttgacaggacacaccctgtttgcaaatatctgtggggttagcgctcaggagtgtgaagagaggcgatcatgtgcctgctgggagctggtgcctgtgattgttgcatggtgtgtgtgtataatcccaggggaatgtccagaaaaccagtgtatgcttt

SEQ ID NO: 252475 - DNA, 242 bp, Homo sapiens
caggcatttgtgtattagccaagagttgctaatgcatttcttgatcataagtctcagagaaatgggatgaaagatcttagatttttatacactctgcttcaatgatttctcagcttttctgatctgaaaagaataaaggacaccttttagctaagcactttctgttttatttcttataatgccatgtagtggctgttactgccaacacagcagtcatttaataaaccctgaatgtctgtagc

SEQ ID NO: 252476 - DNA, 643 bp, Homo sapiens
ctgacatgcatgaaggggagatctgcccactcttacaaagacaggatgtaattcatcctattcatggtactgagtttggaaagatcttcatttaaactatggaaaatacataaaattgcaagggaaatccaaatggcactggaatcccccagcatggtgacaagcgtggcctcctatttgaggctgcccacaaagagtttggtaacaaaagatgcactggagttgatggtaggaagttgattaacactgtagacttaatgtctgtggctatttaaaatgcagagcctattgttaggtcagtggaaaccagactaaacctgttgtctctcaggtgagaagtgcataagcaatgttatttcatgaacttctattcttacagtatgtggaaaagaactgtaaatactttaaaggaaatcaacaaattcaaacaaacaaaaatcaagatttcttcaaatcagtctcagaatttctttggaagagaaattttatatgataaaaaagaatttgataaatccttgccttgcggacatagccacacatgaagaagttataatattcctgaaagacacccttgtaaaatggatataaagactggatttcattgtttacttactgttatggactgaatatttgtgttctctca

SEQ ID NO: 252477 - DNA, 448 bp, Homo sapiens
acttctcaacagcaatcatggaagccagatagcagtggaataacatcttaaaagtgcagagcaaaaataattatcagcctagaattgtgtacatagccaaactacctttcaaggttaggattgtattagttttctattgctgcataacaaacgatcacagacccagcagcttaaagcaacacatgtttattatgtaatggtttctttaggtcagaggtctggcacagcttagctgaattttctgcttcagcatcataccgaactacagtctaggtgctggctaaggttgtggtctgataagagaattgactggggaaagatctgcctccagactccctcaggttgctggcagtattcatctccttgtggtagaagaactgaggttcccatcttcttgctggcttctggccaggggcagctgtcagctgctagaggcttcccacaattc

SEQ ID NO: 252478 - DNA, 523 bp, Homo sapiens
aatcgaatacctgtcacttaggaagtaatcttataaaatctgagaaaaaaaaatccaacctgaatctgcaagcttcttgatctaccgctttttgagaattataagacagagttacatattaaaacacaccatggagatacaaaaacaaaatttagtgaggggactttagggcaggggttagcacacaatgcgtgggacacatctggcccattgcctgtttttgtatggcttttgagccaagaatagtttttacattattaaatggttgaaaaaattcagaatattttgtgaattatgaaaattgcagcgttcataaaaaggttttgttggaacacagccatgcttatttgtttatgtattgtttgtggctgctttcgtgctacaagggcagagttgagtaggtgcaggagtctgtacaatcaaaatgccaaaatatttactcactggcccttaacaacaaaaaaaattgtcaatccctaatctagaggactaatggcctggtttctttaacaaaaaaattcca

SEQ ID NO: 252479 - DNA, 866 bp, Homo sapiens
attcatgttgtattaccacaattacccactttctttataaagcggtagtaagtctttcagccaaaagaataagtccatgatgggattaagtgaaagtccaagaggtactgcatgcacctaaggtggagatgtgtttatcttttgcataagctggggatgtatttggaaggtttctgctagcccagaatttgggtggacaggctgagcccctcccaacagcaggattcacctatggggttggttttgggtagacaggctgagcctgccccatggaactgtaggggcttacgaaggcatttcgtttggggaaggagctcatccaggaggactgggatctctggttatatgtgacttctgacctctgggcatggaggtctctctccagaggcccaggcctggacacgaagggagagaggcctccattgtcccacaggggccgaaatgcagacggtgcatccccggtgccctggggaacccttctctgatcatcaggattctcttggactccggggtccttgtcctgctcaggcatccctgccctgctgtccttcagggccctcaacacgatcttctctggacacgagtctggggatagccgggtgttgtgggctccaaagggttgactccttgctcctgggccccacagagagtccttgtgctcagtgcactggctgtgctgcaagatatcctggaattcgaagcacacagtgctggcttgctgtggtacctgtgcaatcaaattgaaggcaagatcaccaggaaggaacacagggcttgcaagatcacggaaaaccttcttggagttgttttgacacaccactcatgtcaagtgtctgggtacttgtaggatggcccgccactccacc

SEQ ID NO: 252480 - DNA, 585 bp, Homo sapiens
cttccatcacaaattcaattccactcaattatgtctacatatccccattccttctactgtgtttctatgctgtgaactataagggagcagatttccaggagttccctgcatacatctaattattctccttcctacttctctcctggtctctcatattctgtttacttcataagtttgatgtgaaaggagattcagaaaatgcctctgctatatttaatgccaaccaaatagtacaactgaaaagaaaatggctgtgattagactgtagacaaactgaatgaaacaaacatcaaacttagggatatgtataaaacagccactccttgtacatttcagtatttctgttttctacactccaaaaaaaggcattgaaatagcctttaatcctaatagaactaatataatttttacggttgacttttctttggcactttcacatatcctcaagtcctaaaagaaataaaacaggctgggcgtggtggttcatgcctgtaatccgaggcaggcggatcacgaggtcaggagatcgagaccatcctgactaacacggtgaaacccggtctctactaaaaatacaaaaaatta

SEQ ID NO: 252481 - DNA, 414 bp, Homo sapiens
tctttgatcacgtcattggttaagtttcactattgtttttgccagcttacttagaagcagctgagttaccattattacattaaaaagtactaaagtatgatatgccataccttaaaacttcctcaagaatgaagtttacttctcaaaaaaaaaatagaaccaggctgggcacgatggctcacacctgtaatcccagcactcctagcactttgggaggcagaggtgggtggatcactttagttcaggaatttgaaaccagccagggcaacatagtgaaaccttgtctctacaaaaaatacaaaaattagctaggtgtggtggcatacacctgtggtcccggctactccaaaggcagaggtaggagtgccattgtactcctgcctgggtgacagagtgagatcctgtctccaaaaa

SEQ ID NO: 252482 - DNA, 363 bp, Homo sapiens
tcttacaaaagtatactatacagagaagaggggacaatctaaagctacacataccaccccagacaaatttcacaaaccatactgacccaaaaaaggcaagttgcagaataatacatacaatatgttattatctgtataatgtttaaaaacatgcaattgcagcaacatatattgtttatatacatgtacaggttaaacatccaaaatctgaaaatcttgaaatctgaaatgctccaaaatccaaaactttttgagagtcaacatgatgctcaaaggaaatgctcattggagcatctcagattttgaatttttggattaggagataattaattggcacgtataatgcaaatattccaaaatctg

SEQ ID NO: 252483 - DNA, 620 bp, Homo sapiens
gatcgcttgagcccaggagttcaagaccagacagggcaacatggcaaaaccccatctctacaaaaaaatacaaaaattcgctgggcatgggggtgcatgcctgtaatcccagctatttgggagactgaggtgggaggatcacctgagcccagggatgttgaggctgcggtgagccatgatcatgaaaccctgtctcaaaaggggggaacaaaaagagggtatctcaaggtagggtatctcagggtagggtttctgttgaccacttttcttagtatgtctttaaataaaatgttgatgccatttttaatacactaataagcaaatgaaatggcattagattctggccaggtgtggtggcttatgcctgtagtcccagcactttgggaggctgaggtgggcagatcacttgaggccaggagtttgagatcaccctggccaacatggtgaaaccccatttctattaaaaatacaaaaattaggcgcagtggtgtgcgcctgtaatcccagctactcaggagtctgaagcacaagaattgctttaacctgggaaatggaggttgcagtgagctaagatcatgccattgcactccagcctgggcgacagagtgagacctcgtctc

SEQ ID NO: 252484 - DNA, 571 bp, Homo sapiens
atgtttccttccatcttctgtgttctaatttatgctgaggtcatgaaactcagtatgagttcaaaaataccacctgagtgagctgtcaccaatttcccacaccgtgtctaaacttaaaagagcttcctctctatgtgagttttcacacagatattgctcattggttcaggatcagttctcctagggaatgttctcccaggggcatagggtttttatttttgaaaacttgggcagtacagggcaaacatgctgaatggatctgtcatctcagcctttctgccacggtgcctgcatggtgcctggctgccagtggagccatctgaccttagaaaccctcaacactttacaaaagcttaaatattaatttatacatgagatccttaataggttctgaagtaaaagcagagtgctacagtgagaaaacaccttgactgtgagttggggtccctagcaagattgtctgtaactaataaattttgtgtcattgggtaggttatttaacctgggtctttttccttatctgtaaagtgagttagaggagatgatctctaagattcctattggttgcaaa

SEQ ID NO: 252485 - DNA, 392 bp, Homo sapiens
tgcctttaggatttaaatttctcttaagtgggcagtattaaaaaggaatgctaggagttcatctacttcacttttaccctcctattaaatcctcagcatacacagaagtacacacaactctcaaccggcattttcaaagctgaatccttttgtaacgattactttccctcttgattttacttgcttaattagaatctctagaaaatctagtagcattaaaaataatcacccccccaataaaaaaaaaatcttcattaggcaaacaccacaataatttttgtcacagacaagatctatcaaaagattctttaaaattagtggacaaaagtttgaggaaaaacgttatttgtataatcccaacgtatcttccccatgaaatgtattaattacaa

SEQ ID NO: 252486 - DNA, 153 bp, Homo sapiens
aaaaaacacacatccctatgtccacaaacaccctcaccctcacttcctccctcatccacagacacctgttccccagtgatgcacatttgctcacacacctgcagctgctcacacatgcctgcatgagaggccctctccacccttcagtctccc

SEQ ID NO: 252487 - DNA, 307 bp, Homo sapiens
tatggtcatggaagtgcagcactggcatcttagggagctgtggagtgtaactcaggagtggcacgtgggtgagagtgggcagctgtgccgggtgctccaactgcctttggcagccagtggagaaggtgcgaccaaggtgctcaaattatttttagctttgttttcttttttgactttttttttttttaaaaggtaacttttatattgtcacagaacaaacagaaccaagatttaagtctcacaatttatgtagctaatttcatgttctgacagttctaccataaagcatgcagaaaagttgctgtta

SEQ ID NO: 252488 - DNA, 339 bp, Homo sapiens
caccatgccaacctcccttcctccaccatgccaacctcccttcctccaccatgccagcctccctccctccaccatgccagcacagggactccccgtaaatcatcttcatccccctttgtggaaagactgaagatctgtatatgacaaggtcaagagtgggctcacccagtgctatccaagagaaacaccgtgtcagccacctgcataactttacactgtctagtggtcaccttaaaaaaagtggaaagtaacagataaaactaattttcatattttatttcactcaatgtatccgaaatattaccatttcaacatggaatgaataattaaaattattaa

SEQ ID NO: 252489 - DNA, 552 bp, Homo sapiens
  misc_feature (106)..(106): n is a, c, g, or t
gctcgctgtatgtgggggatgtaacgataccatttcccagggacagctagcatgatcgatttaatcgcttcaatagattgggcctcgagccaagaatcggccgagncaatcttttcaacagaatagaagaaacccacagctaatgtacatcagctctgccatcactccctgccgggtcagggaagaagaaatttgatgcctagagattgatctgctttttgtttttaagttctagttctggttcgatttcagaaccagtctgcaggcaactctgcattgtctccttagagaactggacaattccactgatctggatcctttggcagcaagctgacattttattgaggctggtcagcactcctggccagagtcttgaaattgtgggtgtgtttttgctgcccattgttgagttattcatgaacagatatgaaaaccatatatatccgaattttgttaccactagatgtgatgagtttttctttttgattatttggggattcttagttctctgtcaaactcttcagattaaaacccttcttatagctaaaaaaa

SEQ ID NO: 252490 - DNA, 461 bp, Homo sapiens
cagttgagcaagtagattggcttccagactaaaccctggattgaggtacagctagaataactcacttaggttttctgtttattctttcaggaagaagaaatttgatgcctagagattgatctgctttttgtttttaagttctagttctggttcgatttcagaaccagtctgcaggcaactctgcattgtctccttagagaactggacaattccactgatctggatcctttggcagcaagctgacattttattgaggctggtcagcactcctggccagagtcttgaaattgtgggtgtgtttttgctgcccattgttgagttattcatgaacagatatgaaaaccatatatatccgaattttgttaccactagatgtgatgagtttttctttttgattatttggggattcttagttctctgtcaaactcttcagattaaaacccttcttatagctaaaaaaa

SEQ ID NO: 252491 - DNA, 426 bp, Homo sapiens
cctagtccctagaaaccactgatccattttccatccctacagtttggccatttctagaatgtcttgtgaagggaattattcaatatatagcatttctagtctgttttattcccccttagcaaaattcccttaagattcatccatgtggccgggcatggtggctcacatgtgtaatcttagcactttgggagaccaaggcaggtggatcacctgaggtcaggagttcaagaccagactggccaacaaggcaaaacctgtctctactaaaaatacaaaaattagctgggcatggtggcaggcgcctgtaatcccagctactcaggaggctgaggcaggagaattgcttgaacctggaaggcggaggttgcagtgagcagagatcatgccattcactccagcctgggtgaaagagtcagactccatctc

SEQ ID NO: 252492 - DNA, 530 bp, Homo sapiens
atcttgcatttttgtaggagctttttctatgaagtgtcaatctttgaattctacttagggcttttaaaaatgtttatctcttcttgagatatacattgagaattgagtattgagcatactcttggtaaaacaagatttggactcagtattaacaaaaatctgaaacttaataaaggtttatatcattatgtaaggtgtgaatagaaccacaggagaaactgattttaaataaacataccagaacatatgtatgtcatgttaaccaaataccttgggaggttataaatgcatttcaatagggcattcactactcaacatactgtgaaacttcttttttggcattgcaatcagaatgactttaggaactacacattatcatgtagtcaaacaagattttttacaactccaaattacattgcctgacttaacaaacttactcacttgacttggcttcaaataaattccttctgttttctcaaaacaaaagtaaaggtaatgaacaaaacaaaacaaaaaacccacaaaagaaa

SEQ ID NO: 252493 - DNA, 158 bp, Homo sapiens
gccgtagacgccacgctccgaaatcaccatcaagggacttaaaggagaagaaggaagttgtggaagaggcagaaaatggaagagacgcccctgctaacgggaatgctaatgaggaaaatggggagcaggaggctgacgatgtgaagtagatgaagaag

SEQ ID NO: 252494 - DNA, 180 bp, Homo sapiens
  misc_feature (128)..(128): n is a, c, g, or t
gccgtagacgccacgctccgaaatcaccatcaagggacttaaaggagaagaaggaagttgtggaagaggcagaaaatggaagagacgcccctgctaacgggaatgctaatgaggaaaatgcgctgcanatgacaagcagccttatgaaaagaaggctgcgaccgctgctggaaatgctga

SEQ ID NO: 252495 - DNA, 367 bp, Homo sapiens
cagatctcctccgggagtggtgggcagctactgtgaaaggcctggttcaaaaacctcacagcggttgttttcagagttgtccctcctgtgtactctcaaagccccagaatgaagcaaagcatcctcccttttcaaactggcactcttccccaaccttgaggaccactaggcactttgtttttaaagccacagttacttttatggagaagtattgttatgaaaaaagggaggcatctgaggagtggaaacagagaaatgagtgactgagatcagtgtcttattttgaccatcttttccaagtgctgcatcctcccaaacacaacatgaactcaacacttaataaagctgcagtcctacgtgaaaaaaa

SEQ ID NO: 252496 - DNA, 227 bp, Homo sapiens
ctcatctccagttgtaatccccatgtgtcagggtaggaacctggtgggacgtgattggatcatgggggtcattcccccatgctattctcattatagtagtgagttctcatgagatatagtggtttaaaagcatgtggtggtttctctcctgccaccatgtaagatgtgccttgcttcccctttgctttccaacattattgtaagtttcctaaggccttcttggccat

SEQ ID NO: 252497 - DNA, 278 bp, Homo sapiens
ggaccctggcaaagtgtcacacacagcactgaatccagacgcagggaccccagataaactgcaagacgcccagtgaacatggatgtcggagcatctaggtgggaccctggcaaagtgtcacacacagcactgaatccagactcagggaccccagataaactgcaagactcccagtgaacatgaacgtcaggtgagcaacagacaagctttcggtctacagataaaatgcaagacgcccagtgaacatgaacgtcgggtgagcaacagactagctttca

SEQ ID NO: 252498 - DNA, 339 bp, Homo sapiens
aggaaattgtgaaatactttctaatgatctttaaagatataatgaacactaatccatctggatttgtgtaggtgtggtcctggtttaagacaaagggacacaccggtgtttccctttgtaccagacagcacaaacccaattaagtgtttaatagatactttctgtgataagtccctttgaaaaacaaaacaaaacaaaatcttatatagattgcctgaaaaagtgaagtaatatcacttctcgttaaatgttaacctttaaataactaaaacagctagtttatcctctggacttaaaaccctacatcacactagctttaacatacatacaaagggtaaa

SEQ ID NO: 252499 - DNA, 234 bp, Homo sapiens
tagcattcgggtagttcaaattccacctttttataaatgagaaaaacaaagttcatacagactgttatttgttctcagttctctgatggttagtgacatagctatgataagaactcatacctcctaatgtctcaaaacatttatctgctaaattaaacttcactcccaaataataattaggtttgtgtgtaaatgattaattaaaaatcagagcatggagcttctgagctggtt

SEQ ID NO: 252500 - DNA, 182 bp, Homo sapiens
atatgtatgtatgtatgtatgtatttgaaatatatatatatttaaaacagcaagtggtggccagccaagaaaagcctcccataatatcgttttccaaaaactgaaaatatactttaacttgaagggtactagggcacacttccaaattaggcattttcttttagttaaaaatcataattggc

SEQ ID NO: 252501 - DNA, 443 bp, Homo sapiens
ctccccattaacaagtgtctttctggtgcttaactagacaccaagagttgtctgaaaaagaaaaaagctggataacaagggggattatcactatttaactgtgttttcatactgttattaatttagttcagatctagtgccatatgcttctcttcatcattccactgaactcctagtgactttcatggaagttccacacaaagaatgagggcgacatatggttctaatagtggtttgttcattcctctaagattgatgggtattttaaacacattaatcattatatttaagacaccctttaatttcttcagaaggccggatcttcactgatttataggagtccttaccacacagccatacctactttgcttttcttttaaaacttggcatcaagagaaaaatattgacatgttcctcttataataaagtaaaaatgtaacaaa

SEQ ID NO: 252502 - DNA, 863 bp, Homo sapiens
cctccacctcccaggctcaagcagtcctcccacctcagcctccctagtagttgggaccacaggcacacactaccacgcccagctaattttttgtatttatggtagagatgcggtttcaccatgttgcccaggctggtctcaaagcaatcctgagcttaaacgatctgcctgctttggcctcccaaagtgttgggattacaagcatgagccaccgtgcctggtcttaggtggtattttttataatgtgatcagagtaaggctttatggtaatatgacatgtgagcagagtcttgaaggaagtgagataatgaagccgtgtgagtacgagaagaacattctaggccaagggaataataggagcaaagattctaagctggaggaatacttacttgaagaacaaggaggtctgggtagctgggccatagtgaatgagtgggattgtagtgagagatgaggtcaaacaggtaactgggaaagtggaggaggtaaggatgaattatgttgggtcttgtgagccattgtaacaacttaaattttcactttaggtagccattaaaggattttaaacagaggaataatgagatatgatttatgtctaaaagaatctctctaaactatgttggaaatagactctaggggtacaagggcaaaaacagagacagtcatgtaataagggttactctctgtagatatcaaacatacaccagatataatattgaaataacttattggtagcttatcaaagtggcatgctgccaactaaagagcctgtgctggctactcagacagtatctttgccaagtgctacttctttttcttgattagccatttctttctttctccttacaacttgaaaaatagaa

SEQ ID NO: 252503 - DNA, 629 bp, Homo sapiens
tacaaaaaatgtggcaaaacttttaatcaatgctcatatctttttgcatgtgatagcatttatacatgagaataattgcacaaatataaaaatacaaaagccattaatttctactcacatcttaccagatatcagaatttatggttaacaaaagcattataaatgtaatttctgttgaaagaccttttagaaaatataggccattaaagcgaagaagagtattcttaagacagacaatacaaatataaagagggtgtagtacctgtacttgtatcctggatcttactgtacacattttgtactagcggaagactcagaagcagttgctcaaactttgttcaacatcagagaatttacattggagcgaaatacgacaaatgtaataaatgtggaaaaacatctgttcaaaaactgcaggttaagaaacactagagagtttatattagaagagaatttgtagatgcaataaatgtggagaaatatttaggctaaaattaagcctatgtaaacatcagaggatttactggagaaagaactaaggaactaacaccttacaagaaatcggagtattaagtgtaaaaaaatccaaagttcaacctgttagaaactttctttgttggccgggcacg

SEQ ID NO: 252504 - DNA, 439 bp, Homo sapiens
ctggtctcggggactgcagtccttctctcctggatgggttgggggtggggggctgttgagagctttcctcctccttttcttcttcctcctcctcctgtctccctaaccctggaagggggccatccactgaacttcggaaagaggtcaccctccctgaaaaggggacttggattgctgcatccagagccaccccctgtggtccctcaatctagccacactcagttgctaaagcagggagaggtttcctagtccggtgttccggccgacgcaaacggagctcaggatgacgccacatgtgtgtttgagtcaaagcgcttttaactgtggctccaagaacagcctgtacagccacttgagtttccccgtaacaaggaatgtacaatagatgagactttactggcaaaacaatttttaaaaataaagggagaagcagcaaaaa

SEQ ID NO: 252505 - DNA, 380 bp, Homo sapiens
gccactgcactccaccctgggtgacagagcaagactccatcccccccaaaaaagaaagataatactcaacatttatttgaatatttccgtaaaataagatcatttaaatgatttattcaacattttgacttgattaatctatacctgtcggccgtaagacaccactattgtcttaactgtaatattgggccaaatctaccatataaggtgattgtgaatcaggctgaaactcccaacccagtcaggttgtgccaacaggtgacatatttaacctgcacaatattttagggcatcaccataccctgttgtcattatacctgcttcttttaatcagctgaggtaccagcctagcgtttgaagacattttgagtttgaaggcc

SEQ ID NO: 252506 - DNA, 720 bp, Homo sapiens
cctgggtctcctgtggactgttttcctgcacccagtgtgcttctgcctccctccatttgaggccatgtgtcttctcatgctctcttgctctctctttttgaactgttgcttatttggaaatattttcagttatttccacacataacttctagatgtttatacctttttacagagtcaggtatcctttttctggtgtatttatttggtctggaatgtgtcaggttttgaggccacagcacagatgctttgctctcccataagtgtgggcaatatgtggagaatggctttgtgtggattggaagtggaggtgaagggggaagtatcttgttgggaagaaatagctgactgtggccttcaagtgcttcttgggtggatgcatttaataatgatcttagtgaatcagttgctgcatattgaaaacaagatggctggggccgggcgcggtggctcacacctctaatcccagcactttgggaggctgaggcaggcagatcacctgaggtgaggagttcgagagcagcctggccaagatggtgaaaccccatctctactgaaattacaaatattagctgggcatggtggtgggtggctataatcccagctactcaggaggctgaggcaggagaatcgcttgaacctgggaggtggagcttgtagtgagtcgagattgtgccactgcactacagcctgagcaacagagcgagactctgtctcaagaaa

SEQ ID NO: 252507 - DNA, 878 bp, Homo sapiens
tgattttggatgttatgtccatgtatactgccaaatatgaacataaagctcactatatacttataaaatacttctagaaaaaatatctatacagcaaggcttaaaaaatgagtttcatgctaagaattaagcctggtgaccaagttagtctttggtatgcatttgatacctgccatagataggaggtgtgcctccatcaagatggctcatcaggtaacaatgccacttggtagcagatgtttaaaaatagccagccttaattaactgctttcatatgctgtccactgtgctcagtgggtttcatggggtggtgttattatcactattatgtagatgagaaaatcaaggttcttagatgttctggaatttgttcattttcacatgattggaacattgtggtcttgtctttcaagtccatgtctaccatactccacagacccttttctgtccactttgtcacctataattctgaactccaatataaagacttcaccgtatttgaaagagaatagtgggaagtctgatgctcaattttgtgtacagaacagttgcctctgtgacattgtaactgctgaaataagaaaatccccttttgattcaggatattatttaattattgcaaatctcctggcatagatctgatactcaagttaaaaaattaggctcaggttcttacctatgattttgctttttatagtactttgaaacctacaaaacttacattcaacatttacacatacaaaattcatacagtctttcaaaactaagattgcgtaataatttgatggcttgaaattttaagtattacaatataaagagcagagactttatgtttaggattaatactttttaataaataacattatcctttgcattaa

SEQ ID NO: 252508 - DNA, 407 bp, Homo sapiens
attcgttgtacagattatctcatcatccaggtattaagcctgctacccatttgtttttttcctgatcctctccttcctcccattctccactctgtgataggccccagtgtgtgttgttcctctctatgtgtccatgtgttctcatcatttagctcccacttataagtgagagcatgtggtatttggttttccattcctgtgttagtttgctaaggataatggccctgcagaggacatgatcttgttcttttttatgtctgcaaggtactttgcttataaggacaaaggggagaatagggattggtgggcaactagtcatctactagttacctcagtaagctaagcattaaatctaagaaacagcaaaataagcctatggaaattaggaagaaggaaagaatcaaggt

SEQ ID NO: 252509 - DNA, 422 bp, Homo sapiens
ggccaatggagtgtgggagggaatgtaggccattttcccagcagcctgattcttcatgataaatcagaaaacttggtccatttacctgcggatacctcactttgttgtgaaatgtttttggttgtggtgaccagaaaccttttagtaggttaaagagaaggaaaataaaaaggctatcggggaagaaatgaggggacttgttagaacactagcttttaaaggtacccctgagatagggagatgctcttgggaggttggggaaaaagcattaagtaatattgagtcacacaaagtctcaatttagatctatttttattagtacatttctctgtgtctccatcttcaatgcgtaatgatacctagctaatatttacactgttttagttatatttacttttgtcattacctgtaggtatagcaaa

SEQ ID NO: 252510 - DNA, 582 bp, Homo sapiens
ccgccagcttccggaagaccagacagcgattctcaacagtgtggaccacgatgacccaggacatgccactttgctgtgactccaccccactctaggtgtccccggggcgaggttgctgggctcaggcagggagggccactgtgtgggggtgtgtcctcctccgtctgccaagggcggcccagacctttgtcctgcatgccccctcttttgccagagcgggtgtctccctccagatcctggccgcctgtcttcaggacggagggtgggcacaccttccacctgtgggtcgaggtcaggaagtggattggagactgggcaacacctgtctcctcccctccgccccctgcttcactaggttgatttttctcatctcttccaatgtctttggaagtgaagaggaaagcaatggcttttactgctctctgcttctgtttcagtttttcaagtcctggaagaaggctggacttaatgtccatcttccacaccccacatatatatagatatagatacagatgcatatgtctgtagtgtgtgggtttctctatgtgtgtatatatatatatatatatgtacattgaggca

SEQ ID NO: 252511 - DNA, 798 bp, Homo sapiens
ggtatagggggatcctgcaagcagaaatctgtggtgggcgggcggcaggtgagcaaggagaacgtgtctgtaaaggaagcacagggaacaggtggtggctttgtaagacagttggaacccaaggaaggcaggccatcccccaggaaagcctatgttggtgagggttatgatgggagaatgagtgaactgcagcctggcaccaccacaccctggaaggtgcagttgggaagaaagtttctgaggctgtagacatggggatcggatgctggagaaaccccctgctgctgctgattgccctggtcctgtcagccaagctgggtcacttccaaaggtgggagggcttccagcagaagctcatgagcaagaagaacatgaattcaacactcaacttcttcattcaatcctacaacaatgccagcaacgacacctacttatatcgagtccagaggctaattcgaagtcagatgcagatggagtttcgctcttgttgcccacgctggagtgcaatggcatgatcttggctcactgcaacctcctcctcccaggttcaagtgattctcctgcctcagcctcccaagtagctgagattacagaggggacaagagcaggcgtggagggctgccaggtgcctctgggggcttcacgcccagctcctcccaactgaggctcctggtcaagtgacatccagactctccagacctcagtttcttcacctgcaaagtgcctcagaataggagggaagcacttagcacagtgccaacatctggtagcacttataaaaaatctttgctgttatta

SEQ ID NO: 252512 - DNA, 361 bp, Homo sapiens
ttcgattggcgggcaacttagaatgtttcgtatcctacgctggttctgagcaggcttaataagaagctgacatcgatatctgatggcctgagaatctacttcagcactgaagtacacttactcctggccccatggacctattattgttcaacttgcaataatgggacacttccaaagagctgacaggcaatctttaattaaaatacactgaaaataacttgaggcacagtttgcacaaagaaaacaactgctctcttaagttgcccgccaatcgaatcgattggcgggcaacttagcttaggctctccttgcaaagttatttctagttaattcattatgcaaaaggtataggggtacagtc

SEQ ID NO: 252513 - DNA, 585 bp, Homo sapiens
caagagtctaaatttataggatgtatatgattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaat

SEQ ID NO: 252514 - DNA, 167 bp, Homo sapiens
ggtaccaggatcattttaatggtctttggcttcagatgggccatttaaactactcaacaagacctttgtctgcctctggtcagtttcctctgccattcaccccagaaggatcatggattttaactgctctgatcaagtttcttattccacccctgcactttcttctt

SEQ ID NO: 252515 - DNA, 448 bp, Homo sapiens
tgtcagccaccgcgcccagcctaagtaaattttttaaatctgggatgtccagtggggtagccacagccacatgtggctacctcactttgcactaattaaaataaaagtccattcttcactcacagtggccacattttaggtgctcaacagccacatgtggctggggactctcatattagacagtacaggctgggtgtggtggttcatgcctgtaaaaccagcaccttggtaggccaaggcaggcagatcatttgaggtcaggagttcgagaccagcctggccaacatggcgaaaacccatctctactaaaaatacaaaaattatccaggcatggtggcgcaagcctgtagtcccagttacttagggggctgaggctcaaggatggcttgagcccatgtggcggaggttgcactgcagcctcggtgacagagtgagactctgtctcaaa

SEQ ID NO: 252516 - DNA, 283 bp, Homo sapiens
tgaagaaactcagtcatttgccctgcagaattttctacactgtggatttgcctgactacaccctgtggtgctgttcctctatcttgttctggcaaggaagagccaagcaccgcatgactcttgtagaagatggactttgcagactgcaaaaggggaaaggaaaggggcgtgtgatgtttgtaggtgccttggtagaaagtccctctttgcctagaaattatttaggcatccttttataatgcttctggaagaacagaaagaaaaatctatttcctgaatgaga

SEQ ID NO: 252517 - DNA, 230 bp, Homo sapiens
gaagatggaatgccagggtgaagaatttggttttattttgtagagtatgaagagctagtgaaagttcacaggagattaacaaaataaaaattaaggatttaggaggaacagtggtaagaaagaacatgtaggaggcttttgcagtatccagtaatgagatgtaatcacttggattaggattacgccaaagaaaaacattacaaagaaaaaaaccccttcttctggtgccc

SEQ ID NO: 252518 - DNA, 360 bp, Homo sapiens
gttttgcaagacgaaaggttgtagagatggatggtagtaatggctgtacaacaatgtgaatgtactcagtgccactgaactgtacagttaagatgattaaaactgtaaattgttatatatatcgatatatatttttttgagacggagtctcggtctgtcgcccaggctggagtgcagtgacgcgatctcggctcactgcaagctccgcctcctgggttcacgccattctcctgcctcaggctctcagagtagctgggaggatcacatcagccccggagttcaaggctgcagtaagctatgatcatgctgttgcactccagtctgggtgatggagtgggatcctgtctctaaaaaaacatt

SEQ ID NO: 252519 - DNA, 427 bp, Homo sapiens
agtaactcttcagggcatgcctatgggagatttactcctgcagaacttaatcatcctagttttgctcttcacacctttggcggcttcttataagccaccatgctgtaaggaagcccaagccaccctgtggagaggcccacgtggagaaccacagccagcaacaacaatgtgtgtgagctatcttgaaagtggagttccagttgagctgccccagctgacagcatggagcacaggctttctttagatgagcaaccatggtggctgctacttcctgtggagcaagaggaacgtggactgtaagggtcatgtgcacggggtgggaagcgctggtgggtgagctggggtccccccaatgatggattgttggggagctttctttcaaggcactaataaacacacaagcggctccagttcttgaaaaatgtgt

SEQ ID NO: 252520 - DNA, 693 bp, Homo sapiens
aaattcataggaatagaattgttaatagaattgctcgaccaggtttcacatgcatttgccatgcgatggatgtggccagttttctgttcttcgaagagatgggctttatgtagccttcacaacacacaagaactgactgcccacaccctggccctgagcagggctttgtgagcaggttgagcattttcttcatgcggttaagagtgccttatattttgttttctgtgaactcagttgaaatcctttgcttctttttacttattgacttactggtctctttcttattgatttaaatatttggaaatgactgtttctggtattaattgcaaatttctttttcagcttgttattatctttcaattgactcgtggtggtgtttcattctaggcagaaggttttatttttgtgtcatcatatttcttagcattattatggcttctggattttgtcttgtgtttagatcttccctactccaatgtcataatctgggagttacacctttgctctatttggaattaattttggtgaagtatagaaccaacttcatagtttttccaggagactacctagtcaacatcattatatgaatatcctgtttcccctcatgatttgaatgtctttgtcttataatttgcagtattttgaggtctatttctatgctttctaattatttatttgccagtaacatatttt

SEQ ID NO: 252521 - DNA, 489 bp, Homo sapiens
tggttcaagcaattctcctgtctgagcctcccgagtagctgggattacaggctgtgccaccacctggctaatttttgtattcttagtagagatggggttttgccatgtttgccaggctgatgttgaactcctgggctcaagtgatctgcctgcctcagcctcccaaagtggtgggattacaggtgtgagccaccactcccagcctagcctttgtgttctcttgacctagcattcaactatatgttgaattgaaatgaatatgtaatctctgccttctagctgcttaccataggctgattgatgatcacttgtatagactccattgcctgtggaaatggaatagctttccttgtaatactgcctgagctctgctttccacccagtccgttttagcctacttgagccctggaccttgactgctgtctggatgcttgaactatgttttcctttttatttttctaatcatctagaatccagcctaactctcca

SEQ ID NO: 252522 - DNA, 397 bp, Homo sapiens
gagaccctgctgtgagccagggtcctatcctaggcactgaggattcagcagtcaacaagacagacaagatccttgctgtcctagggtttacattctagccattctagcccgggaagacacacaataaacaggatcatttcactttgtgtttttgagatggagtctcgctgtcacccaggctggcacaatctcagctcactgcaaccactgcctcccaagttcaagcccatctcctgcctcaggctcctgagtaactgggattacaggcatgcgccactatgccctgctgatttttgtatttttagtagaggaggggttttgccatgttagccaggctggtcttgaactcctgacctcaggtgatctgcctaccttggccttgtacagtgctgggatt

SEQ ID NO: 252523 - DNA, 545 bp, Homo sapiens
ctcctccaaaaatcactcaagtggcaaatgttgcaggtgggatttcagtccatgtctgtgattctcacctgccatactgctaagctaaccagttgccccatgcaagaagaacacacctcggtcgcatgtggaagcatggggaagacagtaggttgcatcattctctgctgcctggatttgacagcagaactccctttcctgtcgcccgtcactcatatccaggaatgaaagccttgattgaaaggcttgtccaacaatacagctttaacagggccatctgctcaggacacagtaagtagtgacaggaaacatctgctttggaaatgccggtgcttctgttgattgaaatgtacacacaggaaagccgtcttccagtccgggggaaattctgagctgaagagattgtggtattattgaccacatcaagaagagctggaaatgggagaactcttgggtggcagaggagcagatcccaggccagcaggggtcctcttggtaataataacaattgctgataaatattgtttcatgaaaaagcttggaag

SEQ ID NO: 252524 - DNA, 502 bp, Homo sapiens
ctgccacagaagctggcgccaacggagggagttggatccagcctgccctggagctgtaggtgggggcccaggaccacagctggagctcctggctcactgggctgcctgattgctggccccaggtgccagtgaccacgtggtctcagcatgctgagcctcaaacacctgccagttcaggcgggctggggaggcggctcctgtggcaggtgcagtagtgcgggagttgccatcagcttcccaaggagctgcatctcacaccaactacactgcatgcacctgctttctagaaagatcagggagacagccaggagcagcacccgaaggacatggaacgggagtcagttgctcgggcattgaagccaagctctatgggtcctcttcgcactgggcacattgtcacctctctgggcctcagtttcctgcaggtgaaatgaaaaggctagaccatgtttaactgtgggaccttgaggctctattaaatttttaactagaaaatgtccat

SEQ ID NO: 252525 - DNA, 414 bp, Homo sapiens
cacagtttccagtacatggaatgagcttaacaagtggtggctattataagtgcagtattttcttcattgactaccagaaggtggtaaacttcacttattcatgtttacaccatttctagtaccaatggggagaacttaaaaagttgtagaatgagtgcaatataaaaacctaatggctggctgttctctggaagcatgttctggctatgaggtagggaatccccccttccttactctggcctgccccatcaactagttatttagtcaacttgtagctaaatatggatgaaaggaaaatattcctaatatggacagagaggttaggatagacaaagtcttaggatcttttgatagtttattttaaaatcatgttctactaatatagtaggacaaatctaatgggacacagtgcaa

SEQ ID NO: 252526 - DNA, 412 bp, Homo sapiens
ggatcacctttcttctctaatctccacccaggcaaaggccagaaaagcgaccttcagaaggagccagcaccccagctcctgcctcagggcgatatgaagaccccaggaaggaaattatgctgagaaaaggagatcacacctctgtccagcctgcaccggccccttggcatgccctgaagacacaaggcctaaatcaaggtcaaagacacagccctcctggttgtgaagattccaaaggctcccagctgcatgaggagggttacccagaatgtcagatttggagcaattcagcgagaacccttcaaaattcagtgtggtatgtggaaggtaagaggcagacaggccaccaggaggtgggttttatttcgtgtgcacaaagttttaaaaaatacatgtgcaccattaaaaggga

SEQ ID NO: 252527 - DNA, 341 bp, Homo sapiens
cacacacacacacacacacacacacacacacacacacacacacacactgagaaatgcatggccaaaagtaagggtaaaaagcagatgagtgtaaggtgcccggagtaggtgttgcaagccaccactcgtttggttgtcttcctttctcacggaggtcatcttaaaaacagatgactctgaggtaatgtggcttggtgaaagtgatattccacagaccttttagcaagagttctggagctgcgaatctgcgccatgaaatctgtgggcttctcatattaaaaggaaaaaaaggtaacacaacaccactcaccaaataatgtaaaacgaacattcttgttttc

SEQ ID NO: 252528 - DNA, 250 bp, Homo sapiens
tagttccagcaatttctagccgggtgactttagagaaggctcttgattctcagaacctcagttcttccatgtcaggtgatgtcaggaggatcacctacgataatgcatacacgacacccagcactatgtctgatatgtaacagatgttcaaggaattgtcttcatcattctacacagacataacagcgacataattgcatgtcattaattttactctcagggaggcgaaaaaaacctaattaccttccgg

SEQ ID NO: 252529 - DNA, 248 bp, Homo sapiens
ctacccaattagtctgtttatttgtccacatggcattaatggcttcttagcactacatcttgtgttagacaaggatgggcaaggatggggcactggttttttgtttgtttgtttgtttgttttttgacgaagtcttgctcttgttgcccaggctggagtgcagtggcgcgacctcagagaggcttggcagggagaagggctaaatcctaagggtagtttggctacagcaggccatgtgcaaatcccga

SEQ ID NO: 252530 - DNA, 431 bp, Homo sapiens
ctctctgaggggattcaatataattcactgcccaccagaatactgaattcacaacagagaggaaaaaaaaaactgatggtgctgctttgcatctgtttaaatttttacagaaatgttaagggagttaatcttctacaagtccagtcatgtgctttcacaaagggccaagaaaggagtcccaaagctcgccatgactcaacaggaagctctttgtgtcttcctttctacaccatgtctgacaaagaagctgtcttaagttcatgggcctctgtctcttgcgtgaattctgaagtcagtgaagcaacaatgatgtcattgcttctgaagaccactgttggctgagataatgaagatctcttcacccaaaacattgccatttctgcagcatacatttcctaccctttcaaatacaaaagtattctaccgattga

SEQ ID NO: 252531 - DNA, 367 bp, Homo sapiens
aaaattttgtagtcaaattaattgcgacttgggtaagattgaatttttatttcgttgtgtttttagcatctgtaacttacttgccaaagcctttattcaaaattctttaacttaatatagcaggttactgataatctataattttcaggattgcatttctaatgagactgactttgatatatactttatagtatgttagttatttctgtaatctcataaggggagtaggaacttcgggaacaaggaaggtgtaaagaagtgtctttttcaaaaataccaattagtgaggcatgtaaatgtaaaacccttattcctttttcggtattgtattgtttctggttgctaaacattaaaacgggtgattatg

SEQ ID NO: 252532 - DNA, 519 bp, Homo sapiens
ctacttatgctatctgtggatgcctcaagcctgcccaaagctgccaccagaggggaaaatcatttttctttctcttatacctttcatatatttcatatatcatggttatatatagtctggtgtactactggcaatggatcctgcaaaatgtaggcttgtcttcacagaagggagtatatgaatacatgaaaatgatgttcattaacagataatagagcacagcctacccctttgtcaactcagcacccatatgcacttacacaaccaaacaacagtagcaacaatatcatgcttctgcctgatgtaatacaactagctcctgcaccagtatgtgttgcatttgccctttccccatatttgggagacccaaagtcccaccagtcactatacctatttctaaatgatgttcataaatcttttagttcagagagtatagtcacacttttccctgttatggtctgtaatctaaagaatgaacagtaacgttaaccaccaccaatataccttatagtagtcaaa

SEQ ID NO: 252533 - DNA, 565 bp, Homo sapiens
tagtaatccatgatccagaaaagataaatgcaaatacagtgttctctgaagcatttttattatggctaaaaagaagatgcaacttaaagtcccaacagtagaaaaagaatttgataaatttacgtatattaacatagtagaatattaagtagttctttgaattataattatgatacctatttgggaatgtgtgacaagtattaaaattagactgcgattgtaactaaatatatggcgaggtttatgttgtgttaggctcatgagaaggcaagaaattttattatttaaatgttttctccagtaatgtattggattcaagccattgagatttggggagtgtttcagtgacttatttgggcaaaacagaatatttgaaattggcattgtctcagaatctggcatttaggatcattagccatatactttgtctgaaagattgaaaagaacttaaattattattattggaatcattgtaaataatgttgttgttaaaaatgtgattataagacaatgtgggaaactttttttttttttttgagactgtccccccgcccccaccgccaaa

SEQ ID NO: 252534 - DNA, 414 bp, Homo sapiens
cactgaacatagaaataactgaggacactaccatatataacgacatatttagttttaatttagttgaaacccaatgagaaattcaatgttagtcattattagggcttttctcaaactcccaaagttgtgccaaggtcctagagtctcatattgcaacagtgcattgtgggaagctactctgatgcgctaccattaaaccatactgattattatctaatgcccttgacccaggcccacatttttccttcatatttagaggttctgttgcttttaagcccaactttacaaccttttcagtgacttcaaacttacacacacacacgtgtgaccacaataaccctgattgatctgtctgcaagtcgtttttcagcttgtgtttttcaactgcacaaaattctgaggcaaagaaatatc

SEQ ID NO: 252535 - DNA, 615 bp, Homo sapiens
cagaccattaaaatctcagaggacagtgtgcttccttgatttagtattgcagaacctcttctaaaccagtcacttacctagttaaacacccacacatcatagagcagctgatcatataacatatacggttgtgagaacagcattctctccctgccagattcagaacttggaagctggaaaacaattgcatagcagtgaaacacttaaggagtagtggtgccagcagttcactctcattaatacaaacagcttgctttagtttctccaacactcttcttcagacacccttcccttaggaggtttcagatcagcagctcctactcaagggaaacagcacctactttctgcagctgtggtctcaagatctgattcgtgacacccagaactgttgccatttctgttctaagtatgggaagtaatctcgtagtgtggtaagaaaatacttttcaagtctgtagaaaaaaaaagttgattagtaatgctactgatgtgattttgtttttgaatgtctgaagcctaacgaagaggtaaactagaatgtgaacttttgaagtcacccttttctcaggggttttagataattttaccaaaaaaatgtgactatactcttgaatt

SEQ ID NO: 252536 - DNA, 378 bp, Homo sapiens
gtatttttctaggctgagcgagtactgggaaaaaggaaatacccagacatttgagggatcactgacactgcttctgaattaatgctaattcctgaggattgcaaacaccactggatccaccaatcaaaatggggatctatgaaaatcagattcatcaagtgactcttcagtcaacaactgttcaagacgctgttaacatcacgtgtagaatgctacgtttctagaattgacatttcagcgatcgagaattactatatttgtaaacagaaatgccactactagaaacagaatgctataaatagaatgacgtcttttgttttcaaggtcaatatgtcagagcgatgcaaaaataataaaagtgagatatttcatggcaaa

SEQ ID NO: 252537 - DNA, 631 bp, Homo sapiens
gagaaggtggcaggtattataaatgtggtaaattcctcatctttcattgtccaaagccaaatcactatttaatgtttttgtattaaataacagaaacaaatacattgtttcatgttttaatgataaccatcataagggaaaatagaaagtgtgaaaggtggttattactaagggctgtgactgggtcaaggttgggagggttgaacgagaacttttacttttcattttagaatttgattttttaaaaattgtatgcagatttcactttaattttttaaaatatgccaggtgcaattgggggctaagtttgtttggggaacaaaaggaaagatggtatcactttctccaggaagtttcccatgactaccttggggtctcttttccctgtgttcccaacaggcaagcatgagacactatccaagcatttaatatactgtactgtgtctgtgtgcatagttgtatgactaacacactagactaaaatctcctggaaggctggtgtcataacgtgacatttgtatctccagcacataacagtataataactagaagagcaataagtatctgctgaatgaaaacaacacatgaatgatggtccatagtgaaaaaaatgatcacacaaattatttgc

SEQ ID NO: 252538 - DNA, 309 bp, Homo sapiens
cgtgagccactgtgcccagcctatctaataatattttaaccagttttaatgttcagtggtattaagtgcattcatatggttgtgcaaccatcaccactacccatctccagaactttctcatcttcccaaactgaaactgtgtccccaggaaacactgcctatctgctttccaagtccctggcactcaccattctgttgctatgaatgtgacaacaaatctagtctgggcaacaaaacaagaccccgtctctataaaaaataaattaaaaattagccaagcatagtagtgcacacctgtggtcccagcta

SEQ ID NO: 252539 - DNA, 542 bp, Homo sapiens
tctcatatcccagagtattcaacatcgacttacattttcattaactgatgccttgtgcagttcttcatttcgtgcacattagctttacttccaagtgctctgcaggctcctataaaccagagacctcacatatctttcttctccactccctatgttatcaaccacagattaagttttctaaaaccctgctctgatcattgatacaaatgaccttcctgtccaggcttccaattgcctatgaaattaagcacaaactccttagcacgacagttaaaactctccataatgtaattcccaaccttaattcttactacttagtgcccagattaatgcttggcatagagtgcctgctccatcaatgctccctcctgctctccctctctttgctatctctcatgcccttgccaaactggaagagagaactgagaacaaaccactgggtttgacaattatcaggtcactcatgagcaatttcagtgtcgggatggagacaaaagccagatagcaggaactgaaggagtacgtacgtcatgaaaaaaata

SEQ ID NO: 252540 - DNA, 225 bp, Homo sapiens
agtcaaaaggtttcagggtaaagagttaagaatatatttgttacccaaataaattcatccaacttgtttctttttgaaggagatggactgtagaaggctgctatatttgggtagaaagatagggtcaaacagttttcaaaatatgtttatctctcctttgtctattctgtatcagatcatttaaaggtatattgtttgtaaatattaaaactgtaacaaattata

SEQ ID NO: 252541 - DNA, 357 bp, Homo sapiens
ctgaaaccccactcaagcctcccctttcctcacgaacaggtcctctgcccccctatttagattcacatcctcctaccccagccttcttctgtctgggatcccccaaggtagaatctgagctgacacttctgggagaaaggttcttcatggtcttctctttcattaagccaaactactccttgctgtccagaaacgggaatgcttcctaagggtagttttctgggtggtggggtggggtttgccgggcctattcttgggggattcagaacatgctgtgaaactactggtggcctggcctctcacagtgggaataagtccttcctctggctacagagccacactgctccccccacctcc

SEQ ID NO: 252542 - DNA, 472 bp, Homo sapiens
tctgaagagaagagagaaatatatttgaaaaagtgttgaaaagaggctgaaaccaatgaggcaataccaaaagtgccaacttgtgcatagttggattcccagatggagggagtggaaagcgagaataagacagacaaaacataaataaataacataaacataaatgtaaaaacagcatagccaggtattcctccaaattattaaaagttgtatatttatatttcaagaatcccagcaaaactcacacagtgtaaatgtgaagaaatctatgcacaggcatatcatggtcatgattatcaaaagcagaattaaacaaaatcttatatgtgtatagagagttacacatagaggaacaaatgggccaatattttcaaagtgctgacagaaaaatactaaagacttggaattccatactcagtgaaaattaatgtcctttaacaataaaagttaaataaaaacttcttcagacaaa

SEQ ID NO: 252543 - DNA, 438 bp, Homo sapiens
tagagtccatgttacccaaagaagagagagctactaaacctcccagagagtcctaccagatctgagatctatgagaccaagtattgggtcttgttcaagactctatcctcagagtccagcacagcagatgccaatatttactaaataaatcactgaaaaaataaaagataactataaatattaaacgaaataatgtttataggagccccttaaaagctgcaaagtgttgtatacatagtcattatgctgacaattgacctctactttgagtgtctgtggttcaagaatggaatgaatttagcaagggcttatggagccaaagccttctgataagccaagactaccatttagtaagatatccccagagagattatgggctgacatgagttagaagtgatagtttcactcaggagttggatcactcaaccctattacacg

SEQ ID NO: 252544 - DNA, 322 bp, Homo sapiens
gctccacaagtgctgccaaagtgggaccccaggcagaggaggcgccgagagcgagccagggctgtgaggactgccagcacgctgtcacctctcactgtgaaattggaggaaaactcatctgttgaagtcaaggaggaaggtagaatgatcagagttttgaagaagtgttcaaataattaattgctgggagtcctaagacattacggaagtatggtacatttgttgggctgtattgaagacacaactaaggtatgggataattaattcttagtggtctaaagcttgtgttgactaaattgtttgttttccaggtagtgttcaa

SEQ ID NO: 252545 - DNA, 401 bp, Homo sapiens
tcattctctccctggagaacgcctgcggccccaaagccaggcctactgatttccagtgaggccacaaatcccctccctggttagcaattcagttttcaccgccttgggggagagggcctgcccttccttgaggggaagaacctggaaggctcggctcagtgtcttctcttggaagagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggcggaggtaggaagattgcttgaggtcaggagttcaagaccagcctgggcaatgtaggaagacttcatgtctacaa

SEQ ID NO: 252546 - DNA, 592 bp, Homo sapiens
  misc_feature (584)..(585): n is a, c, g, or t
  misc_feature (587)..(592): n is a, c, g, or t
gtgaggggtgaaactggccccccatgggtagccgcagtctgccagggcctcccccaggatccccagccacctcccctatgcaggagcatgcagaggctggggtcaggtttggcttgccctggagcacaggaaatgccccatttacacatggaccggaggccagtgtctttcgcaccaggatcccggcccccaggctcagaacttgaatatctgggccatgctctccaggagtctctctgagaaccaggccaaagtagctgcttatggtctaggatacacctaaaataggagtgggggcggcctgagaggtgaatttccctgggctggtgcatgggctgggcttgtcctggagcctccagtgccggcactcatacagggacccctgccggggccaggagaaagccgttgctgtgtgtagcctggagagtgcgtcgtcacgtgacagatgcttgtagccacccgggacctgcgaaaagcctgcagctggtgatgctcccctcccaccaaggggtgcagagctggaggattgctcataaattgttcctgccctgtccaataaataaaatatgccttctggggcgcannannnnnn

SEQ ID NO: 252547 - DNA, 466 bp, Homo sapiens
gatatcctacatgaatgcacatgagtgagtgtgcattaaatacggtgattcccagcccagagcttttgtacccccaggggacactggcaatgtcaggacatctttttgcttgtcataactcaggtaaggggtagggtttgctagtggtttggatgctaccggtatccagtgggtaaaggccacagagtctgctggacagcttacaatgcctaggatggccaccatggcagagtcatccttctgaattgtcaacagtgctggaaggagagctggagaaccctgggctgtgtggtctgtttgcctgcagacatcagcaggacagccccatgggtgtagcaaagggaataagcacacaagcaagaagagagttttcaactaaaggacgatcaacgttaaaacttgttcagaagtatagcatctattattcaatgattagtaaagcagaaaataaagtcaaaaaaaaaaa

SEQ ID NO: 252548 - DNA, 189 bp, Homo sapiens
atatttgtaaatcattttaacttgccattgtttttgtttccctgtaattatctttcttgggttctttgccttaactttggccctaaaatagtaataattggtgagagttttgagtttggagaggataaagaaattgtcacggtgcagactcttgagataaatcaatattgttaagaaacttgaatgaga

SEQ ID NO: 252549 - DNA, 469 bp, Homo sapiens
tttctgcttttaaatgtttgcaaacaatagcagtccatgtcacatgttttattctttttagattaatgaggtggcctgttcaagttagacaggccatattaatttcagcgaatgcggtccttagcaccacaaaagcaaacaaatgattttaactcaactggacaaagagtcttggcatagtaggtgcgtaattgttggtttttggatttgactggagagtgagagttgtgattttgattctccaaaagcagactatatgagcaccaagtatattttaggtcatttagaaagtttgttgtttgaacaaatgaggataagacatccatcagtttttgacactgcaccaaatctgcttgatttcaaaaggaactaactaaacactccatcacaagagtcctgacaaagatgcacggatggctatattaacgagactgtgtcaaaatgaataataataaatggctgtcttgag

SEQ ID NO: 252550 - DNA, 598 bp, Homo sapiens
  misc_feature (4)..(4): n is a, c, g, or t
agtntgtgcttaaactattgactggtaggtctactgtatataacatctaatatatatatattataggccagctacaaggggtttaaatattgaggactgtgtcttgaaaactaagtattggagtggattttcttctgctttcatagctaacagttattgcatcatgtgggtggggtcctaatccaataggactggtgtccttatatgaagagacaccaggagcacatacacacaggagaaaggccatgtgaaaacaaggttgccatctgcaagccaaggacagagtcctcaccaaaaaacaaccctgccagcacctagattttggacttccagactccagaactgtgagaaaactaatttctgttgtttaatccacccagtccatggtattgttatggcagccctagccaactaatacaaaagggaaattcgtattttaagagggaatattgtaccatgtttattttctgaagtaagcaatctgggagagggggaaattactgacgcaatgtttttgggcagtggctatagaatgggatttagtacatgggacaggagttggctcttgataggaatttaggtagatgtgtacatgtgg

SEQ ID NO: 252551 - DNA, 291 bp, Homo sapiens
tcttaacaagcttgagtgcagagattgaagagtcaaatctgaccatgatgttgatgttggataagagaattctctgctccccacctctaagttgcccgccaatcgaaggcaacttagtgtggtagggaaatctgtatgaatgaagtggtgttgatttaaactgggatgtcttgagttgagagagagagacttaagctatatgaggctgaagctcaggggagagataggggttggagatagaagagaaacaggagacatcaacaggagatggtaagtgaacgcagtggggaa

SEQ ID NO: 252552 - DNA, 562 bp, Homo sapiens
caacatctcattttgtcacccaggttggagtgcagtggtgaggtagaccaccagaggcactagcaatcccaaattcccttgatgtctctctaaaataataattggttgcagttggccccagggaacaggtgtctaccactagacacaaacacctgaaactgatcagcagcttcccgataagatctcaggggtagggcaggttggctcaagcatgcacccgaaaaggaaaaatggcagagtttaactggtatatgaccttctaggggcatcccactggtaagggaagaatgcctcaagggagcatgtatacagccccagtgaacacactgcgcatgctcacctccccagtgctagaggccactgcacatgcaggcagcccactccaagggaacaatcgggagaagggacgcaagacccaggaagcatgccaatgaataaaaccccaagtcaaaaggtcagacggtgctcttgatctctcaagtcgtgtctttggcccttttccaagcatactttacttcccttcctgctctaaagcattttaataaacgttcactcctgctct

SEQ ID NO: 252553 - DNA, 419 bp, Homo sapiens
agcctcaaccccagacctctgtccctaaatccttgctccagataaagctgaggagcctgtgccagtgctgggttgttccttcttgggcaggccttactgggaccaagaatttaccagctgtcagaggactgtgtctcctggagctgttcaccagccagggctcagccctcagagcctcatctgggcaaggacagagctttcttcacctgacactcagagtggagaggatagaaagacaagctttgtaggacatcggcttaggagagtccatagaaagtctaatgtccccagaagcagaaacagaaggagaagatgtacctggtagcagattgtccacagggatctgatgtaaaggtgttttctcatggaagcaaattaataataaatgctgtttgtgtgaaacctccactgtgccaagc

SEQ ID NO: 252554 - DNA, 417 bp, Homo sapiens
tatgtaactcacctcaggtcgtgcaccagtcatggcagggacaggcttcacacagaatttgcagccttggcttagctcccaaacaacattgccttccctttctagtccccagggttgacattctctaaaggacactggaaagagccaggaataagaaagctgatggtgagatctctagagaaggcaaagagtcctgatcctcagcagtttccaaagcataggacacaatgaaagcttcatgactttgaaaagaacagagggctgaggatccagaaaggagacatgagtactggtgaaaagtcctctgtggatgcatctgaatgtccttctcattgaacctgtcactctccccactcaacagctggagggccactgatgtgttggagaaaagaataaataaaagagagaagctacagg

SEQ ID NO: 252555 - DNA, 453 bp, Homo sapiens
actgaagtccctagttctagatgccatcaccctcaccctacttcagaggctgtaccaaattcttagaagagaaattttgcctcaaaagcgacctgggaacctgacctcaggaagaatttcatctctgtgggaatgtggaatcggagtgatagaggtgaatgacaaggatgtggtgttccttaagctgactcctgatgagcttggcgaaatgaagccagacattttataattggtcccttttctttgtgtagtgtctaacactttttgaatacctactgcatgtcagtgccttttcccactgaggatcgtactggataactttggatctaaggtcgctttggcagtgagaagttcccgcctctgagtcaagaccacctttgagtccagaaatggtggctcacgcctgtaatcccagcactttaggaagctgaggtgggagcttggcccaggagc

SEQ ID NO: 252556 - DNA, 327 bp, Homo sapiens
tgcctcagcctcccaagtagctggaactacaggcgaacgccaccatgcccggctaatttttgtatttttagtagagatggggtttcactatgttggtcaggctggtctccaactcctgaccttgtgatccacctgcctcggcctcccagagtgctaggattacaggcatgagccattgcacccagccagccaaggcctgatgttttatagttacagagtcctctgatgagaactgatggtggaagagtgtgcttgtttgtatctttatctggttggatgcagtctttttttttttggggtactacgcttgggcagggtaccggagct

SEQ ID NO: 252557 - DNA, 305 bp, Homo sapiens
caggcccagcaggttaccgacagaggcaagtaagaatcaaatggtgtcaaggacaaccaaaaagaccagtgaatttctaagcccatcatccttgggatcccatcaaacaatcacgtgatgaagaagaggtatagatgtcttcactttcactacttgaaaagagctgttctaacagcaagggcaagtgaatgcaacaactgccataaaagggaggatactgcctaagttcgcagtaaattaagaatagttaacctggagtcctggatagctgggcagggtgaataaaagcaaaaacaaatgtacct

SEQ ID NO: 252558 - DNA, 405 bp, Homo sapiens
ctttatttacttttaattattttctcaatctaccatgaagttcaaaaactagaataatataccttttcctgaatttgattttgttttagcaaaaaccatcacaagataattaatgagctccaggctgttgaatatcagtgaaaaaccaaaaggaaagttggaaatacctgtacacctggcctaggaatatctagataacaatatttttattttatttctactaatttgctctaagattttgggcaaatttctgagccttggtttcctcatctacaataagagttggtaccttctgtcatcttattctttgatataaggtttgtgcttttggattccacgattcttcttgggctttgtgtccccgttcattggctgaacaggaaaaattaaataaacatgatattt

SEQ ID NO: 252559 - DNA, 368 bp, Homo sapiens
acgcactctcccctttatgattctactgacccatggagtttttccgtccttgccattttggctgtttttgactcactagaagttgtttttgaagccagttcctagtcatgaaactaaacatgaaatgatcgctctggtgaagcaaaagcatcaaacaaatgacctatcaggatccaagagcagccatgcagaaagcccatgggctgaagcaggtggtggcctggtgctgctgctgatcacctggactactgtgggcagctgacatcacctcctgagcatcactttcttcatctgtaaagtgaattcggaagtgtcaagtggagttgttgtgagaattaaataaaacaagccagcttttctagccaaaa

SEQ ID NO: 252560 - DNA, 460 bp, Homo sapiens
cctcggaaagaaggaaagaagctggtgtcaaaacccagagagagacactatgaagagctctccctccagcccccaacccggagctgtggccttccaaagtgacatgcagctaacccacagtgacccagcaaatggagttgagagactggacaccccagcttgactctcctctctccctccagtttcctacctggcccaccattaactgatcccaagccagagggcaacagagtccatcaagacagtctctgcaagtcaaacccgtagcacagagagcagggtggagaagcactgggaagggggtgcaaacagaagctatcccatacccacacaaggcccttgctgcactgtgagatgccccttatatggctggccattgtcccaccctctcctctgaagctatctggggagctagggttcccccactcagccactgttataaagtcatttttgtccaaag

SEQ ID NO: 252561 - DNA, 521 bp, Homo sapiens
taggcctacacagggtcaggatcatcagtgtcactgtcttccatccccacatcttacgccattggaaggtcttcagggggaagtaacacatatggagctgtcatctcctatgataacaatgacttcttcctgaatacctactgaaggacctgcttgaggctgttttccaattaactttttaaaaatttgtaagtataaggagtacactagcaaataatgatgagaggtgcagtatagtaaatacattaattgttaacataattgtttatcattatacgactggcagtgcagtaggtttgtttacaccagtatcaccataaacatgtgagtaaagtgttgccctacaatcagtgaaagcctcaactacaatgtcacaagacaattggaactttatagctctattataatcttaggggaccactgtcttatatgcagttcattgttgactgaaatgtccttacgtggcacatgactgtattatttttccctataccaactacttaagtatggctttaaaaaaa

SEQ ID NO: 252562 - DNA, 317 bp, Homo sapiens
taaaccctgtcaagctgcttacctgtgacctgcccaggtaaagaggagtatagacacagcaacagcccgtgggtgcctgggccttctacatgatgacagcagggtcagggcagggcacgggaatgaggggtgggcacagataactgaatgccccgagagcctttctttcctttagtctgccacagttggggtgggcgattaaaggaaagaaaccctgaaaagtatataagctttgacaaccaggagatttggcttcaaatcctgcttctacaacttcttagctgttggcctgtgggcaatttattccacctccctga

SEQ ID NO: 252563 - DNA, 423 bp, Homo sapiens
caattactaacagacctaacaaatgagatagacagcaagacaataatagtgcgggacttcaatactccactgacagcactagacaggtcatcaagacagcaaatcaacaaagagacaatggatataactacgccttggagcaaatggacttaacagatatgtacagaagattccaccgaacaaccacaaaatacacattctatacaacagcgcatgaaactttctccaagataggccatggaatgagcctcaataaatttaagaaaattaaaattatatcaagcactctctcagactaaagtggaataaaactggaaatcaactccaaaaaaacccttcaaaaccatgcaaatacatggaaattaaatagcctactcctgaatgagcattgggtcaaaagtgaaattaagatgaaaattaaaa

SEQ ID NO: 252564 - DNA, 650 bp, Homo sapiens
gcctgggctggccttgagctcttgcactcaagtgatctgcctgccttggcttcccacagtgctgggattgcaggcgtgaaccactgtgcatggccgggacttaggatttttaagtgactaacagggtcccagtccgggaagcccctgactagcattaaagggcagcctctggagggtgaggtcagcagggtctaagatgcaggaagcaaagtcctggctggaccagggcggacagtgtgcacccggccagcactgatgttcacagggcagcctctggagggtgaggtcagcagggtctaagatgcaggaagcaaagtcctggctggaccagggcggacagtgtgcacccggccagcactgatgttcacagggcagcctctggagggtgaggtcagcagggtctaagatgcaggaagcaaagtcctggctggaccagggcggacagtgtgcacccggccagcactgatgttcacaggggtcgctgcttcttcctcaccaaggctggatctggggtgctccttcccaatcctctggcttcttcagtgcccagagctgagtcctctcaggccacggccagtgtctgtgcttggccttcccagacggcctctggctccggattctggtgccaggtcagggcgggcccgcccaca

SEQ ID NO: 252565 - DNA, 436 bp, Homo sapiens
agagcctattctccataaggtgatgttgggccagctgatctctcttctctaaagcctgtaaaactagagactgtgaggatggagagctagttactttcttctggactgggagaggacgatagttgacagagaataaaattgttaattttggggctggacgcggtggctcacgcctgtaatcccagcactttgggaggctgaggcgggtggatcacctgaggccaaggagttcgaaaccagcctggccaacatggtgaaaccctatctctactaaaaatacaacaaattagccgggtgtggtggcgggcgcctgtaatcccagctactcctgaggctgaggcaggagaatcgcttgaacttgggaggcagaggttgcagtgagccaagatcaggccactgcactccggcctgggcaacaagagcgaaactctgtctc

SEQ ID NO: 252566 - DNA, 473 bp, Homo sapiens
gaagaaatgagaaagtgaattatggttatttgagtgccatgaacccattggtagacctttgtgaaaagaaagccaacaatcttactactataagataaaaccaggacacttaaggtaaaatactaatttgaatgaattgaaaaaggattatgtaaaagattttaaaaattcaatacaaaaagcccccatattataagtatttgaacaataaatactattttcatgtttcatttgcaagtggcaagtgacaactgcattaccttactttcatgagatggtgacagaatattccatgccaattccatgacacaagttgtagttaaaaatacacttctatggctacattgcgctagatactttatcagttttcaataaagcaaaactagcaaagtcggtatgtattcaccacatttaaaaatttggaatttgagtcctggagcttaaatattaactcatgctaagtgtaggagctg

SEQ ID NO: 252567 - DNA, 400 bp, Homo sapiens
gttctttgtgatatttcagcgacttgctttttgtatgtagtaaagagtttatatttaaataagacagtgagactaccttggggaggtcatccaaatcccagtcaggtggtgggtgagtgctggggagtctccccaagaaagcaatgagacatggatgctccatggcttgatgatggttaggattggtggcccaatttcacaggttccctggtataggttctttgtgcattccacctgcccaagaagttgtctaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagta

SEQ ID NO: 252568 - DNA, 249 bp, Homo sapiens
ctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagta

SEQ ID NO: 252569 - DNA, 2353 bp, Homo sapiens
gcagattctccaggcccagcatctgcctcaccgtggccccccacaagccaagcgcctgcctttcagcagcctctacacacccagctcctgccacccaatggctctttaggccaagctcatacctcacgatgatttttccaggcccaacttttgtctcatggcaaccttccctggccaagtttccacctatttcctggcagcctggacaggcccaggtcctgccacacactggcctctctacgcccagctcatgcctcacagtggcctctccaggcccagctcctgtcccgggacatcatctccaggcccaaaacttcctcaagtcggcctctccaggcccagttgctgcctcccggcattctctccaggcctagctcttcctcctggctgtatctacaagaccaactcctgcctcacaacaaccttttatggctcagctcctgcccaactactgccggcctttgtaggcccaaaacttcctcaagtcaagctctttaggcccaccttctgccttgcagtggcctgtacagacccagctctggcttgagaacagcctctgcaggccctgctcttgcctcttagctccctctccaggcccatctcttgcctcacagtggcttccgtgggccaagttcccgcctgcctcccagcagcctcaacaggcctagctcctccctcacaatggcttgtttaggtccagttgatgcctctggcaacctgtccaggcccagctcctgcctcacactggcctctctaggccgaggtcctttctcatactggcctgtttaggcccagctcattcctcttgtcatctctccaggcccagcttttgcctgttgttggcctctacctcacagtgcaccttccagtcccacctcttgcctcaccatggcctcctctgaccaggttcctgcctttcggcagcctctacaggcctagctgctgcctcccaatggcctttgtaggccacgctcatgcctcactgtggcctttccaggcctagctttcgctttttggccactccaggcccagaacttcccccagtcagcctctccaggcccagctcttcctcccagcaacctctgcaggcccaaatcatcctcaaattggcctcttctttcccagctcctgcctcctggtggcctctgaagacccaaatcgtcctccagttggtttttccaggcccagctcctgccttttggtggcctctccaggtgcaaaacttcctcccatcagcctgtccaggcccagctcatgcctcttggtggccttctcaggccctgcttttgacttggtggcctcttcaggcccagaacttgaactcaagtcagcctctccaggcccagctcctgccttcttaaggtctgtacaggcccagcctctacctcacagcggactctccacacccagctcttgcctcactgtagcctccccagtccaaaactcctgccttttggcagcttcgacaagcccagctcctgcctttcaatgacctctttaggccccgctcattccttacaacggcctttccaggcccagtttttcccttttggcggcctctccaggcccagaacttcctcaagtcggcctctttaggcccagttgctgcctcctggcatcctctgcaggccgagctcttcctccctgctgtgtctacaggcccaactcctgcctcacaacaacctccttggactcagcttctgcccagctcctggtggcctttgtaggctcaaaattttctcaaatcaagctctccaggcctactgtcagcctcgtggcagcctaaacaggcccagctcctgcctgacaatggcctctccaggcttttctcctgcctcgcagcaggctttccaggcccagctcttgcctcatggtggccttccccggccatgttcctatctgacttctggcagcctcaaccggcccagcttctgcctcacactggcctctctaggcccagctcctttttcacagtggcctcactacgcccatctcctacctcagatctgcctcccaagacccagctcctgtctcatggtggtctctcttacaccagctcctgcctcacaatggcctcgtctggcccatcttctgcctcacagtggccactcaaggcccatcttttgcctcatggtagcctcttctggttttgctcttgcctcacagttgcctcttccagatccagctttaagcctttgatggtcaacagcatcaaggagcctaaagcttccctggactctcatttgttcactttacagcagagtgccttagcaaaaactgtctcttaaccttgagagtggatttctgacaaatcgatagtaaattctgcctgtgtggtttcaaaaaaaaaaaa

SEQ ID NO: 252570 - DNA, 401 bp, Homo sapiens
tcttcaaagatgtatctacaaatacgtccatgacagtggtatttggaacatcaacaaactggaaacaacctacatggccaataacaggaggacacagaaacagagtttgataaatccaaacaaaaggatgctttcaatataatatgatgtgaaataaccccaaacatgtatgagagccttcacccgtatgtgtgtgtgcgtgtgtgtggtcattctataaatacacattgaaactatcctaatgtattagcagctattacctctggacagttgcaatcttacgcaagattttttaaaagtaatttatacttctttttaattttcatttccaagtcttctgtgataaaagtgtactgcttttagaatgtgagaaaaagcaataaaaggcattttaaattgca

SEQ ID NO: 252571 - DNA, 405 bp, Homo sapiens
attgaaagaaagtacagaattcaaactaaggtgctttgatgcaattcacctgttccatcttcttgatgaaacactagttgctctgtgtctgtcattagcgattccgcaaggcatgtggtgataagacttccagattttgaggatatgtccagtaattgtgcttgaacattgtaatgggtgtgacggctgccaggtgcctcatttggggagtaggggacaactttctggctaggtcattctttccaaagacatgtactctctgcttcctctgtgtgtagcccagcatactgggacatccatatgactaaggcttggggagtttcttgcagagtggtgtggtggcacagatcaaaatcttggtagaaaagtgagcccaggtagtcacaggcttgacccaagcctgga

SEQ ID NO: 252572 - DNA, 345 bp, Homo sapiens
agtttacagcttgggggaaaaagtagtaaaacaaaactgcctttattcacagacaacatgattgtgtgcatagaaaatcctaaaaatctacaacagagctgctaggactaatgagggttttaatgaggtcttaggaaataatatcaatatataaaattcaactataattctatatactaacaaaaaatattaggcaataaaaattttagatggtatgtacagtagtatcaacaaatattaaatgcttctagataaatttaacaaaatatgtagaagacatgtacaatgaaaacagaaatacattgctgagaaattaaagaccaaaataattggagaaaaaacaag

SEQ ID NO: 252573 - DNA, 170 bp, Homo sapiens
ttccctccactctccccctccatacgcaccccgccgccccgccacaaacccacccccttgccatctgtagggcaaccaagtgttctgatgccgccctcggagcttccgcccatggtttatgttaagagtaacatttaacttctgttgattaaaaaatcactgctatgaaa

SEQ ID NO: 252574 - DNA, 193 bp, Homo sapiens
ttttcaatgactttacaacttttgaagagcactgctgtggatacacagaagagagtgattctcaaccacaaagaaatgaaggtgacggggtctgtgatggggacttaaatgaacaagaggtttagaaacactaattcaagtctatccccttcataatacaaataaagaacctatgacccattagacctataaa

SEQ ID NO: 252575 - DNA, 413 bp, Homo sapiens
gctgcagcagacacaaccaactttcccgcggcccaaagacagttctgtgtctgtggtgtgatgaggattttattatcacaagtggctccctatgagaaagtcttagctgtatgaaggaaattccctcttctgttcagaactgtcttaaaagtaatccagattattagaaaaggaaaagaaaacatagtaatagagattattactaaaacccaccaaatcgtacactttaaaagggtgaattttatggtttgtgaattacattgcaattttttaaaattatactcagcaaatgaagaaaacttggctaaactaaccacaaagagtttaaaattccaaatatttgagtttaaaatcccaaatcccaaatattgtgggcaatccacatgattaaaattaattccttttttttcctc

SEQ ID NO: 252576 - DNA, 445 bp, Homo sapiens
  misc_feature (4)..(4): n is a, c, g, or t
  misc_feature (34)..(34): n is a, c, g, or t
  misc_feature (38)..(38): n is a, c, g, or t
  misc_feature (46)..(46): n is a, c, g, or t
  misc_feature (58)..(58): n is a, c, g, or t
  misc_feature (67)..(67): n is a, c, g, or t
  misc_feature (72)..(72): n is a, c, g, or t
actnccgcattctcagcgtcgcacactccatcancaancagctctngaacgtcgcatngcacgcgtnacgtnaagcttggcacctctcagagcggcccgctcactcactcactcactcgagaattctcggatcctcgctgccttgagggtccatcctgtgcccacacggtcttgggtaccttgtgcactggacacagatgttttacgcccagactctggaatcactgccaagttcaaatcccagctattccagggaccaggccagtctgcttggcttctctgtgcctcgatttcctcctcagtataagacaggtgataaggtaactgctcacagagttatttaacacgttttaaaactgagaatggtgtttgacacataggaagcatttatttgtcagcaagcttttcacccgtgctgcaatcctgaggaggactctgcaatgcc

SEQ ID NO: 252577 - DNA, 272 bp, Homo sapiens
gttttaaactcttcttggaaaattttcatgaaatatttcacatatcttcctttcttggtacagtggaaatataactgctttgaaaattctgcagtacgttgtgtttgatatgatgtcactaaacaatgatatttcatcactgtggaaggtacaggaatttaaattttatctccttgattatgggattaagaaggaagctgcatgcttccgtaaatatcttaatgtttaattcttaattgtagatgtagaaataaaagcatttaattatcata

SEQ ID NO: 252578 - DNA, 232 bp, Homo sapiens
taaaaatgttttccaacaattggtttgtttaaactacaatctatacacagttcacatatgacatttacttgttaggcctctttttgtccaaaacgatgcggttccatacagcagcctctggacacatgtagctgatgagcagataaaatatggctagtccaaattaaggtatgctgtaagtataaaatgcaaagtggatttccaaaacagtattcaaaaaaaaaagaatgca

SEQ ID NO: 252579 - DNA, 631 bp, Homo sapiens
ctaagccaattgttgctgagtgcttgcctgcctatctaggagttcccagtgtagggttaagaggcttaggaacaaaatgacaggaagggctccagggagccttatcctcccagctccaatcacaggctctgtcagctgtgggaagagccttgacacccagacaggaccagtgctctggggacaacagtccctgccctagtcctctgctcctcacatctctccagttgcagggaaaagggctggcatctggccacagggagcctgagccggcggccagggtccagtggaccgactctgccccctgctggctgagaagggtcctgccagctcccagccagaggtggccaccttttgggagagggggacccaccccactgaagatgtgcacccactgtgtagctgaccctgggccaggtgctggacatcagtgaggggagctgaccccctaacggctcatgaaatgtcctcaagttcactcctggcagtcgagactaagcattcattaaactaatattgttgagcatttctagtgggccagacattttatatgcattactcattaatttccacagcaggtggatgttataattcccattttatagatgaggaaaccaaggttatataacttgtt

SEQ ID NO: 252580 - DNA, 352 bp, Homo sapiens
cactaaaaaaaagacataaaatattaaactaatgtctaggaaagctttggatggtaataaattgggagggttaggccaggtgccggtggctcacgcctgtaatcccagcactctgggaggccaaggcaggtggatctcttgaggtcaggagttcaagaccagcctggccaatatggtgaaaccccatctgtactaaaaatccaaaaaaaattatcaggcatggtggcaggcgcctgtaatcccagctacttgggaggctgaggtgcgagaattacttgaacccgggaggcggaggttgcagtgagccgagacggcactccagtctggacaacagagtgagattccatcttaa

SEQ ID NO: 252581 - DNA, 789 bp, Homo sapiens
ttgtgtccccccaaaattcattcgtttgatgccctaacccctgatgtgatggcctttggagataggacctttgggaggcattataataagggttagaagaagtcctaagggaggggccctcatgatggaattggtgcccttacaagaagagacaccagagaattcatgcgtgctgtctcccttttcccacatgcatgcaccaagcaaaggcatgtgaggacacagaaagaaggcagccacctacaaaagccaagaagggagccctcaccagaaactcagctggtggcactttgaactctgatttcccagccttaaaccacccagtctagggtatttggttatggcagtcaggtggcagatgtcaacttcaacgtaagaatctgtcttgtaagaggcaaaggaggcattctttaggctgcacaggaatgggaggctgtgatgattccagcaactggaagtggggcagaaagggtaactccagacatgactacccgtacttcacagctaccaagaggctcccacacaacagctcacactcactttctacaactcagagaaaatgcctttcgtgtaatttgtaaaattggtacttctcttcttaattctgtaattctaacatggtcatatcagtcaagtttctgtcacctttcatcatctgtctccttatttctgcctttgagtagttggtttgtttcgtaactttaaatgaaatgttttccttctaaatttcaagaagccaggcagtacagtattccatcagctactttatacactactttagctgcataa

SEQ ID NO: 252582 - DNA, 382 bp, Homo sapiens
aggagatggaggccaggatgttaatgatgatacaaatgtttccatctttgggtccgaaagaacagtggtactagtaacactaagagtaaataaagcagctgggcgcggtggctcactcctgtaatcctagcactttgggaggccaagtcgagtgaatcacttgaggtcaggagttcaaaatcagcctggccatcatggtaaaaccccgtctctactaaaaatgcaaaaattagctaggcgtggtggtgcacacctgtaatcccagctactcgggaggctgaggcaggagaatcgcttgaacctgggaggcggaggttgcagtgagccgagatggtgccattgcacactagcctgggcgacagagcaagactctgtctcgaaa

SEQ ID NO: 252583 - DNA, 138 bp, Homo sapiens
gggacaaagatctgagggtgtcggacaaggtaaggttgttctccatgtaactgttcctgttccaacgcatggctggggggagggcgcagcttccaaacccacagttctccctccaccacctcccaccagatgctccta

SEQ ID NO: 252584 - DNA, 157 bp, Homo sapiens
ttgggtaggcagggaatattcttatgctggcaatagctatctgttaacactagcttgacattcacttacttaaagtatataatcactgtatagtgcttagatcaataacaaaaacagattgacaatctattaaaaataaattatttaaattgaaaaa

SEQ ID NO: 252585 - DNA, 327 bp, Homo sapiens
gcctgcctcggcctccccaagtgctgggattacaggtgtgagccaccacgcccgaccccctcttctaaggacatttgtcatcggatttagggccctcctggattattgaggatgatcctgaggcctttaacttaatggcctctgcaaagatccttttttatgttttgagacagggtcttactttgttgcccaggctagagtacaatggcatgattatgatcacttgagcccaggagaacaaggctgcattgagccattatcgtgctactgcattccagcctgcacaacagagcaagatcctgcgtcaaaacgaatgctgggtgcagt

SEQ ID NO: 252586 - DNA, 214 bp, Homo sapiens
ttcacatgcgtacatttgcacaatgtagaaaacaaagatgacacgagcctgttcacttctccacatgcctgtccatctccccctgcccctatcaacatgtcttgaaggtgtggccactggccgtttgcatcacctttctgtctacgtagcacctgtcagtgacccctgaccccagagcacctgcccttagccttgagaagcctgtattttccct

SEQ ID NO: 252587 - DNA, 418 bp, Homo sapiens
tttcgtggaataagcctgttttcaaatggggcaagatttcacatttcctttcccttcccctacccctgtgtctcctctttgtaagaaatttattccctcctcccccaggggtgaagggaaactaacatacaatggtagctttcctgtgacctcgctccctgctagagaatctgtgatccactccaacttggtgtctgtgatcccagcttggctcagtgaacctgaccaagtgggttgaccttttgatcaaatgtgcagtttacctctcatatataggtctgtgagatgcatttttatgtagcctctatcttttatgatgaatgatgttttaaatgcagtatgtgtttatcacattgccacagatcgatgatgtgggagatagtgaacaattggagacacctgagtgcctctgggggac

SEQ ID NO: 252588 - DNA, 421 bp, Homo sapiens
aggtctggggcagggtggggagcctgtattgtaacaagcacagccaggtgattctgatgggcggatgagggaatacactttgagaaacacaggcttggtggagctaaaccatgattgggtagggttggtgacagctgtatatgatggctcacctttctgatgaaaaaaaaaaaaaaagtctgcaaatactcagcacctactgtgtaccaggcactgtaatgtgcactctctggagtcacagacataaggaagttagatctatccaaggaaagggccagtagtctgacgtgaccaggaagagtggacagactgagtggtaatgtggagttgaagagtggtaggtgataaggttaaagaagaggtgggtttggacagggcgcctctaatcccagcactttgggaggctgaggtgggagaattg

SEQ ID NO: 252589 - DNA, 428 bp, Homo sapiens
agaaaccttgctctaatagaagctttctggtagcaccaaaggcctctctgtcctttgtagcacttgccttggctataattttgcatttattggtatgattatttgcttactacccatcaagtcccaggatgccatttcttggctgtgtgaccttgggcccctgggactgcctttcagaacctccatttccttcatctgcaaatgggattgtaaatatgtgataaattcagagttgaggttaagaccacaggctccagagttaagacgtacctgtgttcaagttgcatctctgctagtggtgaacttaggcaagtcacctgatgaacctcagtttcctccgctgtgaaatgggtctaataattcccttcctcattcagagggtgaatatgggaattaaaggagctcataatggtgaaaattattttatt

SEQ ID NO: 252590 - DNA, 149 bp, Homo sapiens
aaaattaccaataattgatgaccaaatccgatggacccttcttcactcacttcatgttcctcaaccactaagcagcatttgcacagttgaccctcccttcttgaaaaactctcagtcgggtgtggtgggtcatgcctgtaattccggca

SEQ ID NO: 252591 - DNA, 511 bp, Homo sapiens
ttgataagtctaaatttttcaatgtaatcaggaatttctcatgctattactaagagtcatgtattctcctgctatactcataaccttgaacagactctgtgtctgattaaattcatgtactcttttcaacaggtttgacttttgggttatctttagataaagcccatttatgggcttcccataaagagaagcaattacactgcaggaagttttctttgcctttttggtacttggcttaaaaaaatgaagattttacattttattaatagcaaaataatttctatattatattcgtaggtttttgattctttaggaaaactaaaatttaaaagggctaaggtatttatattcatataactttgtgtattgcttttaaagtcttttaattatcaatctttggttaaatgaacacattttttgttttggtgaaatgttttgaaccttttaacatctttaataaatattcttgaaataaaaaataaataaatagaagttattgtttgaggataaa

SEQ ID NO: 252592 - DNA, 870 bp, Homo sapiens
cgtcatacgcagcgccctttgtgacaccagggccctggtgctttaactagggcgttgggacctgttgcccacacagaccgccctgcagtttcagactggagggcggtggacggctactcagcggcccaactctctcgcagcccttctctccgcaaaatgtcagcctccacctcctcgcaccggcccatcaaggggatcctgaaaaacaaaagctcgtcgggttcctcggtggcgacttccggtcagcagtctggagggactattcaagatgtgaagagaaagaaatcccaaaagtgggacgaatcaagcatccttgcggcacaccgcgcaacgtacagagattacgatttaatgaaggcaaatgagcccggcacttcctacatgagtgtgcaagataatggggaagattcagtgcgcgatgtcgaaggagaagattcagtgcgtggtgtcgaaggaaaggaagccaccgatgcttccgaccacagctgtgaggtggacgagcaagagagcagtgaggcctacatgagaaaaatcctcctccacaaacaggagaaaaagcggcagttcgaaatgagaagaaggcttcactacaacgaagaattgaacatcaaattagctagacaattaatgtggaaagagctacaaagtgaagataatgaaaacgaagaaacgccacaaggcacgaacgaagagaagactgctgcggaagaatcagaggaagctcctctgaccggtggactgcaaacccagtcatgcgacccttagaagatgcctgcttcacccttgcaattgtttgtgaatatgtgacgcttagaagatatctgcttcacccttgcaattgtttgtgaaatacaaaccttgttactgtaa

SEQ ID NO: 252593 - DNA, 923 bp, Homo sapiens
cgtcatacgcagcgccctttgtgacaccagggccctggtgctttaactagggcgttgggacctgttgcccacacagaccgccctgcagtttcagactggagggcggtggacggctactcagcggcccaactctctcgcagcccttctctccgcaaaatgtcagcctccacctcctcgcaccggcccatcaaggggatcctgaaaaacaaaagctcgtcgggttcctcggtggcgacttccggtcagcagtctggagggactattcaagatgtgaagagaaagaaatcccaaaagtgggacgaatcaagcatccttgcggcacaccgcgcaacgtacagagattacgatttaatgaaggcaaatgagcccggcacttcctacatgagtgtgcaagataatggggaagattcagtgcgcgatgtcgaaggagaagattcagtgcgtggtgtcgaaggaaaggaagccaccgatgcttccgaccacagctgtgaggtggacgagcaagagagcagtgaggcctacatgagaaaaatcctcctccacaaacaggagaaaaagcggcagttcgaaatgagaagaaggcttcactacaacgaagaattgaacatcaaattagctagacaattaatgtggaaagagctacaaagtgaagataatgaaaacgaagaaacgccacaaggcacgaacgaagagaagactgctgcggaagaatcagaggaagctcctctgaccggtggactgcaaacccagtcatgcgacccttagaagatgcctgcttcacccttgcaattgtttgtgaatatgtgacgcttagaagatatctgcttcacccttgcaattgtttgtgaaatacaaaccttgttactgtaaaaaaaacacaaacaaacacaacacacaaaagagggggcgggcaacaaaaatcc

SEQ ID NO: 252594 - DNA, 339 bp, Homo sapiens
aaaggacttagaatccaagatctgggtgctagatgtgcttgaggtgttgtttcctccagatcttctcaactgacagagcagtgaaatatatgtgtgtagggaggatggggagaacaatttttttaacacatatgaatacttacctggcaggggagataccatgatcacaaaggtggtttccccagggtgaggcttatccattgcactcccgatgtgctgacccctgtgattcccccaaatgtgggagacttgactgcataatttgtggtaatgggggactgcatttacacttttccctgtaaaaatttttaaaaataaataaatacataaataataaat

SEQ ID NO: 252595 - DNA, 385 bp, Homo sapiens
cgagagaagaaagtccctatttagaagaaaatatttgctccatcagagcaaaatgcctctacatttctgcctgaaaccatctatatttctgaacagggcttgctccaccctacagtggaggagtggactccaccctgcagaaccttggtctccagcccagccgtgacctggatgccctttccctgcctctggccagcccagatgcattccttcctgcaaacccagctcaagtacgtcttctccacagcccgtggtgcaccttgcctgcctcccgtgtctcctcctcgctgaagtcctccggcatatccacactatttggggctgctttaattggtcctcactggtattttgtcttgagaaagtcctttggttgttgcatgtgttt

SEQ ID NO: 252596 - DNA, 795 bp, Homo sapiens
ccacacgaaaatgtgtttacaaatgttcatagtagcattatttataatagataaaaagcggaaactacttaaatgtcagtcaactgagagaacaaaaatctggtaactccacataatggaatattattcagccgtaaaagcaaatgaagttctgatacatactacaacatgaatggacaccaaaaatattatgccaagcgaaaaacccagatgcaaaagaaccacatattatattacttcatttatatgaaatgtctggaataggcaaactatagagatagaaagtagtgatttttcaggggctggggcaagggggagtgggaagtgactattaatagttacaggtttctttttgggatgctgaaaatgttctgaactctgaatatactgaaaaccactaagttgtatactttaaaaggggtgaattttatggtatgcaaattatatctcaagttgtttatttaaaaaatttgaaattgaaaagtttttaaaaagagcttaattggtctgagattaagctgcagttggcacttcataagtgccagttccatgtttctttcaaagcttttttaaaaaaatctttggtatttaatgtttactgtgttcagtattttgactttatttttatttttatttttgagacggagtttcgctcttgttgcccaggctggagtgcaatggcgtgatctcggctcaccacaacctctgtctctactaaaatataaaaattaggcatggacagcctctaatcgagctactcaggaggctgaggaggagaacattgaacctgggagc

SEQ ID NO: 252597 - DNA, 989 bp, Homo sapiens
aggtcaccccgactccctgccctccccagtgtggttatttgagaaaaggcagcttgggtgagggggaagggattggggctgagaggggtatagtctgcctccccacccacggctggtggaacctgagggcccccggcgccaccagagcttcgtggcttaatgggggaggcgaggagccactgcggacctgctcgggacagtgaagggcgccagtctcagccctcatctgaaacctgctccgtgaccctggactagttcctgctcctctctggacctcctggccctgctcctttctggctgagtaactttggagctgtgccctgaaaccctctgccctgctgaagaatggagaggactcccccaccagcacctccacctaggacacatgggaactgtgggacttggagcaaagttttcaagtctctgtgccttagtttcctcacctgtgctgttctaggcgctgaggatgcagccgtgcacaagacggatgaaatccctgccctcagggggccgacatttgcggagtaaataaaggaaaggccaacatgaacagctgatttggataccatcaagacacctgaaattttagcatgagccagatgccaaggaagagactccgggaggatcctgaggacccccggttgcagccatgtcgaggctgatgctgaggaggaacccaagctgtcaacgagaaacaaccgtcgaacaacagacaaccagctggagacagatcaagaagctgtcacagatgatggacgaaaacctgaggaacgcggacaagcatcagaatgagtcatggtagctatgatagtggaatcaccattgcgtgagtattccactacaagacagggctgacacaagacaaacacgtactactaattaggcctattcacaccaatcttggccgggcaatacagcctgcatgtaacaacccacagacacagtacaatgatcgtcccgatcacagattatcaatacaaactccacat

SEQ ID NO: 252598 - DNA, 941 bp, Homo sapiens
aggtcaccccgactccctgccctccccagtgtggttatttgagaaaaggcagcttgggtgagggggaagggattggggctgagaggggtatagtctgcctccccacccacggctggtggaacctgagggcccccggcgccaccagagcttcgtggcttaatgggggaggcgaggagccactgcggacctgctcgggacagtgaagggcgccagtctcagccctcatctgaaacctgctccgtgaccctggactagttcctgctcctctctggacctcctggccctgctcctttctggctgagtaactttgggaggcaggggcagtattatcatctccattttacgaggagggcaagcaatgtacccaagttcccacagctaaaaagaattctgtctgtcctcagagctgtgccctgaaaccctctgccctgctgaagaatggagaggactcccccaccagcacctccacctaggacacatgggaactgtgggacttggagcaaagttttcaagtctctgtgccttagtttcctcacctgtaagttgggggaatgatagtaactgctcttaagagctgctgtaggaattgagatcttgcatgaaaaaggataaaaccaattgatatggtttagttcttagtccccacccaaatctcatgtccagttatgatcctcagtgtaggaggagggacctcgtgggaggtgattggatcgtgggggcagtttctaatgttttagcaccatcctcctagtgctgcttgtttaaaagtgtgtagcaccccaccttcctctcctgccggccatgtgaagacgtgcttgcttccctttcaccatctgccatgattgtaagtttcctgaggtctccccagaagcagaagcctgtatagcccacagaatcatgagctgattaaacctcttttctttataaattaaaaagtctca

SEQ ID NO: 252599 - DNA, 787 bp, Homo sapiens
ctcgtgccgaattcggcacgaggaaactccatctcaaaaaaaaaaaagtataggctctggacatagttccactgtttcctacctccaggaccctgggcaatttatggactctgccaagcctcagtttccttatttgtaacatgtgaagtacagtacttaccacgactggcgcagagtaaatgctcagtaaatcactcattcacttattggacaaatactgaatgagcacctattgtttgccaggtgctgttctaggcgctgaggatgcagccgtgcacaagacggatgaaatccctgccctcagggggccgacatttgcggagtaaataaaggaaaggccaacatgaacagctgatttggataccatcaagacacctgaaattttagcatgagccagatgccaaggaagagactccgggaggatcctgaggacccccggttgcagccatgtcgaggctgatgctgaggaggaacccaagctgtcaacgagaaacaaccgtcgaacaacagacaaccagctggagacagatcaagaagctgtcacagatgatggacgaaaacctgaggaacgcggacaagcatcagaatgagtcatggtagctatgatagtggaatcaccattgcgtgagtattccactacaagacagggctgacacaagacaaacacgtactactaattaggcctattcacaccaatcttggccgggcaatacagcctgcatgtaacaacccacagacacagtacaatgatcgtcccgatcacagattatcaatacaaactccacat

SEQ ID NO: 252600 - DNA, 419 bp, Homo sapiens
ctcgtgccgaattcggcacgaggaaactccatctcaaaaaaaaaaaagtataggctctggacatagttccactgtttcctacctccaggaccctgggcaatttatggactctgccaagcctcagtttccttatttgtaaaatagggaaaacaatagtactcacatcacagggctgttgaaaggattaagtagatacacatgtgaagtacagtacttaccacgactggcgcagagtaaatgctcagtaaatcactcattcacttattggacaaatactgaatgagcacctattgtttgccaggtgctgttctaggcgctgaggatgcagccgtgcacaagacggatgaaatccctgccctcagggggccgacatttgcggagtaaataaaggaaaggtaaatatcttccacgtcagattg

SEQ ID NO: 252601 - DNA, 728 bp, Homo sapiens
ctatggccggtctggagcacttcaccatcgcattccaggacgactccccctcacaggaggccttgaccttcacaggatcgcggcacacacctgcgcagacccagcgactttggagttcccgcgtctcttccccatgtctgcagtcggagggcgcgggtgggctcctggtcgcggcccggcgctcttcgtcctcgcccttctccgcccggggcgcttgctgaccctagagtcttggacagtggcgttgggagtccccagcggcctgggaaccagatgaggctggaaggaggaagtggctgagcgaccagaccgttgctgtgtgcagagcgagagcggggcagaggcggtcgagcgctcgttttccgggcgacttggctgaggggcgagatggtcccttggagagaacagccacgggccctgggccgaggggctccaaacagcagtcgctaggctgttttggtcgtcgggctttatcagtaaacaattcgagcccatggttcgaatgattatttaattaaattcctcagtaatagatccagtgcattgtgaaaatatgcgaaataaaatttaaatgatgagataaaataaggaatcaaatacttcgttgttataacaaccaagcaattaattagcaattacataattaaatgaatgtttgtaaagaacaatgcaatggaatatatatgtattccatctatatattccatctctatattccatctatatat

SEQ ID NO: 252602 - DNA, 1006 bp, Homo sapiens
gagacggttgcccagagcaagcccatgtagcatccctggagggcctcatccctgaagataaggttgtgcttctggcaggttctcccttacagaatgaagccaccctgggtcagtgtggggtggaagccctgacaaccctggaagtggttggccgcaggctaggaggtgagtggggctacaggggccccaaactggtgtccaggggcaattcacgacacttagacttacttggtttgccctgcacggtgtgttacttttttttttcttttttctttagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaggtcaggagatcgagaccatcctggctaacatggtgaaaccctgtctctactaaaaatacaaaaaaaaaaaaaaaaaaaaaaaatttacccgggcgtgggggggggcccattttttccccagttaccccggaggttggggcgaaaattgggttaaccccggggggcaaacctttgaaatgaacgccagatatccgccccattagaacttgcgcctggggcaccaggacgaggaagatccggtttcaacaagaaaaacaacacaacagggggggaaaaaccggcgtcgacttgggcgcctgtgtggttcccccacttttagcgaggcaactttgtgcccccaaccgaaagtggggggcgcacccccttggggaagaagcctccaaaggtgttgaccaccacttcttcacacgatcctcctcttgtacgagggccacgagccacattttttcaaaacgaggggtgtcgccacggggctttcccttctacaaaaaaggggcgatccttcatttcggggccacgagtgtctccacgaaggtggccaacagtcaaacgtgtcgttgtacgccccgctgtttccagaaaagtga

SEQ ID NO: 252603 - DNA, 1166 bp, Homo sapiens
caagtcgcctacgtgcgcgcccgggagctgcacactcttgaagtgaccggcctggagacggttgcccagagcaaggtaaagataatgatgtatccctgatcatccttaccccagccactacttgcctttcctcctgtggcttccccagacaacactcttgactctccctttcctttgaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggaggtgagtggggctacaggggccccaaactggtgtccaggggcaattcacgacacttagacttacttggtttgccctgcacggtgtgttacttttttttttcttttttctttagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaggtcaggagatcgagaccatcctggctaacatggtgaaaccctgtctctactaaaaatacaaaaaaaaaaaaaaaaaaaaaaaatttacccgggcgtgggggggggcccattttttccccagttaccccggaggttggggcgaaaattgggttaaccccggggggcaaacctttgaaatgaacgccagatatccgccccattagaacttgcgcctggggcaccaggacgaggaagatccggtttcaacaagaaaaacaacacaacagggggggaaaaaccggcgtcgacttgggcgcctgtgtggttcccccacttttagcgaggcaactttgtgcccccaaccgaaagtggggggcgcacccccttggggaagaagcctccaaaggtgttgaccaccacttcttcacacgatcctcctcttgtacgagggccacgagccacattttttcaaaacgaggggtgtcgccacggggctttcccttctacaaaaaaggggcgatccttcatttcggggccacgagtgtctccacgaaggtggccaacagtcaaacgtgtcgttgtacgccccgctgtttccagaaaagtga

SEQ ID NO: 252604 - DNA, 949 bp, Homo sapiens
caagtcgcctacgtgcgcgcccgggagctgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggagttcacaatgtctaaaagtcagctgattttgtgttaaaattcagtgtctggctttgcttcaaaaattgggaagatcggccggacgcggtggctcacgcctgtaatctcagcactttgggaggccgaggtgggtggatcacgaggtcaggagatcgagaccatcctggctaacatggtgaaaccctgtctctactaaaaatacaaaaaaaaaaaaaaaaaaaaaaaatttacccgggcgtgggggggggcccattttttccccagttaccccggaggttggggcgaaaattgggttaaccccggggggcaaacctttgaaatgaacgccagatatccgccccattagaacttgcgcctggggcaccaggacgaggaagatccggtttcaacaagaaaaacaacacaacagggggggaaaaaccggcgtcgacttgggcgcctgtgtggttcccccacttttagcgaggcaactttgtgcccccaaccgaaagtggggggcgcacccccttggggaagaagcctccaaaggtgttgaccaccacttcttcacacgatcctcctcttgtacgagggccacgagccacattttttcaaaacgaggggtgtcgccacggggctttcccttctacaaaaaaggggcgatccttcatttcggggccacgagtgtctccacgaaggtggccaacagtcaaacgtgtcgttgtacgccccgctgtttccagaaaagtga

SEQ ID NO: 252605 - DNA, 455 bp, Homo sapiens
ttggagaagtgagccgagccgtgcagcgccgcgaagggcatccccgaagaccgggaggaacgccgcggggacctgtggcttagcgcgctccgcccgggcttgtctgcccgcgggggcgcagcggctgaggcggctccgggccggagttccaatcaagcgccacccaactcccagtcgggggccgaggccagcgccgggatgccagcttcccccaaaaagatcctgcctcagggaaatgcatggagccggcggaaaagcccgcggcgcccccggcggatcgcagaccctaagggggcgggaggtggcgccccagtcccaacctcttgagccaacccagtgggtgggaagtgcccttaccctaggccttccgcaaagtgttctctccttgtattattctaattacggtatttttaatttccttaaaaaaataagaaacagaaaagcacagaaagcac

SEQ ID NO: 252606 - DNA, 477 bp, Homo sapiens
agggtagaatccagccccacaagcggcggcgatgctaatcaggccgctaagatggaaaagcatccccgaagaccgggaggaacgccgcggggacctgtggcttagcgcgctccgcccgggcttgtctgcccgcgggggcgcagcggctgaggcggctccgggccggagttccaatcaagcgccacccaactcccagtcgggggccgaggccagcgccgggatgccagcttcccccaaaaagatcctgcctcagggaaatgcatggagccggcggaaaagcccgcggcgcccccggcggatcgcagaccctaagggggcgggaggtggcgccccagtcccaacctcttgagccaacccagtgggtgggaagtgcccttaccctaggccttccgcaaagtgttctctccttgtattattctaattacggtatttttaatttccttaaaaaaataagaaacagaaaagcacagaaagcac

SEQ ID NO: 252607 - DNA, 515 bp, Homo sapiens
attgcattttactttatgtagtatgttgtaacctggtgcttcattcattagattggtgactgaggtatttagtcatggtgaggatgggaatcttcagagatacattctggatttgtggaataaagtgactagaaaggttcttccagagcaaccccttgtttaaagttataagtgtttatggtacctgctaccccttctggaaagttgtcggctttgatggtttagatgaccttaccccataaggccagcttctagcctccctttggaatatttgaggtgtgtgatgttttagtgggggcagcatttgagagacgagcaggcccgagcacccaggctggctgtcagaccgtgtgttgtgctgttgggtttgatgggatgagatatccagggttttacttcctataatgggatctgcaggctccttgtgaagttcagttagacagtagcctgtgacgtagcaagtcaagttttcgatggcccctcattttttttttatttagtgcttaaaaaaaaga

SEQ ID NO: 252608 - DNA, 497 bp, Homo sapiens
cagtatgtactacaattaattttatacagctatgattcatactgcatctttacatttgtttaaatttcttgtaccacctcaagtggcaccatatgtgtctgtgtttactaagttttgatacactttaacttcttataatttctctatattttataatactaaatgataaaatagactatatatgttttatgcattcataatatacctaattttttcttttcctttttttgatgtttcaagactacatgattcatctgcaagttttttcaaattgtcacaaatctccaaaaaaatttccaacatatttattgaaaaaactgtatgtatataagtcaacttgttcatttccaacctgtgttgttgaaaggtcagctgtatgaggttatcgtcaaagatctttaaagaaagaaatgacatcatcaatattttgaaaattagagaaagccatttctaaaggaatcctagaaatgacttcaggccagaattagaaaaaaaaa

SEQ ID NO: 252609 - DNA, 363 bp, Homo sapiens
ataggttctttatgctagaacacacagcagttctgaaaccattttaaaacttgctttatctcgagccccttaatttggaagctcttcaaaaacaaaagataaactttcttgatagaaagactcctcattgccatataacacctgaccataaaaagaaaaacaaaaaccaaagaccttgtttgtcaaagctttttaaatgttttaacctgtggcttatatagggaaacattatttttggagaggaaaaatttgaatttcttttttgttccaaaagatttttaaagcctgtcttgaagttatattctatttgtttaaagtttactatcttttgaaataaaataggctattatttgaaattatatg

SEQ ID NO: 252610 - DNA, 398 bp, Homo sapiens
gcttcccggtaagggtgtatttattatttaatgagaagaccttgaggagggggtaccaaaaataaagtagaggcaggaattccaagacggcacaatatcctgatttggtggcacaaaaatatattcgtggaaacaaatctactggaattgtcttgtttgggggcttgttttacatgtgttttatctcactatgttgtcattatgcagaggtcttctatgtctttacccttttagcagcagatcttatttttcaaattaaatctcacatggtaccctaatacataaactacatgaaatcaaggtgggaaggaaggatgccttgtcctggtaccctgcgccctcaacttcctccattctttcaggtgaagcttttatgccagctggaaaaacccattggc

SEQ ID NO: 252611 - DNA, 252 bp, Homo sapiens
ggtggcctgaacttcccagtgtggctcgaagattaaccacttcagagaataccagatcaacaccgtgttttgcatgcctgcaccttcggagaggaagctgttatttcagaagccaggcagaacaaagggagtcatctggtgcgatcctagtaattagagagaagaggcccctcaggtgactgctgagaaagctcccttaatttgaccctgtttcacacagtccaattttcaataaaaagagacacttcagca

SEQ ID NO: 252612 - DNA, 460 bp, Homo sapiens
atatgaactccagctcttcaggcctctcttcgagaacaccacctctaactcatcaggcatctgccagtcatctactaaagagctctgctttgaaaagactcctcatctactgagctaagaaatacaagtacgtataaaggcataccttggagatactgtgggttttgttccaggtcaccaaaataaaacaaacagagcaataaggaagctactggaagatatgctccaccaaaatgaagaataaaatcgagaaagaatatgacatgagatgaaacacaaaagaggagggacaggaactcccaggagaacaaggtggaggaaacccagacgagtcatgagtgtgtttgctgcctcatctacagatggaggggggccaagctcctgttcagcatcacctgtaacaagaaggcattgaagaacatgaatctttcaaaataaaatggtctagttctgcaaaaaa

SEQ ID NO: 252613 - DNA, 446 bp, Homo sapiens
atcaggaagggggcatcttcccaggacacatgatggtagtctaggcaaaggttggcaattgctaaatgtcacaaactcatcagtgggcttttagatttctatctagaggcaaccagaagccatggagacagtggctttgggttgcctctagatagaaatctaaaagcccactgatgagttaaggcatatagttaagcacagcgcttagcaaaatagggagtgctgtgtacatcattgtcattcaagatgatcgttctctccaggtctggctgatgtgaggggtgcaggtggtgtctgcttagaatttctgctgttcctgagggagtatctgcatttcccacagatatactgtctgattagaattatcctctgattcctttggtcatcaggtattcactgggcacctgctgtgggcaggactctgagcaaaggttctggagataaaa

SEQ ID NO: 252614 - DNA, 617 bp, Homo sapiens
aaaggaatataatgacagggactttaccagctgtttatgaatatacaatcagatattaaagtatattataaatgcacaacaatcttaaaggtatagtaatggcacagaaagagacaaaacagaaagaacaaaagcaaactctatctctatcgtgcaagaatgttgacatttgaaatcagtgatggaagagtagataaatggtgctgaaaataactgggtaaatattggctaaaatgatcatcccattttcatgcctttcatcacaaataattcttgatgaaaaacaaaataaactacacattcacattagtagaagaaaatggttttctttcaacattgaaactctaaaggaaaatattgataaattaaactatgtaagtttattttaaaaggcgtttttgaattaatgagaaaaataatggcttataaaatgtaatgacacaattgactaaccatatgggggagaaaatgaatctgatacctgcctcactccttatcacaaaaagcctttcaaatgcaccagaaatataataatttctatttataataaatgaagattcagtaaagattatatttttaaaaaattgttctatattgtaagactaaaggataagaag

SEQ ID NO: 252615 - DNA, 384 bp, Homo sapiens
gacggagtctcgttctgtcgcccaggctagagtgcagtggcgcaatctcggctcactgcaacctctgtctcccggcttcacgccattttcctgcctcagcctcccgagtagctgggactacaggcacccgccaccatgtccggctaatttttttatatttttagtagagacggggtttcaccttgttagccaggatggtctcgatctcctgaccttgtgatccacccgcctcgacctcccaaagtgctgggattacaggcgtgagccaccgcgcccagcaacaagtgtttcaatactctatgtattgtattattttattggtcacatttatttcaattctgagaacttggataccttatgagccccttctttctaacagtactc

SEQ ID NO: 252616 - DNA, 315 bp, Homo sapiens
gagtgcatggactgtaatttaaatagtgttttctctcacaggtggtagttaaaatcttgagaatggatttggtttcagggagagattgtagagagagtaactataggccatacccacagagaggaggttggagaaattattgaaggaggcatgtggatctcagagctaagagcaaggaaggagttctttttaaaaaagttacatatagttgtagattctcaggggcccagtgttgttattaagctaatttaacagcatttacagcaaataataagcacctacttctgggaattctggcagaaaataaataattca

SEQ ID NO: 252617 - DNA, 330 bp, Homo sapiens
tccactgcaaatctggatgtggaccatcttctatcagagacagctcaggctcaatccctaaattaatggcaagcaagacgtagacaggtgtgacttcttagagacaggctggactgctgctgctctgtccttgggtggcgccagcccttcctttattctttcccagtcttcttatccattgcctgtagcccaggaccagtgccaagcctgtagcttccgcatggtgttcctctcccttccggggatcttcatgtaggtgctgcacggagaaagaagggccctgagaagagaggctgctgtcggcacaggagccgtgagggtggcggccgc

SEQ ID NO: 252618 - DNA, 425 bp, Homo sapiens
aatctgacggctgtggcaggaaagtcaggggcaagaattgttgcacagatatgctaatatctcagttctgccactttctgtaatctcgggtggtgatctaatctgtctaaggtctattttcccatctgtaatggggaaaaaaatcatccctggagttattggcaggattaaatgaggtgatattagtaatgcaatagtcaccaccatgcccccacgaaaactaacattcattgagaccttattgtgttgggcattgtgctcaggacttcaaatgggtgacttcattacatcctcaccatcacctgcccaggtaggcatcatgtattacctgcaacttacagataaggaaaccgtcttagagaggttatgcaacttgccctgccaaaattgaacccattgtgaatatacagtagataaaaaaaaaa

SEQ ID NO: 252619 - DNA, 392 bp, Homo sapiens
gccattttgggggcgtcgcggatggtcgcgagtgaccgccggccaagatcccgggagccgtcggccagagcatcttctgggctctgctagaaaacagcctcctgcctcccgtttactccaagggaatcgccggccagggccctttctgtccttcacctacctctgcaggaaccagaatgctctttcgtcactttctgcagaaaatatctccgttgtcccccgacgtcagagcctcctgcacctcagctcgtctcccttttccctgacccgaaccagaaccctgatcttggattctcttttatcttgtggcctccgcaatcattttgcagcctgacatctttttctatgtaatatttatcaccttctagttaataacataattttaaaaatca

SEQ ID NO: 252620 - DNA, 320 bp, Homo sapiens
taagtccttattttttagagatacatactgaagtatacacagaagaaatgctaaggttaaatatcgcttcaaaatattctgggagagagatctatgtacaaagtgacatacaattggaaatccatttttgttgtaaagacattgtttttcagacttttcagatcaattagaaaaatgtcattgctttaaaatcatagctgttctgtttaagaggaattgaatttaaaaatgagagagtattaaaactcatgtggcagtatcctggtcttaatcaggtattgcagtgttcaaacaaggtatggacacatcaacatattcac

SEQ ID NO: 252621 - DNA, 332 bp, Homo sapiens
aggccctcgctgcagttgccagcaggagaaagaatgactcatgcctgtgatttgctggtcacctgtgattcccgcctccgggagaaaactccaagtagcaggtgttgacccagttgtgtgggaggaatcacccaggcccttatttccaggttgcacttacagatcggattgtgcaaccagaaaaatgccgtcagaaggaagtggggtggcttgggggactgacttactaaggatcactgttaagctctccatacaaattagctccccttctgtcttagtccactcgggctgctatagcaaaataccataaactgcatggcttacaaactgca

SEQ ID NO: 252622 - DNA, 925 bp, Homo sapiens
caactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatgtgcccacaaattaaagccgaccggcattact

SEQ ID NO: 252623 - DNA, 446 bp, Homo sapiens
caaacaccacatgttctcactcataagtgggagttgaacaatgataacacatggaccagggagggaaacaacacacaccgggacccatcggggactggggggcaaggcgagggatagcattaggacagatacctaatgcatgtggggcttaaaacctagattacggttgataagtgcagcaaaccacaatagactctacagatattaaaatgattttaaagtaattaataccttataaatgtggcaacatgaatcaaatggacaattctttgaaaggcacaatctatcatggttcactcaagaagaataggtaacctaggccaagcacggtggctcatgtctgtaattccagcactttgggaggccaaggtgggcagagcacttgaggtcaggagtttgagaccagctcagccaacatggtgaaaccccatctctactaaaaatcc

SEQ ID NO: 252624 - DNA, 432 bp, Homo sapiens
tccttggggatttaggaggcggagcggcgcccccttgaggccacatggtggaggcagcgatgagacctggagtctaaaattcagactgaatcacaggaagaagctatttacacaagtcaaacatggtccaatcttggcaatttcataaggttccaatccttaagggatcaaaacctggccaactgcttccaccgagaggtgtgcctttcaatgccaggcttggagtgtccctctttatttaaaaaggagaggattccacagcagagcttctcaaactcttccacccaaatcccctcaccacagagggacaggagtcctgggcatgtagcctaaagcagccaggagaaaaaaaccttgaccttaatttttttaatgatttcacatgaatcagtggaatgtgtttatgataaaatcatctcctcctgaaataca

SEQ ID NO: 252625 - DNA, 353 bp, Homo sapiens
ggagtcctcaggccagtggcgccctgcccgttctcccgctccggccggggcaggcagcctctgcgcgactccacgtactcccagccctccttggagtgtcgcgggcctgggaggggcctacagagctgtgatgatacctgcattccaggagtcatggaggggaaaggaaggctttggaggggctgggagctggggtatctgcaggcctgtctgctgacacacgtactggctgaactggtacgtggcggggaaccacctctccagccttccgtaggggcgctcggctcttgttgctgggccccagcagctcctggccatacatcaggtcgacgcgcctccagccacaccgcccg

SEQ ID NO: 252626 - DNA, 444 bp, Homo sapiens
ctcaaaaaaaaagaaaaaaacaactttccagttcacaaaaggagtgctttcactgaatgcaagaatagattttccctcttggtgtgtaaagttctcagtcatctgaccctctctgccaagagagcccttcccgccccatttctgcccgtttgggctcctcttcctggagaggctgctccctggtgctgtcccgtgctcccagcctgtcttccttcagggtccaggccggaagcctttgggggcagtgttggggctccgcatgtgcccagtgctcagcccagtgctggggcagagatggtgctcaggaaagatcttgaaaaatgagcaggtctccagccgaggggaatcttacaccttccacctgtttcctcaggattgcaggagctcctcagacaagatctgtggcaacagtaacaataaaagcatcccatgcggaccaaactc

SEQ ID NO: 252627 - DNA, 446 bp, Homo sapiens
ccaacaaccacatccctcctctatagaagcccctgagaacacagctcctcaccatggactgtacctgggggatccacttcttggtggcagctgccacaggtgtccattcccaggttcagctgttgcagcctggggctgaggtgaagaagcctgggtcctcagtgaaggtctcctgccaggcttccagatacaccttcaccaaatactttacacggctcacatggaagagacttgcctcatctcaaatgagaccttggactgtggacttttgagttaaggctcaaatgagttaagactttggcagactcttgaacaggcatgattggttttgaaatgcgacagcaatcatgactctagaggaccacatgtgaaatgcaacaagcaggagcagaagacaagtaattcattatttcactgtagtgcattaaaatggtagactcacagaa

SEQ ID NO: 252628 - DNA, 456 bp, Homo sapiens
ctactctgcctgttgcaaggccctcccggcccaggcttgggagagaggtgtgccctacactgccgtgagccctgagtggacccagacggccagagggagcagccctcagcccagactccacagcgcagcccagcccgtccctgcagccacgatcggagtgctacttggcacacagaccacagtgaaagtggagaaactgaggcccagcagcaaaaagtgtctcgtcgaaggtcacgaaggcaggaaatagcagatgccaggagggtcatggcactcagagatgaaaggagtccctcatgcccggcactcccccgcccaccagccatcgtggccatcctgggcacgtgagcaccactgcgccagcccagcctggagcctggtactgctggccttggcaggcagacattgctggtcaggaatgcagaatcggcctttaaatacctcagcaatttcatg

SEQ ID NO: 252629 - DNA, 350 bp, Homo sapiens
gcgccatccagctcactgcaacctccacctccctgattcgagcgattttgagtggctgggattacaggcgtccgccaccacgcccggctcatttttgtatttgtagtagagacggagtttcaccatgtttcccaggctggtcccaaactgctgacctcaggtgatcttccagcctgggcaacagagtgagacgccatctcaaaaaaaaaaaggaaaaaagaaacataaaacaaaggtgggagcctagatgtttctttgtacagcttaggctaggaaataatgagcactagtgtcagacaggtaaaccaagtctgaggggcaatgcaggcaaaaacaagttcctctccccc

SEQ ID NO: 252630 - DNA, 656 bp, Homo sapiens
actttttcccttgcctgcaaggaaaatcagtcaagatttctactagatcatcgcagttttgttgacctagaggtgacacatttgcattcttgccttctacttattttttcttttcatttatattttattaatctatttataaaagcagtagcccatgtcccctgtagcacattttttctttccttctctcttcattccctccctggtattaagtactttacattgcatggaatagagacattatgatagcctttaagtaactgagtttaaggatttacaggaaaagatgattagatgagacttttcaccaggtctcgtagtgaaaagaattaaccgtagagccgaactacacgctccgtcagaaatgtgtgcctctaactaggtgctgcagctcacacctgtaatcccagcactttgggaggccaaggtgggtggatcatgaagtcaggagttcgagaccagcctcgccaagatggtgaaaccccatctctactaaaaatacaaaaattagccgagtatggtggcgggcacctgtaatcccagctactcgggaggctgaggcaggagaattgcttgaaaccggaaggcagagtttgcagtgagccaatatcgagtcactgcactccagcctgggcaaaagagcgaaactccgtctc

SEQ ID NO: 252631 - DNA, 772 bp, Homo sapiens
ccgctcagcgccttcaacgccgtgtcccggcaccccgcacccgggcacacaaaaaacgggtcgcccgcgattctcagggattgatcgcctcttcagaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaaccaaggaatactttgagagttggggagaaagtggagaaaaaaatgtgtttgaagctctttctgaagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatatttctataaggcaatccagaaacgcagacagtctccagaaaaaatttgatcacattctccaa

SEQ ID NO: 252632 - DNA, 981 bp, Homo sapiens
agtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaaccaaggaatactttgagagttggggagaaagtggagaaaaaaatgtgtttgaagctctttctgaagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatatttctataaggcaatccagaaacgcagacagtctccagaaaaaatttgatcacattctccaa

SEQ ID NO: 252633 - DNA, 706 bp, Homo sapiens
  misc_feature (31)..(31): n is a, c, g, or t
gcgggggggcggggacgagcggggggcgagngtcgggattgggagggaagcgcgtgaaggatctgacgactgggggcgcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataatatcagagcactcatgaaagtagcagtgatgcaattgatgagtcagcatcagctgtctaccagtgtgcttgctagtaaccagacgactatcgaatcagtatttatagatcgacgcacgctagaaatgtgcttcaatactagtatcagtgcgctgctagatatcagtctatgta

SEQ ID NO: 252634 - DNA, 808 bp, Homo sapiens
  misc_feature (31)..(31): n is a, c, g, or t
gcgggggggcggggacgagcggggggcgagngtcgggattgggagggaagcgcgtgaaggatctgacgactgggggcgcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaaccaaggaatactttgagagttggggagaaagtggagaaaaaatgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatatttctataaggcaatccagaaacgcagacagtctccagaaaaaatttgatcacattctccaa

SEQ ID NO: 252635 - DNA, 417 bp, Homo sapiens
taattggacatattctggacagtgtccatcatttaaatttacagtgccttagtgtttatctggtcgtttatcttataccgtgttttgagtttctgttcttttctacaatagctactctcttgaggtatttgcaatttggctgttctcaagttacttctgatgcttccttttttttggtaacttttttttgaagtcttaatagctattttgtttaattgtttggtcatgaaacgaaactgggtttctctcttgaaatgaaacacgaattgaatttactatttttttctcttgtagaaaagtcctccatacattttctccccaattccattccttgggcatgccatagcatttgggaaaagtccaattgaatttctagaaaatgcatatgagaaggtaagtcttccaaataattagagg

SEQ ID NO: 252636 - DNA, 695 bp, Homo sapiens
tggttgttgtttcagcaccattttaaagaatttgaatacaaacaatccctcagcttatcaggttgacatttatgaagctgacctcatcactctttatcttttatgtctgcagtataaatagcatagacatttggtgtgaagggaggagaaaggaagtagtagttctgagaatattcatttgaacagagtgactatggaagaatgaatagcaaaaaaaggagaatttttttaaaaagatctctcactgggaaaagaaaaagttatgcatttataaagtaattaaactggttttccttgtactttattaatctgaatctaatggcacttccttacgagggttttcagatgtgcttgtagttaatggcaacattatcagaatgactacacagacagtcctactctgaggagatgactttggaagaaacccatttggaactacacaccctgctatgtctgtggagaaatggaactgcaatcctcaagagtcacacttcatattccttcctttcaagtggttgataaaaggtagtgcttcaagcacaggatttatggaatagttggcaaattaaacaacatgctttttattttgactaccatttaagtggaatctttgaactttttttttgacatgtgaatctctaatgtggtgagagagaaaaacataaaaatataaaaacattcaagcaatcgactat

SEQ ID NO: 252637 - DNA, 989 bp, Homo sapiens
ggtacccctccgattcgccggtttctctagtgtttcccgtttaaaagactgaattcgagaggtccaccagagcaggatgccgggatagtaagcgtgcacccctcataccccttaccggacaccctttttttttctttttttttttaagagagagtctcgctctgtcaccagggctggagtccggtagtgctaccttggctcactgcaacttctgcctcccaggctcaagcaatcctcccacatcactaagactaaggtacatgccaccatacctggctatttttcctagaggacaaggttttgccatgttccccacactggtctcaaggaatctggcctcccaaagtgctgggattatagccgtgagccaccgcgcccagtggagctgttttaaagaaggcttaactgactgctcaagcttcagttagatattccttcttcctgggtgctcccacaggcccaatactttgtctgtcacagcacctaacatagtgtctgtaattgcttctgttgcttgcatctcccactaagctatatagggaggtcaaatgatgagaagacagatgaagtgtggagaatagaaaagagctggtttagaaaatgagcagcattgagggcccaactgaggttggagaacaacttgtccatagacacatatagtgttgtgattcttttagcatcttggttataggtacttgaatgttgatggatgatttagggttttgcttggcagctgcaatgaaacaatgggagaggggcatcaagaacatacgcaagaatgtggctgaaatggaatgcggaatctaagctgcatggataaggaagattatcggggaacctgccccgatagtcacgtaggttcttttctattttccctaagcgtcggccggtttgagaaataaaaggacagagtacaaaagagagaaattttaaagctgggcatccgggggagacatcacatgtcggtagattctgtaatgccccacaag

SEQ ID NO: 252638 - DNA, 680 bp, Homo sapiens
caacctcaggtgatctgcctgcctcagcctcccaaagtgctgggattatagccgtgagccaccgcgcccagtggagctgttttaaagaaggcttaactgactgctcaagcttcagttagatattccttcttcctgggtgctcccacaggcccaatactttgtctgtcacagcacctaacatagtgtctgtaattgcttctgttgcttgcatctcccactaagctatatagggaggtcaaatgatgagaagacagatgaagtgtggagaatagaaaagagctggtttagaaaatgagcagcattgagggcccaactgaggttggagaacaacttgtccatagacacatatagtgttgtgattcttttagcatcttggttataggtacttgaatgttgatggatgatttagggttttgcttggcagctgcaatgaaacaatgggagaggggcatcaagaacatacgcaagaatgtggctgaaatggaatgcggaatctaagctgcatggataaggaagattatcggggaacctgccccgatagtcacgtaggttcttttctattttccctaagcgtcggccggtttgagaaataaaaggacagagtacaaaagagagaaattttaaagctgggcatccgggggagacatcacatgtcggtagattctgtaatgccccacaag

SEQ ID NO: 252639 - DNA, 477 bp, Homo sapiens
tggcttttgaataagctctatgagacctgcaagttactggacaccaaaggaaaagtgattttaaaacgtatcacattttgaatgccttccaagaagaacggtccagtagatgatggatttgtggctaagatcaaggggattaacagcttcttgggaagtctcccaggaggaaggctggcccgaggggatcagaactgctcccagtggaaagtagatgccacagtgatgtagctctgaaagagagtgcaccaggacaaggagaagttcctcttttaaaaactagacataacacatgctggttgcatgaggaagtggaaggaaaatttattgcctaacaaaatagccattctgctaggaaaacgtttgttaggcctatttgtcatgagaggtaaagtatctagtgttgcctggaatggggaaatattggcaaagaaagccacattgttttacacaataaagtaaatgtgagtcaaaaaa

SEQ ID NO: 252640 - DNA, 405 bp, Homo sapiens
cactgtataatcatggtcattcatttagaaagaaaaaagtaggcaggggaaaggggggaagaaagaaacaagcttaggtagtgatgctcaaaggagtaagttaggcatactggagcgctttaagtgaaggacaatcaatttagcagaattttaacttatttgataaatgtacagatttcttgtaaagttcaccctctactccgcagggctcctggctctgtcacccaatctgttttctttctgtcggtacacctgttgttctgtgatagtttgtttcccctcatctccctcacctctgcctgggttgagtccctttttaagaaaaagagaaaaaaaaaacccacaaaatattgttacactaatgttgtcgtgacattgaattaattaaaaagaaaagaaaagctt

SEQ ID NO: 252641 - DNA, 634 bp, Homo sapiens
gtatacacaactgaatattattcagctatgaaaacaaaggaaatcctgtcatgtgtgacaatgtggatgaacccaaagtcattatgttaagtgaaacgtcccaggcacagaaagacagatactgcatgtcactcatatgtggatctaaaactgtcacaactcacagaaacagaataggacagtggttgccaggggctgggggaatgcagactgtggcgatgctgattaaaggtgtaacttcccgtcacaaggtgaagttctgaaggtctgataaacagcatggtggctagagttaatgttatacagcatggtggccagagttaacattatacagcatggtggctacagttaaaatcatacagtacggtggctctcattaatataacttgaaatttgcgaagagagtagaccttaggtgtctgtatctccaaaaaaaaaggataattgtatgaggtgatagatgtgtattaagttgattgtgtcatcagttcacaaaataaatcatcacgctgtacaccttaaatatatacagtattgttttttgtttaattcatcaatcatacctcagtaaatctgggggaaaaaaacaaaatccataataaatttagggttgatggggtaccgagcccggaat

SEQ ID NO: 252642 - DNA, 521 bp, Homo sapiens
gtatacacaactgaatattattcagctatgaaaacaaaggaaatcctgtcatgtgtgacaatgtggatgaacccaaagtcattatgttaagtgaaacgtcccaggcacagaaagacagatactgcatgtcactcatatgtggatctaaaactgtcacaactcacagaaacagaataggacagtggttgccaggggctgggggaatgcagactgtggcgatgctgattaaaggtgtaacttcccgtcacaaggtgaagttctgaaggtctgataaacagcatggtggctagagttaatgttatacagcatggtggccagagttaacattatacagcatggtggctacagttaaaatcatacagtacggtggctctcattaatataacttgaaatttgcgaagagagtagaccttaggtgtctgtatctccaaaaaaaaaggataattgtatgaggtgatagatgtgtattaagttgattgtgtcatcagttcacaaaataaatcatcacgctgtacacctta

SEQ ID NO: 252643 - DNA, 324 bp, Homo sapiens
ggtagtgactgtgaatgactgtagcgcgtttctcttcgtagctggtgtgagtcctttccatcccagggagcagatcctcccctagtaagtagtcttctccaggaatgcttgcacacaccgtgactgtttccttaaatccctagaagtgggccgggtgtgatgacgcaagcctgtaatcccagcactgtgggaagcagtggtgggtggatcacctgaggtcaggtgaggcaggagaatcacttgaacccgggaggtagaggctgtagtgagccgggattgtgtcactgcactccagcctgggcaacaagagcaaaactctgtctc

SEQ ID NO: 252644 - DNA, 459 bp, Homo sapiens
gatatcacagcaatagtatgcatcttagtctagtttgggctgctataacaaaatatgtgggacagggtaatttatgaagaacagaaatttatttctcatagttctggaggctgggcagtttagaatcaaggctccagcatttgttgtctggtgagggctgctgtctgcttctaagatggtgctttgttgctgtgtcctaacatggccaaaggcagaaaagcaaaaagggcctagctagttccctccagcccttatataaggcctctcatgccattaatgagggttctgctctcatgacataatcacctcttaaaagccctgtctcttaatactgttaccttgaggattaagttttaacatgaattttgggagcacattcaaccatagcagtgtgagagggaaggttaaatgtcttagttaatgttgatttctgtaacaaataaaatctttaaaataata

SEQ ID NO: 252645 - DNA, 396 bp, Homo sapiens
caaaaagaataacaatactagtatgtattggagaaaccaattctatatactgttttttaaagagatgatcttgctctgtcacccaggcatggaaggctggagtgcagggacatgatcatagctcacttcaacttccaattcttgggctcaagcgatcctcccgcctctgtgttctgagagcagctgagaccacaggtgtgtgtcaccacctcacgtggcttaaaaaaaattttttttttaaatgacggtggtcttgctttgttgactatctcaaactcctggcttcaagcaatcctcctacctcggccttccaaagtgctgtgattacaggcttgagccactgtgcccggcccctaattctgtatttctttagtacaaatctgaagagaaaggcca

SEQ ID NO: 252646 - DNA, 395 bp, Homo sapiens
gcgtggccttctgggaactgtagtttccagctggcagaacggagcgccctgggcggagtcacgttgggggcgcccaggccacgccaacgcgggcgcagggctgagtatgcgggaagccacgcagcgactgggcgtactcctaagcttctggaaaggcattctcacgccctgctcctcctaccctcctccaaagttgtacaggagcagtttcctccaattctataactttactataaaacagattagaaattggcacaattgttcttaaatccgtcaccacctttctagtactgtattagtgcctttgtttcaggtaccctacatgaactgttttaagtatggtattttcatatgtcaaacttaaagagtaataaaatcaaacaaatccaaaagca

SEQ ID NO: 252647 - DNA, 1360 bp, Homo sapiens
  misc_feature (18)..(18): n is a, c, g, or t
gtgagccacagcaccagnaccaggggctatttttgtgacccacataggtggcccattcagcctcaaggggaaatccagggtaggaagcagcagctctgctggaactgggctcagcagtcccatttgggatgtaagcctctattgcctctaagatgacccttttcctgtgggttgactgactctgagggcgatttcggaaatgttttcagcagaaatgaaggataagcatcgcacatgtccagcaatgtctttgagaatgcagtcatttgcacgtgagttctcatctttgttttctgaaacagacgtttcttttagtaagtcacaatacatgctaattttcatttctagaatggtcactggcagttctcacttttaactataagaagtcacgtggaacttagtgatttttaacaaatactaaattcatcctcactttatgttgatcttccagcaacgtttatatatttagtaattttaaaaattcctatttgatacaattaaattttatataatgtgttttgcttgaataaaatgttacatttatactttgagaactctgaccaaatctttcatacagatacaggtaaagaaatatttttctaggttgtcggagctgcgtacctcccgctgcttctccttgtggtccagcaccacctgctggtcagtggcagaactgtcctgacttcgtgaacatggaactgctaagagggaaaactgcatctcagcattttcattttttctgaatattaagtgaaaagcaagttctatttgtaagaaatagcttttgctgaggagttgtgaattcctgcacctgtgtttgatgttatttgtatgcaatggattgctggccctttgttcctaagcaagagaagaccaaagatgcttccccatgacctctccggtgaggatccgcaccccccggacttgctctctgatgaagggcatgtcgttcagtgccccagcagtcagaagcagtttttgtggaactaaaactaataatgttaccctcacaaaggaaatgttcttttactaagtaagttattgctgattcttgaatgtctgttatataactgggtcggctatcaagaaggaaggttatatttcttatcacattttaagttgttaagcaaatgtgagtttttttttaagaaatgaggctttcactgagatttgtgtgctattcataattttaggaattactgcttagaacagctgcttgggtgtatttttctacacaggtctgtacttctgccactttctccttttaaaaaaacaaaactatgcatattatgtattaaagttttcttggttttatatatcagagaataaaaacttttttgacttttgagtaaaaaaaatg

SEQ ID NO: 252648 - DNA, 499 bp, Homo sapiens
agaaggttggtgctgtcactctcagttgttcctcatttctacataactggtcaatgcttctacttactgtgggagttggaatgtcttggaaacacaggcgggtcctgagtgtgtgaggagtaggggctcatggtcttagtcctctgtgtaagtaaatgtttggggcaatcacagagcaggcatttgtaggaacctcctttggccactgggaccagattccctgagagcctcattagggacaagaagaacataattgtcccacctaattttggcccctttggaccaaacaacgacgacattcaatattatctaacgtttagataaaactcttggaccaaaacttgtagatattagaaatgaagccatcctgatacagataaatcgcagacaagattccttggaaccacaaacctcctcaccttgtgatctgctcctgtgcccacaggtgtggaaattctgtcatgaaatcctttgcagtatcacttcctttgttgagaaa

SEQ ID NO: 252649 - DNA, 279 bp, Homo sapiens
ctacacttatcactgaattcaacaccattatcttagtcactagccggtaagacaagtgctttgaaggaatataacagctatttataaagaatatgaaaaacttctagggtaagatagtgtgtcaaggcagatcacaaaatcttttaaaataaaaacaaagaattacaacttcgacttatttttcttaaataccagttagcaaaaaagagcaaaagacttcagaaatctatgatgtgttccaacttccaagcagtgtcacccacctaatcagaccgagag

SEQ ID NO: 252650 - DNA, 557 bp, Homo sapiens
ttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagagggga

SEQ ID NO: 252651 - DNA, 446 bp, Homo sapiens
aatccgcaggtgctgggcgcccggtgccggtcgcagtttcaaaagcgcctggaggtgacatccaggagcaccaccgcgccgcctgcagggagacccatggcgaggcgcgccccctaaggcggccaaggaaaaagcagaaggacgggaaggtgccccagagctcgatctcaggccgcaagcaccgaccaagttcctggtctccgggaggtcttttttttttttatttcttccatatttcatcattattattattaacttttcaagatggattaaagacttaaatgttagacctaaaaccataaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaa

SEQ ID NO: 252652 - DNA, 340 bp, Homo sapiens
tgagatttgagaggagggaaccactatttcccattaggattgtctagagatgctttattggaagtgacatgtttgagccaggccatggattggtgcagtttgaagaagaaacttttatcgagagattgaagggggatttaaaaaaaaacaggagtagagtatttttattttgttttcaataccttaactaatacttcgacatttcattagtattttttcctatgtggggaggagaccacagtttcctctttccagtgtttgaaatggcaataacagtaacacatggtcatgtacatgtagttttgaagtttaaaaaaaaataataaattctcacatcaaa

SEQ ID NO: 252653 - DNA, 1708 bp, Homo sapiens
ggagcgcggcctggagactaacagctgctcggaagaggagctcagcagcccgggtcgcggaggaggagggggcggccggcttctgctgcagcccccaggccctgaattacctccggtgcccttcccgctgcaggacttggtccctctggggcgcctgagtagaggggagcagcagcagcagcagcagcagcaacctcccccgcccccgcctcctcccgggcccctccggccactcgcgggtccttctcggaagggctccttcaaaatccgcctcagtcgcctctttcgcaccaagagctgcaacggtggctccggcggtggggatgggaccggcaagaggccttctggagagctggctgcttcagctgcgagcctgacagacatgggaggctctgcgggccgggagctggacgcggggaggaaacccaagttgacaagaactcaaagtgccttttctccggtctccttcagccccctgttcacaggtgaaactgtgtcgcttgtggatgtggacatttctcagcggggcctgacctctccacaccctccaactccccctcctcctccgagaagaagcctcagcctcctagatgatatcagtgggacgctgcctacatctgtccttgtggctccgatggggtcttccttgcagtctttccccctacctccgcctcctccaccccatgccccagatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcccaagtttgaggaccgctgtcaatctgttgtagagtttattaaaagagccattatgcactccaagaatggaaagtttctctatttcttaagatccagggttccaggactgccaccaactcctgtccagctgctctatccagtgtcccgattcagcaatgtcaaatccctccagcacctttgcagattccggatacgacagctcgtcaggatagatcacatcccagatctcccactgcctaaacctctgatctcttatatccgaaagttctactactatgatcctcaggaagaggtatacctgtctctaaaggaagcgcagctcatttccaaacagaagcaagaggtggaaccctccacgtagcgaggggctccctgctggtcaccaccaagggcatttggttgccaagctccagctttgaagaaccaaattaagctaccatgaaaagaagaggaaaagtgagggaacaggaaggttgggattctctgtgcagagactttggttccccacgcagccctggggcttggaagaagcacatgaccgtactctgcgtggggctccacctcacacccacccctgggcatcttaggactggaggggctccttggaaaactggaagaagtctcaacactgtttctttttcagaagttttgtttttgatatttatattacttggtatggaaaactcacctt

SEQ ID NO: 252654 - DNA, 292 bp, Homo sapiens
cagcacgtcctgggcagagcatctgacccacccctcttgccctcggcacccctgtgtcccaaggagaggagcttgtctagatgagtcacctcagggctctctactgccaggcctcatgctggttcctttgagctccaaatagttcaggcctgtaagcaccaaggaatgcttcccaggcaggagctgtggtggtgaggagggccactcctcattgacagagcagctctactgtgtgaaggagagatacacagaatcctaattctagagaaggtaaactccagggcaggcatga

SEQ ID NO: 252655 - DNA, 265 bp, Homo sapiens
ttttttttttttaaaggttctgctctactgaatctatccgataatatttctccaaagaacttttatgctagtgctcattttttcccttttgggggatgatggaaagggggcagttaccctcccttgttatcacaagtaaaatgcaaaaatcagcccacagatggttgcagagaaaaaggtcctctcaaaccccaaaggcccaagtgtaaactgatattaatagatctgctcagtttgtaggcagtttaacaatagctatccagac

SEQ ID NO: 252656 - DNA, 502 bp, Homo sapiens
tcttctactatatactacatgagttttaagtcaatgagatgtcctagagttttaaaggacactaatatgtgaaactgatggtcacatatattactgttattaactataacaactatgccacaaaactagcaaggccaatttaatagtatgtgttatacttataaacttagtgttttttgacacagagttccacttctcaccatttattatagagaaacagtcaccatacttatgcatagggtgacattacagagctattcattacaacactgtttgtaacagcaaaaaactggaaacaccctaaatctccaacagtaaggaatagctaaacaaactacacagcagttaagaaaaaggagttactggggcacatgttctcaggatttcctggggctgtgtcgcaggccattaaaaagaaaaagaaaaaagaaaaatgagttacttctgtatgtagagacatggttaatatattgttgaatggaaacaagcaacttgtaaaaaa

SEQ ID NO: 252657 - DNA, 412 bp, Homo sapiens
acaaatattgacctcgcgtctaatccactcgtcctccagtgccagctcattcctgagaagcccagcctggcagccgcagatcccatttaatcccagccccacaatgtcaccagctcgcagcttgggagctgggctcatccaggccctggcaggtggggccagagctgggctctgacctctgtacccacacttaccaccatgtaaagtgctgggaagaggggtggggagtcacggcaagttgagggtccaggcttgccccagctcgccagatgctcgccctggctgccctgacctagcagctaatctctgcggggcactgcggctacatggtgactccagcacggggacatttatcagaaatggaactgatggattaaagtggaaccaagcgaattgatttttctccctgggc

SEQ ID NO: 252658 - DNA, 1108 bp, Homo sapiens
ggccttttttgggggaaatggccgatttgcctgcctcagctgctcgggaggctgagggaggcgaatcgcttgaacccgggaggcagaggtttcagtgagtcaaaatcgcaccattgcactccagcccgggcaacagggcgagactctgtctcaaaaaaacaaaaaaacctcaaataggctaagcagatccattcccataatagtggattctaaaaccgtccttaaataggcaaataactgactttttcaaaactttttttaggtgttgggttcacccttgaaagaactgtcctctaacaactggttttgtcagttaaagcccttgagaattgacatagctatatacctggttgagcaggtgataaaacttgtaactaatgttgtgtcctgaaaacctacacagggaggtactgttttcccttagtgtctacctggctgcttggccttgtgactactgattccattagagcagtggttctcaaagtatgtgctccaaagcctagaagcatcagcatcagcatcagcatcacctaggaatttgttagaaatgcaaattctcgagccccaacccagacctactgaatcaaaaacgtgggggatgaggccctgctttctatgttttaacaagctctccaggagattttggtgcatgtcaaatttgaaagccactgcagtaaaggatactgctaccttccatagtttatggactgagctacctatctggctcctcctctgtgaataaccacacacacaaattttgcccaaggcacacaatatataaagcaaaactgttagtaatgtactttttaattattccttaacaaaatagaataaccaaaccaaatgcttcaaagtaatagcaacaagagagaagaaatgcgatggcccgagtaaaaaatctatcttctctcctttttttgtgggacaaaattcccgttgcaactggtttgtggttcgcccgctcatgacctgcccagtgggagggtgctcccacctcaggggattgggtggccacccgtttgttttggaacggtccggccggtaactgactgtttcgcaccaggaaaggagggctttcttacacttggagaatttttcgcttataaac

SEQ ID NO: 252659 - DNA, 1109 bp, Homo sapiens
tttttgagacggcgtctcgctctgttgcccaggccggactgcggactgcagtggcgcaatctcggctcactgcaagctccgcctcccgggttcacgccattctcccgcctcagcctccccagcagctgggactacagggcgagactctgtctcaaaaaaacaaaaaaacctcaaataggctaagcagatccattcccataatagtggattctaaaaccgtccttaaataggcaaataactgactttttcaaaactttttttaggtgttgggttcacccttgaaagaactgtcctctaacaactggttttgtcagttaaagcccttgagaattgacatagctatatacctggttgagcaggtgataaaacttgtaactaatgttgtgtcctgaaaacctacacagggaggtactgttttcccttagtgtctacctggctgcttggccttgtgactactgattccattagagcagtggttctcaaagtatgtgctccaaagcctagaagcatcagcatcagcatcagcatcacctaggaatttgttagaaatgcaaattctcgagccccaacccagacctactgaatcaaaaacgtgggggatgaggccctgctttctatgttttaacaagctctccaggagattttggtgcatgtcaaatttgaaagccactgcagtaaaggatactgctaccttccatagtttatggactgagctacctatctggctcctcctctgtgaataaccacacacacaaattttgcccaaggcacacaatatataaagcaaaactgttagtaatgtactttttaattattccttaacaaaatagaataaccaaaccaaatgcttcaaagtaatagcaacaagagagaagaaatgcgatggcccgagtaaaaaatctatcttctctcctttttttgtgggacaaaattcccgttgcaactggtttgtggttcgcccgctcatgacctgcccagtgggagggtgctcccacctcaggggattgggtggccacccgtttgttttggaacggtccggccggtaactgactgtttcgcaccaggaaaggagggctttcttacacttggagaatttttcgcttataaac

SEQ ID NO: 252660 - DNA, 575 bp, Homo sapiens
aatttgttagaaatgcaaattctcgagccccaacccagacctactgaatcaaaaacgtgggggatgaggccctgctttctatgttttaacaagctctccaggagattttggtgcatgtcaaatttgaaagccactgcagtaaaggatactgctaccttccatagtttatggactgagctacctatctggctcctcctctgtgaataaccacacacacaaattttgcccaaggcacacaatatataaagcaaaactgttagtaatgtactttttaattattccttaacaaaatagaataaccaaaccaaatgcttcaaagtaatagcaacaagagagaagaagagtgggaatgaccagagctaacaaaacactctattcctttctctcttttttttttttttggagacagaatctcaccctgtagcccagcctggagtgcagtggtgcgatcccggctcactgcaacctctgcctcacaggtttgaagcaatttgcctgcctcagcctctcgagtagctgggattgcaggtgtgcgccaccatacccagctaatttttgtatttttagtagagatg

SEQ ID NO: 252661 - DNA, 707 bp, Homo sapiens
catgtatatttcagtaaacttgttttaatatgtgagacaaaggtgggtttcttcacgtattaattttagcataaagatttaaaaactatttgatgaatgttttcattgtctgcatatgacaccaagttttcaattgggcaatttattagatttttattttccccttaggacctgtattctattatatgagctggataggtgttgagagtgagaagtgttgacactggagtctgggatgaaaaagtgagaaaggaaaggagtgacatagcacgagtatatatatatatttgaaatatacctccaaaaagttagaataaattcaagaaaataaatttgcactggggtggaaaggaataatacttatataagagaagttggtggggaaggtcaagagtgaacttttattgttttccgcgctctgattcagccatcatcgctttctgcatctcctctcccctttccctcacttcccacctatctctcccttcatctcctacccctctctttccaccctttcctatgctcctctccatcgccctcgccctcatctgctctttttacacccatccttcccctttccttctcccctcttctcttctctcctttaatctccctcattgcccctcctatttcctcctctctcgcgccttcatcatttctccgccttttccgttcttctcttagcctctcttccctcactctcctcc

SEQ ID NO: 252662 - DNA, 2393 bp, Homo sapiens
  misc_feature (224)..(224): n is a, c, g, or t
  misc_feature (1859)..(1859): n is a, c, g, or t
agaacatcgtgtttgagttgggaagggatttgtgtgtgtccttccagataggtcgatatcgcccattgtggatgtttagcaaaaacgagtggatcgttatcatatggaaaacgttcaaatcttttgtgggagggctgagctacctgggaacgtgaaattatttgcataatgtttggcgaggccatgagtaattctactattatgaagaggagtaattaggagtngttaacggttactgagagccgcttcatgctaaggactttgacatgcattttctcattccgtcctcagaacaaccgttgctactttacgggtgcagaaactgaggtttgtagaaaattgcccaagttcacttaggcagagagcactgccctgattccgaaccaggcaggcccacagagagcaagagctcttacccactgtagccttcccagcaatcagtttcttagaaaatgtgtgttttcgccgaacgcggtggctcacgcctgtaatcccagctctttgggaggccgaggcgggtggttcgtttgaggccaggagttcgagaccagccttgccaatatggtgaaaccccgtctctactgaaatacaaaagattagccggccttggtggtgcacgcctgtcgtcccagttgcttgggcggctgaggcacgagaatcgcttgaacctgggaggcggaggttgcagtgagccgagatcgcgccactgcattccagcctgggtgacggaataagactctgtctcaaaaaagaaaaagaaaaaaaaagcgtgttttcatattagctgtgctgtttaatgaaaagattgcaaattcgttgcatgggctccctagaagtgcttagtttggtttacagtattggccttcaaaatgtattgtaaaaatttgaattgattaccaacattttaaacattgagggattgcatgaaaaacccagattccagcatctcttggaaaaccagaatctctgacaacgtgggatccattttccaaaagtgcaaactaggtttgaagtgtggtcgaagccacaccctttagaggaacctagggtgctcctgttcaccacactccccgctgtttgcttttcccatttacattatctggcctcagtaggcatttgaggttgtttatttatcttaaatcattcagtcaacacaaaccagcaagtatttatttatggcttggtcctgctgaaggtatggacaacaatataagcatggaacaaaactgctcttgagtttaaacaacatagtttcgaggctgatgttggctgtttttgaatggggtatatacaaacgagtaaaagtggacagaatttaggaatcatcacaagacgcaggaagcacactggagatgctgccttgaaatctattatccccaagtggtaattcaaaaccactccaggctcattttgacttacctaatacataaggaacaccgttaactttttggttgcataaattattaaatttctgtcgttcaaatacgcaccctgaaatgcagagaatatactcaacaaccaccaaaaaaaaaaaaaaaaaagtgaatcacaacattgtttacctataaaaggtatgttaatcccatcctctaacattttcattagaaaagaattggtcatgtgactcacactggctacaaaccttaggcaactctgttttttagggaattgcaaattcagcttgcaaggaggaaaagagcggaaagaagtcgggcgaggtgggttttggacatgggtcagattcagctggtttatagaggacttttaaagatttaggatttgagatggtccataaactctttggcagatctaacattctctaaagagaattggccaggcatagtggctcacgcctgtantctcagcactgtgggaggtggaggctgggggatcgcttgagtccaggagttgatgaccaacctgggtaacatggtgaaaccctgtctctgcagataatacaagtataagctgtagtgtcagctactcaggaggctgaggtgggaggattgcttgagccaaggaggaggaggttgcagtgagctatgatcgagccactccactctagcttgagcgacaaagggagaaccctgtctcaaaaaaaaaaaaaaaagctagaagcagagtgaatagcttcttttaactgtatatcctctggaaaagggaggtatcatttaatgttgggcttgcaacaaatataaacatggagatatttgaccaaacgaaataattaataaaaatgtatcatgaagcgttagaattccctactatttttttttaagtaggactggtgaaaatgacattttaaaaaactattagataatcctttctcgtgaaacaagttcaaaaatgacagtgcacatctgatcatttcgatgtcagtgtttaaaaaaaaa

SEQ ID NO: 252663 - DNA, 358 bp, Homo sapiens
gatggccaggctcccacgccctactggccgctacccgaccaccaatgaggcagaggcctgaggccagtcggtgctggagccctacttccaaggtccacagaccgcttcaggccacagagccgaagaaaactgggcatgtgaaggcccaggaggcggggtccctatgtctgccattcttggcaggtgcatttcacgctgggagcaagtcaggaaaggtgatgcctctcaccgccaagaaggctcccagcagagaccagagccaccggcacagatccccaacccctgaaaccacctccctctggaggaccaggacgccctcctagttggtagaagcacagtaagctctctgtccttatga

SEQ ID NO: 252664 - DNA, 411 bp, Homo sapiens
gtttggccttgagcaactgggtgatcagggtggagcagttcagggagccatcacaagagacagaaaacgcggtagtcatctggtgtctaaatggcatttaagccttgagggtgggtgagaggaaggaagggtagatagagcagaggttgaaggactgagccctggggcatgccatatgaggctgccggcggacagaggtgcacagctagtgagaaaaaaacaaggcctttttgtagtcctgaagcctcaaggaagtgtttcaatggtgcttgatcatatcaatttcaaataggctgttttcatccccaacttctgctcagccaataactcaaactgataaatgccctctgctatcctggattttccaaattctgttttggggttttggaataaacactggtccaaatcctc

SEQ ID NO: 252665 - DNA, 450 bp, Homo sapiens
cagtattaagagcatggggtcagaggcaagatagatctgagtttaaatcccagctacactgccttcaagagtgtgaagtttaacctcccagagctgcaggttccttatctgtaatgtggaaataaaatggcacgcacctcagagccttgttagataaaagacaaggcagtaggaagtcttgatacggtgcctcgatgggttatcagtagctcatcctcatatttctagttacgtctgtgctggaggatgcctttgtctgctgcttttcctcccaccatctatccttgcagagtttctaagcacaaccctcttcgcccgtggggccccagtcaggtcatccagatgggtctggtggggttggagagggtgtgtgtgttgtgggtgcacacctgcctgctgcttttggaagccgatcgaactccttgcttcccttaacctgctgcttgctca

SEQ ID NO: 252666 - DNA, 108 bp, Homo sapiens
ctcagtttccttcttctgcaaaatgtgcggcctgatcctgtgggcaggtctttgggccagaaaatttttcattaaagtaattttttaaaaagttttataaaataataa

SEQ ID NO: 252667 - DNA, 438 bp, Homo sapiens
cataaataagttgcaaatcaagtcctgcaagccagagctctgggaaatggctgcattctctgaaatgccatttctgccccagccctccagagcaaatttcaggtttgccaggccacccatcccatataaatccttcagatataggccttatgttatcatcttcctatcttgactgagactctttaaaggggattcctttcaaatccaaattacatattcttaaacatttttgatacttattagtatagtaacatacctacacacacacacatagattttcagtgacaaataccatgttagtacttatagatagtgaaatacactttgatctagagggctttattttctaggccaccaattgtgtctcctgttacaatttcccagagtatctggcataatgtctgtaatagtaaatgttcaataaatgtttgttaatat

SEQ ID NO: 252668 - DNA, 632 bp, Homo sapiens
cgccagacgtgagccgatcattaagcgcaagacagctggccaggatgtccgagtccagcccagaaagccgggaagagctggagagcgaggacagttacaatggccgggggcagggagaactgtccagcgaggatattgtggaatcatcatcgcccaggaagagagagaacacagtccaggccaaaaagacaggggcaaagccctcacaagccaggaaggtaaacaagagaaaatctcccccaggatcaaaccccaacctcagttgaggccagggtggtcagggtgcagaataaatgccatcgagcctgtggctggccctctgctgctgttctctccctccaacctggctgtttcttgcggggcaaggggtgggctcagggctgcaggggtttctcaaaggcaatccagctttcacaaaggaagcccatgggaaggcaggtgggagggaaaggaaggggcacagccctatttcttcctacctgctaggacaaggtggaagagtgtatctggggtgggaaggagggcttcccctctctgctgcgagagactggtctgtgtgaaatccacttctgggacaggcagtactgtctgcagcgatacccccaataaacggaactttttaacccaaaaaa

SEQ ID NO: 252669 - DNA, 437 bp, Homo sapiens
  misc_feature (284)..(284): n is a, c, g, or t
aagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgagactgcctggattacaaggatccttgtaatccaagcagtcgtccctcaggataactggcgctctcgcagacgcgacgcacgcccgccacgcagttttatccggtaangcgaatgattagaggtcttggccgaacgagtctcacctattctcaaactttaaatgggtaagaagccgactgcttggatacaagagtgaggtgaatcgcatccggtgctgcgcggttgtcgccatcacaccagagcgcggcggcagccgcgac

SEQ ID NO: 252670 - DNA, 363 bp, Homo sapiens
  misc_feature (305)..(305): n is a, c, g, or t
aagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgaggaggagccctgagctgggaggcagcaaaggctgacctatcagagcctcccggaggccaccgtgctgggtaccaggactcacctctgacaagcaggagaaggtaagggcccggtcagctcctaagtgnggcccacgcgcgtgcacacagcttccctggtaataaagagctggcatctttcttaaaa

SEQ ID NO: 252671 - DNA, 540 bp, Homo sapiens
caggaaactgagatggctcatcagtacttacttttcagctccaggagttgtaataattacattttggagattttcagataaagtagcaatatgttacagtagtcataccaggtgccctgcctttaaatcagggttgcagtgtttcatagttgtgtgaccttgggccagttagttttctcctctgtaaaatgtggttaataatagggctgggagggggattaaatgcaaaacacttactgtgactcatactaaactttcagtgaacactgaatattagtaaagttatttttactgggaagatcataaatatattacaaaaaaggtttgagtctctttctgtgggatatatgatgcaacacaacaagccgtggattgggtgttgctttgtaaggaaaatcaattacatatgtcttaagtacttcaatctctcaacatctttgttgattccatctgagcttagttactctactacgtatagtgtatgatgttacgggtctagaataactagattagggtaaaaaataagtataggaaaaaaaa

SEQ ID NO: 252672 - DNA, 361 bp, Homo sapiens
  misc_feature (327)..(327): n is a, c, g, or t
caggaaactgagatggctcatcagtacttacttttcagctccaggagttgtaataattacattttggagattttcagataaagtagcaatatgttacagtagtcataccaggtgccctgcctttaaatcagggttgcagtgtttcatagttgtgtgaccttgggccagttagttttctcctctgtaaaatgtggttaataatagggctgggagggggattaaatgcaaaacacttactgtgactcatactaaactttcagtgaacactgaatattagtaaagttatttttactgggaagatcataaatatattacaaaaaaggtttnttctgtgggatatgtcgcacgcggccgtcgaatt

SEQ ID NO: 252673 - DNA, 415 bp, Homo sapiens
cttttgtctggctgccttgaaactacagtgatagcacagttgagtaattccaacagaaaatgtctggtcttcaaaatgtaaaatattatatttaatactgaccctttaaagaaaaaaatttgctgacctccctttcctaacctttaagagactggtagtgtctgctctacacctatacccagcaatatgaatttttatagaaaacaaattttagtaaacctaattttaaagcatatatatctagaaattaaataaaatttacaaagacatataaggtcatagattataaattttttaagtaaattaccttctttatccttaatgagaaaggtacaaacctattggagcaaaacatttttaagccgttagtgtgtacattatggtgcctttctcagttatttgcagaatcataccc

SEQ ID NO: 252674 - DNA, 447 bp, Homo sapiens
gtgaatacttctgggaaaaatagaaaatacatgggaatatgtcagttttaacagagcctgctaaatattttaggggatttaatgtttattaaaacccatagtgatataagcttttctttttttttctcaacagctggtgagaccagcaccaagatattgatgcagtttatagtaggtctcttagaatcaagtcagtagtagactaggcattgtaactctcaagtcttaaatactcatcagctggtcagtccattgggtctggcaaaattaatgtgtatttaacccttgagaactcatgcttgggtgtaacaactagtggaaacaattgtagaaccccagagatataaaagtggcatacaaatgctttctaataatgatgggcacagtttatttgctttctgattttgggcattttgcctttgtgaaatttcctctcatttggtgcct

SEQ ID NO: 252675 - DNA, 179 bp, Homo sapiens
tcgttattcagtacagtaacgtgctatacaggtttgttgcctaggtgtgtagttggctatactaaatttgggtaagtacacaactttttgttgtttcacacgagaacgaaatcacctactgatgcatttctcagaatatattgctgtcattaaactatgcatgtctgtatttacagtgt

SEQ ID NO: 252676 - DNA, 369 bp, Homo sapiens
gcctcccaaagtgctgggattacaggcgtgagccaccgcgcctggctagtatatggtatttttcttttatgtttatatgatgatgagaaatttgaaattattgtttgtttgtctttagtttttattcttgttaatggagaaaccaaactccgtgaaatattttaaagaggcttcttctgagccaatatgagtgaccaccatcttgggatggtggccagttgtgcctaaactccgaaagggaaggggtattatgagttttttctgatccctcttcccatcatagcctgaaactcagtttttgaggtttctctggggtccccttggcccagaagggagtctgttctgtcagtggggttgttaccagttgtg

SEQ ID NO: 252677 - DNA, 357 bp, Homo sapiens
gtgggagatcccatcctcagctaacctggactcccaccaggagtgaagctttcctctggacatgctggaggcctaggtgtgagctgccacagccatgcgggtgcttctgggaagagggaggagagctggtgtccagccccatgccagccccacaggggctgagagcagaacagttgagagccagccaggcccgctgggctcgggaggccttggaagccccactctgcccccagagcatgcctggtgcttcctttcacaagttgccatcagcataatggaccagtgtgatgccatgtgagatggcaagaaataaagtccctgtgaaataaattatatggatgcagttcgctcaggaaa

SEQ ID NO: 252678 - DNA, 712 bp, Homo sapiens
gcaacttgactctgagagcctgctgtctccactgaatttgattatgtgctatcaggagaatccatctactgcctgcagctgtcgagctcctctcctggacatcctaaactcaaatggcagggaaaaaaaaacactgccatctattctgacctctgaagtcaccatgcccattaactgaggatgaagaagacagaaggaatactgaatgtctgaagagagagaaaacgttataaaattatcctttcaaaagatggaagaataaattcacttggcaaatgtgatatggactcacctgaggtttgaagtcatccaaaaagaaaccaaaaatcatggttttgagattttgtccaaattccttcattatctcagcactgcactaggatactaatgagttttcgggaacagaaaacccaatggaatattaaaattggaaagaagagctccttgagttaatttcactgaagtgcatcacaacacactgcactgttgtaagaatgaatattcaaataggaatccagtcatgggaaaattaattaaggaaaatgttattgctaatatttctttttatgaatatacatatgcggagacacacaaccatctattggctccacactgacaataataaaagccaaacatttatgagagtcaaatgttcaagatctcttgctgagttggtgttaaaagattttaaataaaaaaattatgattccag

SEQ ID NO: 252679 - DNA, 494 bp, Homo sapiens
catcctcctccattaaaactggacagactaagggccactttcctaatggatgggtcttcttggttcatctcatgctcccaacagagctccctcccggggatgggaacgcgccatgccaggagagccctcttgatccagcctccagccaaagccagtccccctgccaaacaggccctagagttacactggagggtgacaggcctaacctggaaatttcttgctgaaaattgtcagtttcccacacaagtacagcctggcagttaattcaaattcaaaccagaagactgctgcttcagtctcgactgcttgaaaattaggttgtgtagagctttcatttgctggaaattgtgcagccagacattgtgcagattgacccagtagctacagcaagtacacacatagggcgccaagcaaggacaagtgtgcacatgtgcgcacgcacacacacacacagcagaaaatctagaaataaactattttaatgtcagctgtca

SEQ ID NO: 252680 - DNA, 802 bp, Homo sapiens
aggaatagtgagggatatgatggtgggttggataatgtgatctggtttatgtgattcgatctggtgtgtttttgttatatggtgatttttatttgggccgtgcggcccaaataggccgttaacgacgattccaaggggagcggtcgagtgcttatcgatggcaaatattgattgggttctagttagtaacagtccccatgggaagcaggaaataccaaaaattgggtgctttttgaaattctgaaagatgtggcaatcaaaatgagcccaattagcattttaccttccagaataaacaatattttcttaaattgataaatgaacaaatgaatgaataagtagataattatataagtttcaaagaactagaagggaggttcctaatagaggttaaatcatcagtattaaaaactgaaagaacaggcagtcatttggctttcataaggttaaatagttttagttcatttataaatgtctgcattagctcttcacaattaactcttcatagtatcaagagttaatgtcttgtcttccatttttgtactaaaatattaaaccagaatggcaaaaatgtctactaaaagaataaataagaataaacaataataataaagttcagcatgatttggtatatagcttatggtaaatgagaacgcattatgacttatttctaagagtagacatacagacaaaataaacagaataagtagacaaaaagtaacatcacacatacgcacagattttcaactctactaataataacatttagtatttagataagtatatctcacagttcattttc

SEQ ID NO: 252681 - DNA, 556 bp, Homo sapiens
gttcagattccttaattcaacatggcaaatattgattgggttctagttagtaacagtccccatgggaagcaggaaataccaaaaattgggtgctttttgaaattctgaaagatgtggcaatcaaaatgagcccaattagcattttaccttccagaataaacaatattttcttaaattgataaatgaacaaatgaatgaataagtagataattatataagtttcaaagaactagaagggaggttcctaatagaggttaaatcatcagtattaaaaactgaaagaacaggcagtcatttggctttcataaggttaaatagttttagttcatttataaatgtctgcattagctcttcacaattaactcttcatagtatcaagagttaatgtcttgtcttccatttttgtactaaaatattaaaccagaatggcaaaaatgtctactaaaagaataaataagaataaacaataataataaagttcagcatgatttggtatatagcttatggtaaatgagaacgcattatgacttatttctaagagtagacatacagacaa

SEQ ID NO: 252682 - DNA, 414 bp, Homo sapiens
tacaaacagtacccaaaacggaacaggctgctatagcactaggaatgttcaggcaatgcaactgtcaagtctgactacacatcagaaacacctgggaatagttttaaaactatcaatgcccaggccccatccccaagcaattaaattaaaatctctcgggaaaggcccgggcaatgggaggaattaaaaacttccctgggggttccaatacgcagctacacttgagaatgaccacggtaaagacaggcaatccttggagatactatgggttcagttccagaccaccacaataaagccagtatcacaagaaggcaagtctcaccaactttttggtttcccagtgcatacaaaaattaggtttacacgatactgtactatattaagcaagcaaataacattatttctaaaaaaaaa

SEQ ID NO: 252683 - DNA, 236 bp, Homo sapiens
tctttctctttctttcctttccttctttttctttctttcttcttttttctttccttccctctttctctctctccttccttccttatttccttcttttagagatggatatctggataagtgggtgaagattaagtcactatcaattatttgtacaaaccctatacttttagagaataaagggaatactttttttttgagatggagtcttgctctgtcacccaggctggagtgcagtg

SEQ ID NO: 252684 - DNA, 364 bp, Homo sapiens
cagaccgggcccagatgagtttgcgctgaatctgaagtcggtaggtccctggacatttctattatggaagccaagaagaacctcccctccaccctctgaagccagtgtggatcgggtttctggcacttgcagtgtctgcacggtctcctctccttccttctccattgccctttctcacccgcctgggcccgccaccctgaactaccgggacacatgctgttcctgcctccaggcgtgcacttcttcctgcagcctcctcccctactaactccttcttgaacttgatagctccattgtcactttcgagtcttccctaaaccactcccttcccaaataaaactgtttcatgtatttttctttcatt

SEQ ID NO: 252685 - DNA, 484 bp, Homo sapiens
gacgagtttgaggacctcgagtggtccgaggaggtccagaagctgcaggagcagcagctgcgcagcgacctcctggaccagtaccgttccctgctggtggagcggaaccgctcccagcgctacaacctatacctgcagcacaagatcttcgaggcgctgcgcagaaagaagggcctggaggccgctgaggtggctgaccggggcgcagaggccgaggcccccgagaaagagcaagcgtacctgcgccatctgggcatgctggaggagctgaagaagcagcaggcagacgacctgcagtggtaccaccaggagctgggccagttgaagcggcagtgccaggagaagctcaccagggtggagaaggagtggcgacgcttccaggcactcaagaagcaggtggtgatgcaggccatgggcagctgtcggatgaggggcgggcgccaggctgctctgcgagaggtggagcagatccaggcgttggagg

SEQ ID NO: 252686 - DNA, 408 bp, Homo sapiens
ttatatgcatttttcagataagaaaataaccactgacaccaataactgtctacatcccatctgagagagattaacatgcccaccatcacaggactagcatgcaataggatgaagatttgaatctgagcagtctaatccaagagcaccgatcgtaatcaccatgcaaccaaggccttagaccatgtacctcctccctgtattgtggcccctgtttgaaaccacagctccagtgtggcaaccatttagaccaccaatggctgttgtgccactgagatgatcagtacttctaggcttgccaccaacaataccctttttcacgttgttttcagttttgtatcccacattttgaaagattcttatcctgatcaacatgtaataagtcataaataaattccatttattctatta

SEQ ID NO: 252687 - DNA, 475 bp, Homo sapiens
gatcccccgggctgcaggattcggcacgaagcgacacttcgaatattctactaaatgagagttctgagtatagaaaataaaactaaagttggtagaaaaattatttgtatataatgttaagaggagtaaaagattttttgtagaataataactatattcagattatactttgtttcttgaaaaaattacagattttttgaaaagcaaatgatgtaactcaactcattattttctgctgtttcttcattcttattcacttgtgaaagcttgtgatcatttgttgctgcatcagaggtatgagagattcttcttcattagatgggcattatttatgatcttttctatggatgagtaagaatattaaaatgtaagatgcatggtgaaaatctaagtggagaggttctttgtggttaacttatactattgagtgatgcacaaggtaggtgttaagagtaatattcttttgcattatgag

SEQ ID NO: 252688 - DNA, 124 bp, Homo sapiens
cccagcctacagcctcccctctgcctcgttggtgcagacagcatgcaaggagacatatgtaggttccatgcactgtccagatgtcacacctggacctaagaatccctggacacactgcagggac

SEQ ID NO: 252689 - DNA, 1140 bp, Homo sapiens
cccaagtcacatattttccagggaagaccagaacttgaattcaagcagcttgtctctgaaggatgcactcagaccctgagggcctgcagtgcagatctccaggctcccagcccagccccctaggcttccttcaggaagataaccatgagtctgtccagtgaaaacagacccatgtctatctcttccctgcagacgggcttgatccctgccaactgcagagaagctgcagagcctgagcagagcctgatgtttaccagctctaagagctaagggttccagctgggacagcaaatcctcagcaatcctgggaaacagggagtgatgccagggcacagggtctcctccaggttatgaagagcagacacatgtggttggaacttcttcatccgggatgggcgtcctgcacgcacgttgagtggctctcaggaaaacatttccttgagaaagcagaggcagggaggcaatctctgaagggcaggctgtttttttccatgttctcatcgggaaggagagaagaaaaagcagtcagcacttcctctctgcagcccttcctctgggggcttctcatcccccttcacagcagcagagccccatggtgcagtttgctgtgcttgcctaatatcagtcagcgaagtagagtttgatgagttcagtcaacaaaaagtagccgataagggcttctgggcacccctccgagaatgcctgaggagccttttcaaggatggactggtatggcaaaaggacggagatttgggaagccttggcacttgttctcaaatatccaaagggctgtcttgaggcaggctagttctatgtggactccatggggtggaggagggatggcagggactagtctaaggaaatacgcagaaaggcacagaagcttaggttccaggctatgcagtctgacaggcctgcgttgcaattccagccacactatttataagctgtgtgacaattagcaatttgcttaacacttgtgtacctccattgtactgtaaaatgccagtggtaccatattcaaaggtttattgtgaggactgaagatggtgatttatataaagcacttagatagtgcctaggacttttgctaataataacattattgtgtaaagtccacttgtcttgagaacctatgag

SEQ ID NO: 252690 - DNA, 1100 bp, Homo sapiens
  misc_feature (1100)..(1100): n is a, c, g, or t
cccaagtcacatattttccagggaagaccagaacttgaattcaagcagcttgtctctgaaggatgcactcagaccctgagggcctgcagtgcagatctccaggctcccagcccagccccctaggcttccttcaggaagataaccatgagtctgtccagtgaaaacagacccatgtctatctcttccctgcagacgggcttgatccctgccaactgcagagaagctgcagagcctgagcagagcctgatgtttaccagctctaagagctaagggttccagctgggacagcaaatcctcagcaatcctgggaaacagggagtgatgccagggcacagggtctcctccaggttatgaagagcagacacatgtggttggaacttcttcatccgggatgggcgtcctgcacgcacgttgagtggctctcaggaaaacatttccttgagaaagcagaggcagggaggcaatctctgaagggcaggctgtttttttccatgttctcatcgggaaggagagaagaaaaagcagtcagcacttcctctctgcagcccttcctctgggggcttctcatcccccttcacagcagcagagccccatggtgcagtttgctgtgcttgcctaatatcagtcagcgaagtagagtttgatgagttcagtcaacaaaaagtagccgataagggcttctgggcacccctccgagaatgcctgaggagccttttcaaggatggactggtatggcaaaaggacggaaaagaggtagaagaagtattgaaagaaccgtggcctttgtcctggcctagagaagatttgggaagccttggcacttgttctcaaatatccaaagggctgtcttgaggcaggctagttctatgtggactccatggggtggaggagggatggcagggactagtctaaggaaatacgcagaaaggcacagaagcttaggttccaggctatgcagtctgacaggcctgcgttgcaattccagccacactatttataagctgtgtgacaattagcaatttgcttaacacttgtgtacctccatggcctgttttaagcccttagataggcctaagacttttgctaacacaaccatcacn

SEQ ID NO: 252691 - DNA, 440 bp, Homo sapiens
caagcgcccagagctgcagacgccagtatttggaatgtggccagttcctgctgaatccaagacctgagggccaggagcacgggcttggcagcagctgcttcaagttggatcattgacactgcagagccacgtttcacaaccaaggaactaaactcagggcagacttggattccaaaacaagacgtgcaaaaagggcaatttcaggaggaagatgagcccaaaagggagatctttcaggcctcatggcatttgtgcctctcttcacaaaaataatttttttcctgctctatgtaaaccttgtactaagtgctgcagatacagtgctgaccaagacagaatctgccctgccctcctggagttccagtggggatgcctgccttaaaccatcacgaaagcaaataagcaattccaaataataatgaatgataagtaaaagtgag

SEQ ID NO: 252692 - DNA, 496 bp, Homo sapiens
gggcaattacgaaggggtaagaatggtataatacataaaactgctgtgacaaaattaaaagttaaagattaaacgttattttgagtgtacaacagctgtattaactacttaactgtagctgagtttatcatcagcctgaggatttagaagattagaccaagatcaggacattagaagtggttttcataatggatttataagttgacttagcataaccaggtgagtcttttggatgggtctttccattggaacataaatgggaattcctttttcaacaggttttttttgtgtgtttgtttctatagaattcttttttatataatgtaaaaaataccgttagtcatcgtcatgggattttagcccagatgcatatgctaaacaaactcacataagatctaaggaaattaataaacaaaaaagagtaaatttagcattgactattaaatatatcaagagattgtctcttttaatgtagtatgataccacagcataggta

SEQ ID NO: 252693 - DNA, 554 bp, Homo sapiens
tctctgctgcctgatcaaaatacagtgaatttgaatctttctaaacacagttgtcccttggtatccatgggggatttgttccaggacccctgcagagactaaaatttacagatgctcaagtcccttatataaaatggcatagtatttgcatatgacctacacacatcttcccatattctttaaaccattcttagattacttataatacctaatataatgtaaatgctatgtaaatagttgttatattgtatagtttagggaataatgacaagaaaaaaggcctgtacatgttcagtatagatgcaaccatcttttttttccccaagtattttcaattcacatttggttgaatctgtgattgcagaacccatggatgcagactagccaagtgtaaatctttcttgtagcctaaaagaaatgttgtttttatttccgtctcacctgggtatatgatactatatcatacctattaataaccacaactatcaactgcatatgttttattcttatatttttattcttaataaaaattcttattttccagttgatttaga

SEQ ID NO: 252694 - DNA, 122 bp, Homo sapiens
gggacctggggggcagccttggggtatcttactctccagcagacccggaggacccatcccacactgcacatccggaagagctttttcttctcatctcccactcccacacaccccacccccac

SEQ ID NO: 252695 - DNA, 365 bp, Homo sapiens
tgtcttagtctgttttcttctgctataacagaatacctgagactgggtgatttataaggaacagagatttatttcttacaattttagaggctgggaagtctaagatcaagaggtccacatccgatgagggcaatcatcctgcatcatcctatggcagaaggcagaaggacaagagagtgagagagaccaaaacagccaaacttatctttttataaggcaccttctccctccatgacaaatccactcccatgaacatgtcattattccacttatgagggcagaactctcatgtcttaatcacctctgaaaggttccaccttttaatactgttacaatagcaattaaatttcaatgtgagggttttt

SEQ ID NO: 252696 - DNA, 456 bp, Homo sapiens
aaaaaagaacagaagaatttattgccagaagacctgcactgtaagacatgctaaaggaagttctttaggctgcagggaaatgatactacatgaaagcttggatctgcagaaaggaatccaaggcacttaaaattgtaaatgtctagatatacatactagactataaattttttattcttactaatttcttcacaaaccatatgactgcttaaagcaaaaattataacattgtcttgaactcatcagagatttgaggtcatagggcaaccaactaacctgaaatctaagaaatgacaggtacttccaaggaaaagatcattgaggtacaaaggagagcagagagctgcatattaagaaagggcagcattaggggaatggaaattatgcttctgggaaaagaggaaccaggaaaggaaactgagaagcattaattttagatgggagaaaaaatagaga

SEQ ID NO: 252697 - DNA, 326 bp, Homo sapiens
aaaagaaccagatttagaagagcattagatatctctgtcacatctgaggaacaaattagccatcagagcaaaggtccaggcatcccatctcggcaaacaaagcatgattaaccctagagctgctgattctgagctcaccctaacttgattccctccactggccccaagctggcagctgtagctttgcaaacatgataatgcttctcttgttagaactgaatttagaattggcagcaacagaaacctgcaagctgcagttcatttgtgtatccatgcttaatttaattcttattgaatgaaatgcaccctcattttattcttgctgg

SEQ ID NO: 252698 - DNA, 508 bp, Homo sapiens
gtggcagcaactaaatcaagtagctatgctaaactgaaaatatgagaaaaatatattaagtaaaattaataggccaggcagtggttcacacctgtaaaattttttaaagtatcatttacaatgacataaaaaaatagagattaatatgaaaacagatgtgcaaaccagttgacatggtttagctctgtgtccacacccaagtctcatgtccagttgtggttcctagtgttggaggaggggcctggtgggaggtgactgaatcatggggacagacttctcccttgctgttctcatgacagagttcttaagacagctggttatttgaaaagtgtgtggcacttcccccttcactcctgttctttctgtctctctcctgctggccttgtgaggatgtgcctgcttccccttcaccttccaccatgattgttaagtcttctgaggcctccccagaagcagaagtctgtacggggcccacagaaccatgagctgattaagcctcttctcttta

SEQ ID NO: 252699 - DNA, 405 bp, Homo sapiens
tgggctccagacagaaacaccgtacccctgcaccagcctctgcctcagctcttcacagtcagcacaccctccgcttcctgtcagggtgttctctgctgagtctggttatgggatccctttctgtgcagagccatgctcccgtgtcactgtgtgtcaccttcaagctgtccccgtgtgtatgcctgtgtgagaatatgtgtgtgtgggtttgccatcgaaggaaaacctttattttggctgctaacatttggaaacatttagagaacaaacaatatcttttaaaaaacatcaaaggttcaaaaaaacaagacaagaaacaaactgttgtaaaatttcaactcctctaaatttgtcttaaattgaacttagaactaatctaataaaaatagtatgaagtttcaaagg

SEQ ID NO: 252700 - DNA, 464 bp, Homo sapiens
atgaaatagcagacaatcaagaatatgacaaaaaatttcatctattgaattggaaatggctcgcaaattgtgtgatacatagaatatgatccacattttagaaaatgtattttatgtgtacatactgaaaaaaactaaggaaaataaaccaaaaatattaggagtggttatctctgggtgaagagagagaaattatttttactttatttttgaactagattgttggaaagtaggttttactcttgatgaatagataatagtagtatatgatgattacatcaatatttgttaattttcattttgattcttgaaaagttttaaaatgagtttattaaaatccaaaccaatgacggtcattgataaaaccttaagctttaaagtcagagaatatatatttaagcttagccctatgtgagttacctaaaatttttaattaattaaattcaaatttatgaaactttata

SEQ ID NO: 252701 - DNA, 355 bp, Homo sapiens
agtttccactccagtgaactaattcaaatgtatccagcatctagatatatgtataaatgtaattaaaacatattgagcatctagagcatctctcccaagataattaccacctgatagtaatggctataaaagctaaaagtggaatcagtctacatgtttcgcaataggaatcaattgaagcatacatcaaaatgcagacagtagtattggtgagtattaatgttatagatgctttttatccttcatattttcatatctgtactttttcctgtattttacaatgtatttgtacgttgtacaaataattgctgatcatgtaaaaatatagaaatatagaaattttgttgccatactt

SEQ ID NO: 252702 - DNA, 376 bp, Homo sapiens
atctaagaggatattctttttccaattgcttcctcaggatatctccagttacaactcattggacagaactaggtcacatgcccagctctagcagccaggacagtcatgaaagcaaggatttatcaaggagaataagattggtttctatgaccaaaaccaatgataatgaatcctctgcaactgggaactttggagtcaaaacaaggagttttgttggtatgcaaaattggagaacacctattaactaagcaaaccatagtgtttgccagtataacaatgttttggattttaaaaatccaacaacattataaagccaaacacaaaaatatttagcacaaattgttcagttttggaaagtggtattagaaaattgaaa

SEQ ID NO: 252703 - DNA, 458 bp, Homo sapiens
gtctcaaaataagagagcatgttctaacaatcagaactgttcagcaatgggggctatgttcagagataggacatttccagtcacaggcaattcataagcagagactgacaaagcatagagctgttgtcaaggagaggctggctctgcagaggccccggcttactgacctcaacagtcccttccatctctaagattccttgactctagagcctctttgggaattttccatacaactctgcccttcgaaaccgatgtatttatataaatcctatagatttaaattcagatgtctacagtagcttttcttttcacttaaaataaatgaaatcatccatttactcactctaatgaagtgactgaatcatgtgttttcatctgcagcctataaagtcattaaaaatgcattaaatatgatttgagtgattggtataaaaatagaggcatgatcagtagatttt

SEQ ID NO: 252704 - DNA, 265 bp, Homo sapiens
ctttggacttgctggagccagaggtgggggcaagtctccttctttcatctagccagcagtaatgatgcctgccctggggatctcaggctgctgaaaagcataagactcaaccactttcccttagggagacagcctacaccaaaggggtcagactccacgagagatctgaataatgacaaagactgtaaaaagaaatccagttagataccactggaattcctttatagactgcatattactttcaaatatatactactgcacttgt

SEQ ID NO: 252705 - DNA, 584 bp, Homo sapiens
ttttcctttataagttacccagtcttgggtatgtttttatcagcagcatgaaaacggactaataccatgccttcatgcactgtaagaataggcactatttgtagagagctgccctgtgccagatatagctggtgcctccacactgtatctcattgaattcaattttgagaacaatgttatgaagtaggtattgttatccttagagataacatacagagaagttaatcaggttggctgaggtcatatgactaatgcggagatgtaactcgggtttgctgactctgaagcttcttttgtctatataatttccaaagtttggttttccgtaccattctaataaacccagaagacacttaccagtgctgcttccttcaaactggactccttgcctatatgagttaccttcttacctgcctttagttgtggtgtgggcagtgggtgctgtgttaatcccaagggaacagttgatatcaaccaagaatcactaaatgatgatgcacaggctgagtgcaagttgcttgtctgccattttgctcagaggttaattcctcagggtaattgggaattattgcatgttaccttag

SEQ ID NO: 252706 - DNA, 165 bp, Homo sapiens
ccatgaatgtttttatatacaggaaattcgagtcatttgtcactctgttatggattcataaatctgtatttttagaatgtaagtaaaggcaaacacagtttgcattcatctatctcaagccaagaattttctctaatgtgaaacagtcccttctgtcgtcttctc

SEQ ID NO: 252707 - DNA, 944 bp, Homo sapiens
aatcgggatttttttgtttggggggttttagccgggggagggactgcgaagacagctctgcatcaaaacagtacgtgagaaaaaagcataggacgctctcgcagccgtagttgttggtgacaagaaactgtgcttctaatctaagcaaaaaatatctccacatgccaactatacttttccaagatgtaccatggactactcaaactaacacagccttatttatgtatttaggttggaagtgggcaaaagtgtatcttgtctatgtttctatgtttctacgttgggatgacaccatcatccacccagccagacagttatcaaccttcccactttcttaacctcttacatccgattagaccctatgtcctctagttctcagtcttgagaccagcacccagctggctacatcagaattgccggtggtgatgttttagaagattccaaattcctggactccatccccggagttcatcccctagttttctagtgaggggcctagaacctgcgttttttaagtgtcatgttcatcgccattactgctactttagttcaggtcttcttggtcagctttttcctaaaacgttttcagttttgtttgcctctgattgactctgaattgctgccaaaatgatgttttattattccagtatcatcatccaactctctgatattaatgataccttttttaaagtttttcttcccttgcagtatctatttccctcaagtttcctttttttttcttctgttgattttgtgctctatctttcacattagaggctttcctaggatgtctggtggtccttatctgctcatatgtaagtgggggtatatttaaaagttgattggaagctgttgagcccatgggacgtttgttgaaaatcaagtgggagaggaggggtatggaggctgcggtatgtctcagaatttagtacaattttcactta

SEQ ID NO: 252708 - DNA, 416 bp, Homo sapiens
agggtgttttgactccatgcttataactacaacattaaaaacaccaataatggctgaatttttatcaagaaagtattttcttaattaatgcttactcaatcatttttactccaagataaatgttcaatacagagcagttaaacaatttctacctttttccatcttctattttatcaaaatcattttatggagatgaattcttttgcatttggaattttacaatgatggcttataatttattgacaataatttatttaggtcaaattttagcttctgccactgaattttccatcgtagttttatttctactaagtcaaattttcctggtttaaatttgattgatttgaattttattgggataatttgattcccctgtgaatgtttgctcattaacacattctttgtgtaggttaaat

SEQ ID NO: 252709 - DNA, 419 bp, Homo sapiens
ttgcatgactgcagttaagaatgcatctttattttgatggttgggctcctgatcgggaccattatagagctactcactagtttgtgcctcttcttgactttagtaggactgtgaagttcaagttgattcctgatttgctttcataggatctttctttccattctgggcctcagagtcaaaccacttaatcattcatgtttaactcatggtgagacctgtctcttgtttgttgtagtcacttaagttcctgttacatgtctagacttcatggggtgtccaactcagttaccacaaatgtctgtattacattttcaatgatagcacaatcttctttccttatgcatgtttttatctttacacaagtctttaaagcctttgttatttaatgcatatttctctatttgtttactcagacactt

SEQ ID NO: 252710 - DNA, 1796 bp, Homo sapiens
atggcctcatcgaccactcggggccccagggtttctgacttattttctgggctgccgccggcggtcacaactcccgccaaccagagcgcagaggcctcggcgggcaacgggtcggtggctggcgcggacgctccagccgtcacgcccttccagagcctgcagctggtgcatcagctgaaggggctgatcgtgctgctctacagcgtcgtggtggtcgtggggctggtgggcaactgcctgctggtgctggtgatcgcgcgggtgcgccggctgcacaacgtgacgaacttcctcatcggcaacctggccttgtccgacgtgctcatgtgcaccgcctgcgtgccgctcacgctggcctatgccttcgagccacgcggctgggtgttcggcggcggcctgtgccacctggtcttcttcctgcagccggtcaccgtctatgtgtcggtgttcacgctcaccaccatcgcagtggaccgctacgtcgtgctggtgcacccgctgaggcggcgcatctcgctgcgcctcagcgcctacgctgtgctggccatctgggcgctgtccgcggtgctggcgctgcccgccgccgtgcacacctatcacgtggagctcaagccgcacgacgtgcgcctctgcgaggagttctggggctcccaggagcgccagcgccagctctacgcctgggggctgctgctggtcacctacctgctccctctgctggtcatcctcctgtcttacgtccgggtgtcagtgaagctccgcaaccgcgtggtgccgggctgcgtgacccagagccaggccgactgggaccgcgctcggcgccggcgcaccttctgcttgctggtggtggtcgtggtggtgttcgccgtctgctggctgccgctgcacgtcttcaacctgctgcgggacctcgacccccacgccatcgacccttacgcctttgggctggtgcagctgctctgccactggctcgccatgagttcggcctgctacaaccccttcatctacgcctggctgcacgacagcttccgcgaggagctgcgcaaactgttggtcgcttggccccgcaagatagccccccatggccagaatatgaccgtcagcgtggtcatctgatgccacttagccaggccctggtcaaggagctccacttcaactggcctcctagggcaccactcgaggtcaatctggtgcttattctcagcaccagagctagctaagccaacatagggcaacatttccagcccagccctcttgtccggctgtctgtcttgtccttgtgtgtttgtaaaatgttaagcgggctttggtgagagtcttgctctttgcttgggggaagccaaagagagggaagaggatttcttatttcttctttatgcccttgaaggacaaacaaaactttttctccacgttcaggaaagtatttcagaaccacgattgccttcctggcgtcccctcctcctgctcgttggtgaaatgaacaatatgaatgggatttaaaaggaatgcattgggcttggtaaagattttcagtttgcctttagaaaaaggacccagctgagagtaccatgatattgcttagtccatttgaacccttgcattcctagaatttcaggtaaatatgtattaaaactctacatctaggatttcagcatttcctgagtaagacctttatatgccaaaagggtttcgttttaaaaccacttgagtttatagtacaaaaacacctacaagctccctttagaaaggtcttgctattgtttctcccctttcctccccaactactatttaaaaatgat

SEQ ID NO: 252711 - DNA, 256 bp, Homo sapiens
ctcccaccctcaggacctcaaggctggttggaggctccaccctcatcaaaccagtgccacccgcctcactggcatcagggtctggtctagggcaaccggctcttgacacagcgcccgcggacattttctattttccaggttctggggccctccactacccctgattcctgcctctcccccaaatccaggcacttggatccccaatcttctgaatcctggacagcccacccccagatcaatactcctggatctttca

SEQ ID NO: 252712 - DNA, 724 bp, Homo sapiens
tgacacagcgagactcaatctctaaaaaaaaaaaaaaaaccccaaaaagcaaaaaacaggaacttgtgagctagttgcttggaaacttgaaatcaaccatgatgagactgtttacaccacaggaattggcagaagctctaaaccagggcttttttctgagagaactgattcccagcacacccctgctgcccagcactcctctaaagggcgggaatgtcacagaagcttcttcagccccctttcagagttgccgtgtgtatttcctaagaagggtacaacttcacactggttgctgaacttgttcaagatattacatctctgccaagggccgtgtcattcatcctggcccttgtctgctgtactcgtgtcccccaagttggcagatgggtctgttctccttagtaggtggtctgcaaggggtagagttgatggtatctttgtaacagggaaatctcgtttcccactctgattctgtgcaatggaatcaaaaccactattagttaccctgacctcctgaatcctgctggggtctcaggcttccccttggaaggggaaggagtgattgtggcttcaggccaatgactcctgagaaagtgattgcaggcctgactgtcagtgcagggggcttgcagccagcattcccagaacctcagtctcttctctgccattgttcactgttacttggcagtcttccaagtgacgactgaaaacactgaaaaaaaaa

SEQ ID NO: 252713 - DNA, 246 bp, Homo sapiens
ccaggaagagtgtcccaggccacccacccagaggcccagagattcttactttctgaaagtcaccttaggagtattttgagctgcccaattaattgggtaaatagattttctcattgtcacagagatgtgggttgagaattgtttgctacctcccctttcactgagagcactgtgaatttttattagttattgccaattagttttttatttatcatttgatactgacatttggattctgttctccca

SEQ ID NO: 252714 - DNA, 304 bp, Homo sapiens
tttaacccctgaaagccagtgatctgtttttctactgtataattttgtcattttgagaagttatatagatggaatccaacatgttacatagatggaacataacatgtaaactttgagatgtgttcttcttactcagcatactcacctggagatccattcaacttgtgtgtatcagtagttaatttctttgtattggtcagcattccattatttggaatttatacagtatgtttatccattcacctgttgaaggacattgtttccaatgcttattactaataaagctgttatgaacattcatgta

SEQ ID NO: 252715 - DNA, 334 bp, Homo sapiens
ggaatccctttcgtttgataggagagctgggtgacgagaccctttatgagatccttacaaataacattcctgaatgtgcaccatactgggggaaatggacaaaaacactcgattaatagtgaccaagtgacacagcatcagaaagatgggcagtgacctctcacgaaggctatgggagtcattttatgttttttaggttacccagtcctcaccaaatagagtgacaatccacatatttggtttacttagcatgagtggaagcaaattttgtattgagagaaacttattaaaatgaaataaatctcatagttctataatcttgaattcattacct

SEQ ID NO: 252716 - DNA, 292 bp, Homo sapiens
ttataaaaaaaaaaaaaaagaaagataaaaaaaaatcctgggctcaagccttagtttcctaagtggcttagactacaggtgcctgccaccatgccagactaatttttaaatttttgtaggaatgtaaaatggggccttgctatgttgcccagggtggtctcaaactcctagccgcaagcagtgtttctgccttagactctcaagttgctgagactacaggcatgagccactgtgcctaggttgtcttttttcatgcagcaagaccccatctcataaaaaagaaaaaatgtta

SEQ ID NO: 252717 - DNA, 317 bp, Homo sapiens
cggcagcccctctgcagcgcggtgcgagttcctggaaaggctgcgtttgcgctccccggccctgccctcgaggcggggacaacccgcggcttcagcccggcgtccccctcctgctcggtcctcaaccccggctgcggccggcggaagcgcccgggcctgggagggagagggaggcacctccctgccggctcaaccccctgggcaaggggccgggagggcgcggctgggacgtgcccgggcccacgaaggcctccgccccacccctgcgcgccgcctgcaggggagaccgggcagggcgccccccgcctcccaggccg

SEQ ID NO: 252718 - DNA, 336 bp, Homo sapiens
gataaaatctcagggagaagttttggattctgttgtttttattttctgccatttgtgccgatttgagcggtaactgacctcatgaaacatggaagtattatttatgtacaaggaactgacccctgagaaattgaaggtcagcactaaaataaaaatgtagggggaaatgcaactaataaaatgtaggaaaaaaaatgtgaacagaaaatataataaacctacatggtggtgcttacgtagataaaactgaaagaggattgtaaatagaactgtaagaatggatttgtctaccatttattatattttgttaaaaataaagaaattcaatttacaata

SEQ ID NO: 252719 - DNA, 439 bp, Homo sapiens
caaataattcagattaaaatttcagtataaaagacttttgtttcttagagaaagttaaaataatcccatcatgctcaacaaatgcagcatttctattgttcacacaaatttctgatcaccatggcagacgtttctgcttacctactcaacgtctatttcccattcagtttttgtaatataacctgattttcagtgaggctgtacgtagccagctgcaaattgcatttcctaacctcctttgcaggtagaagtggccatgtgatcattctggccaatgaaacaaaagtggaagtttctgggagagacttcaaggaaaactctttaaaagagactcaattccattggagccaaaataatgcagcttcacatctccttaatggacagaagactacactgtttttgctgcacccagagataaaattattggttttggagtaaa

SEQ ID NO: 252720 - DNA, 183 bp, Homo sapiens
aatgaatatacattgtagtttatttaaaaagacattcatgtgcatatacccatttgatgctctcaataacccagtaaaataaagattattatcccccatataaaaatgaagaaagtaggccaggcgcagtggctcaagcctgtaattccagcattttgggaggctgaggagggcagatcacct

SEQ ID NO: 252721 - DNA, 3307 bp, Homo sapiens
agaaaattctgataagactattggagatggtgatattttcactcatttgaattctcatacagaagtgactgcttgtgaatgtaaccaatgtgggaaacctctgcatcataagcaagctctcattcaacaacagaaaattcatactagagagagcctctatttgttttctgactacgtaaatgttttctccccgaagtcacatgcctttgcacatgagagtatttgtgctgaagaaaagcagcatgaatgccatgaatgtgaggcagtcttcactcagaagtcccagcttgatggcagtcagagggtttatgcaggaatatgcactgaatatgagaaggatttttccctcaagtcaaaccgtcagaaaactccttatgaggggaattactataaatgcagtgactatggaagagcctttatccagaagtcagatctgttcagatgccagagaattcattctggagaaaaaccttatgagtacagtgaatgtgagaaaaacctccctcagaattcaaaccttaatatacataaaaaaattcatactggagggaaacactttgaatgtactgaatgtggaaaagctttcacaaggaaatcaacactaagtatgcatcagaaaatccatacaggagaaaaaccttatgtatgtactgaatgtgggaaggcctttatccggaagtcacattttatcacacatgaaagaattcatactggagaaaaaccctatgaatgcagtgactgtgggaaatcctttattaaaaaatcacaactccatgtgcatcagcgaattcacacaggagagaatccctttatatgttcagaatgtgggaaggtcttcactcacaagacaaatctcattatacaccagaaaattcatacaggagaaagaccctatatatgtactgtgtgtggtaaggcctttactgacaggtcaaatctcattaagcaccaaaaaattcatactggagagaaaccttataaatgcagcgactgtggaaaatcattcacctggaagtctcggctcaggatacatcagaagtgtcatactggagagagacattatgaatgcagtgaatgtgggaaagcattcattcagaagtcaacattaagtatgcaccagagaattcatagaggggaaaaaccatatgtttgcactgaatgtggtaaggccttcttccacaaatcccattttattacacatgagagaattcatactggagagaaaccctatgaatgcagtatttgtgggaaatccttcactaagaaatcacagctccacgtacatcagcagattcacacaggagagaaaccctataggtgtgctgaatgtggaaaggcttttactgacagatcaaatctctttacacaccagaaaattcacactggagagaaaccttataaatgtagtgactgtgggaaagccttcactaggaagtcaggtctccatatacatcagcaatcccatactggagaaaggcattatgagtgcagtgaatgtgggaaagcctttgcaagaaaatcaacactaattatgcatcagagaattcatacaggagagaaaccctatatttgtaatgaatgtgggaaatccttcatccagaagtcacacttaaatagacacaggagaattcatactggagagaaaccctatgaatgcagtgactgtggcaagtctttcattaagaaatcacaactccatgagcatcatcgaattcacacaggagagaaaccatatatatgtgctgagtgtggaaaggccttcaccatcagatcaaatcttattaaacaccagaaaattcatactaaacagaaaccctataagtgcagtgacttggggaaagccttaaactggaagccacaactcagtatgcctcagaaatctgacaatggggaagtagagtgctccatgccacaattatggtgtggggactcagaaggtgaccaaggccaactttcttctatctagttagaattatgaacatctggatcatatagctgatgtgtagttacacatatggggagacacttttgagagtgtttaagcaatgtatagtggccatctttggttacttgatattggtgttgtcaagctcctgcaaataatagtaaatgtgcaaggagatgattggcagtctttcttgtttcactttttgggcaaacagttttataaattcatggctgttgagtttttcatgttctgggtaccacaactattcaatattgacccgcaaaaattcataatgagtagtatgatgagataattttacattgtctaagcagcctaaggacactgagatcaaggcaaagagagggcaatttaggtctataatgaaagtgaatcagcagtttttgtgaaaacactaaagacagaaagaaaggactctactttttttaaaattttctttgggaagtcaccattatttattgttatatctgttggcgtatgctggggcagcagttagccaagaggtctgaaattgctctttgcctatttctcaaaagtctatattattaccttagaactggccctacgatcatggaacttagatacagggacccaggtctagatagcagcactttagatcctcagctttcaccacagaaacctgcacttttttgatgttgttgttaccaactcctgtttgaaaaataggacaaattaagaaaatggatatcaaatcctaaaattttttcccactaattttgttagtacattctctacatgttcgttacttgctagattaccatgagacacaagcatcttgaattttagtttgtgtccttagaagataaaatgtagttgaacatttggaagacttctccttttatctcctcacaatctctacaaactaatcttaattaattttgtttttcaaattctctgtatttgaatagacttttttgtcttttcttctatcaaatactgaaagaactgtgttgtaattttacaaataattgtgaatttgtctcctttagagctactaatttttgctttatatattttgtctttgattttacatacaatttagaattgttgtaatcttcctggttaattgacacattatcattattagatgtttctttttatctctagtaattttttgccttaaatgtactatgtcagatactaatatacatatggattaaaagctaatgtaaattagtactaacatttctggacaaggggagaagttataacattataatttcatttatttgtctcttatatggtattaattttgtatatttggattctgtacatggtgaacatagccaatcattatttgagtcaatatccatttaaatt

SEQ ID NO: 252722 - DNA, 504 bp, Homo sapiens
aaatcattgaaatgacttacaggcatacttgactacaagtaatagaggtgtggaaatgttttaactcatttgcaaatacttgaagtacaaaatttactcagaattctcattaatgggtatttatttatttttaattttattattattatacttgttttagggtacatgtgcacaacgtgcaggtttgttacatatgtatacatgtgccatgttggtgtgctgcacccattaatgggtatttataatgttgctttcaatcatttaaacacaataaataatacatatctgtcaacagaggactggttataaatttatagcacatccgcatgctggaacccaaggcaaccattacagccagcagcaaacttaaaaagatgaggcacactgggtgtggtgatgcacgtctgtgtatcaggtactagagaggctgaggtggagaatccttgagcccaggagttcaagtccagcctgggcaacatagcaagaccctgactcaaaaaaaca

SEQ ID NO: 252723 - DNA, 467 bp, Homo sapiens
taagattagtgttacttgcttctcttcaaagtatatatatatagttatctcaagtttgcctggctattttagtgatttactttaggatataggaagtcatctatacaggaagatacataagaaaatctaaattatagttttggtttagcatagaatagaattggagaaatttggcttgaagaattgttctattcagaaggcctgccatgaacaacaacagggatttatttgattgagtattggcagatgtagtcagtgcttccctgataggattaatgattccagtagatatcatagtttaccttaagaatgcaaacgcttagatggtgttaaaccagttctgccttctttctagcattttttgttagttaaaaagtacccctctagtagatgattatgacttaccagtacactataattttggcacagatcttcaaatcttgaattctgtctgccttcagactgca

SEQ ID NO: 252724 - DNA, 410 bp, Homo sapiens
tcttagagaacttgagcaagcaatttccccttttatagacttatttgtgtcacctacaatgccaagaggatggttctgacttcatagggttgttgagattactcaatgagattacaaacagcaaaggttcagcctgcgcctgggtgttagaattctgttccaagaaccaaacatctcacacactacttgatataacaaggtggtcatgtttacagagctacgggcactgtttcctaatatcactgtcaccaagttgctccatccatgttttcatcaagtgtttgtggatcacatcttatgtccaaaccatgggtgagtgacagcagttagagtgcggatagaaaggaagggacgagaagtagacggtagacaattttaactaaataaatgtttactaaactcatatcata

SEQ ID NO: 252725 - DNA, 630 bp, Homo sapiens
gctggcgtatgtctgcgtaccgatgctcaggcattagcaactggattggtcgtgcggaactgctccagttttccatgttttaaaatgataatccaaaaactacagcactgagcccaataacttgagggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatggcacgcgacatcgccacgatgtgcgtgccatgtgtgccatgttggccaggctggtctcgaactcctgacctcgtgatcagcccacctcggcctcctgctctttcccgcacatgctcctctccttcctcccaggggcaccaggcacaagtgtcccctgcccagaggactccaagacaaaggacgctcaccttatgccataaagcagcacctcagctgcttctccaagccattagccatgccacggccctctgtccgggctgagggattcgttgacaaaggcctgagacgtggggacatggcacgcgacatcgcca

SEQ ID NO: 252726 - DNA, 405 bp, Homo sapiens
ggattttgctgctataaacaaaacctcagcctttaaacccactgctccaacgcttcgtattggctagctgctgcatggcagggatggtggggccctcctgccctccggtctaggtggtggattccccctacccctcctgccctctcctactgagtgtcctgtgtccactggtgtgtttccacaggccggctttcagaggctaagttgcactccagagcagaaaagcagcaagccgcttctcccttctcccttctgaggaaagtgttcttggagctatgccaggtctcagtagagcaaacagattttcaccctttagaggtgtgatgtgtgctgtaattaatggtatgaaagccaatagatatttgtaaacaagttggacaaagtgacaaacctagcctaaatttg

SEQ ID NO: 252727 - DNA, 423 bp, Homo sapiens
cacagctgtgcatctcccatgggtgccctggatatgcgggtccttgtgttcttttgactctgactcatgactctggggctccgtagttgacttttgggaaatgctgctttggagagttttctcctgagcccccacagccaggggcactaattgcttattggtgatttgccctgaggtgccatatcccagcacctggggcggcacagggccttgacatctgcgacagcactgctgctcacaggccctgcttgccatccctccagttctaggccccaagcgcctggtaagtgagcagccaagctggtgtagactaggatggaatctccccacccaataatctgaagcttcagaagtcacagttccacgtgtaggtatgtcgccaacagaaacgggtgtatatctgctgcaagatgcaaactagaa

SEQ ID NO: 252728 - DNA, 435 bp, Homo sapiens
acctgagccccaggatcccccctggatggttacttgcagcctctccttgcattccagactaatgtcttgctactgtcgttacctgggtgatagcatcccagaagctccattccagccgtgatctgaggtctcagctccccaggacactctgctggctcaaatcccttgtctcttcatgtaaggcccagcctcctgtacctccctcccaagaaagcctgtgaattgggaagctttgttctctggctcagcctaggccatgaatgctgcccctccactccagtaagttatgccttatgctaactcctgtggtctgctgagctcctttgggagaagcagagagcttgctggggcacttgagccactgggaataagtggccctagatgtcattggtccaattgcctcactccactgaggaggaaactgaggccagaaag

SEQ ID NO: 252729 - DNA, 461 bp, Homo sapiens
aattcaggaaatgccactccaaaatatgccaatttggtatatgggttaattctagccaaaggcacttgaaaaacaacaaatgtaaggagaagctttctctgaactccccctatctgcctaaagacagatcctctaaaaggagctcagttgtcatcaatcccctccctgggaatttcatcaaccggggaagattaactctatcacaggagaagaggctagaagttgacaccacacctagacaaacttcttcaaaaactattatctcttcttctgaggacccaataatctttcccaaaaattatttctcccctaaattgcctatatctcacctcctctcccctgtgaagtagagatgtaaactcctgaatctcactggttgtttaggtgtatgctttcttttctgtactgccctcatgcacataataaaattgtatatcttttctcatgttaatctgcctgtt

SEQ ID NO: 252730 - DNA, 737 bp, Homo sapiens
gaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaattgacgaacacaaagggaaagaggagaggcacccgatatatgttctctaggccttttagaaaacatggagttgttccttggccacatatatgcgaatctataagaaaggtgatatgtagacatcaagggaatgggtactgttcaaaaaggaatgcccacaagtgttaccatggcaaaactggaagagtctaacattgttacccaagcatgctgtggcattgtggttaaccaaacaagttaggcaagattctgcccagagaattatgggcgtattgagacattagcactctaagagcggataagctcctggacgtgtggagggactgttc

SEQ ID NO: 252731 - DNA, 642 bp, Homo sapiens
gaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttaaaaaaaaaataatttatatattggtatataagaaaaagctctaaaccctgtagggggcccctgtagacaaaaaaaaaaaaaaacctggagggggggcccggtacccaatatgccctaaggggaggggtttcaaaataactggccggcgttttacaacgtgggactgggaaaccctgggcgtacccaacttaaaggctttggac

SEQ ID NO: 252732 - DNA, 436 bp, Homo sapiens
gaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaatagaaataaaatgggactcatagagggtgaaagagaagttggagtcagaggggattcagagatcaaagagaagttggggtcagaggtaggagctggggctcaggtggggggttaaaggtgaggcaaggtcagcggtgaagtgcaccccgtcgggtggag

SEQ ID NO: 252733 - DNA, 365 bp, Homo sapiens
gaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagccaattaggagggcactggcccccaacaggcatcaccccgctaaatcccctagaagtcccactcctaaacacatccg

SEQ ID NO: 252734 - DNA, 434 bp, Homo sapiens
cctgaacttgttcttcaacctgcaggagcttattgtctgttaaattgcagagattacctatgttacaggcttaaattatagatgtgaagatggtaaagggagacactattttaatcaaaagcttcctgggtacaaagctaatgagaggaaaaattacacattttatcaagctctttttcaagtaaagaatagctttcttttttcatctggcttcttgcctgaccttctccccttcccctaaatggtgagaggaaggagagcttgcagatagattttccatatcgtaggggatttttatatctgggaagcacagcatttcatatttataggagggtgtatattgccaaatgggatatttggcattacgagtcatttccagctgagagagtaaggatgcagcctggaggggaaaatagagacaaaagaggtagagg

SEQ ID NO: 252735 - DNA, 514 bp, Homo sapiens
aagtttaatttatcaaaatatatgcacacaaacacagactttacatgataccgcttgtagttgagagaaatgtaagcaaacataaagatgcagtaatagctacataagatttactatagtacatactgtactactgtaataattttgtagttacctcctgttgctttatggtaagctaaggtgttttgagtgtccacttaaaatgctgtgtgatgcaaccatctctgcgacagttcagctctccagtaaattgtgaattgcagtgaaaggtgatctcgcagttcttgcatatttttcatcatgtttagtgcaatactgtaaaccttgaataacaccaggggacccataatgtgctactggtgatgctggacatgctcccaagaagtagagaaaagtcatgacattacaagaaaccattgctcagtatgtaccaaagatacatgttacaactgtggctgcagttattcaccatttctggataaatgaatttaacataagaaccatggttaaaaaa

SEQ ID NO: 252736 - DNA, 482 bp, Homo sapiens
gttttgagaaatgaatgctaaatactatacattattccggtcatgtgtttgcattggaatagtgtagtggtgtctaagccaaatttacttgagaacaaatgtctatcttattggatgtaatgatgtaaagcatattaatcatactttaagtttactcagtgttttatcatggattagccatctactaattttgtcataaactttgaattgtggcaaataaggttagagcaatacatatatgtcaatatggaaagcaatctgtttattctttctgcatatacaacagtaatatagtaatacctgttatgatcattgtaaaatccctaaaggtttgatagtgatgtgtactttgcctgaggttaatgagtctcaaaacttatgtttaaatatttattaggaacagaacattcatatagcatttggaaagtatttgaaggatagcagtaagtccctcacatttcttccacaaatagacttataag

SEQ ID NO: 252737 - DNA, 172 bp, Homo sapiens
atggttacacaccattaaggacaacagctgatccatacatttgctgacaggtgtacctgcgtttccctctgaggacatcactgaaatcatggaaccctgacattcactgactggacccatgggtgggctataggttgccaggccagaattacttctctgctggaggcacact

SEQ ID NO: 252738 - DNA, 460 bp, Homo sapiens
caggggagtatatcagggaagagagaatttaacagggagagcagaggaggcgcagagatgggtgaagaggcagaaatagatggagattgaggacgattgaaagattggggagaaggagcaataagaggttaaataagttgcgaggatggagcagaagagatggaagagaaggaatagagggaagaagggggataaacagcagaagagaagaggggtacaaaatgaagagcagaatcccagggagaaagaaaagaaaacaagagctagagagagaagggggagaatgagagatatgtacagaattagggagggaagcgcagtaatgaagaaaggggggctaggcacagtggctcacgcctgtagtctccacactttaggagactgaagcaagagaattgcttgagtctaggagttcgagaccagcctgggcaacatagtgagacccctatctctgccaaaa

SEQ ID NO: 252739 - DNA, 155 bp, Homo sapiens
ccccttgcagacagctgtccctcagtcaccaattgtccacagggggattcgcattcgctaagggcacagccatctccagagatgagagatcagcaggggctctgcaaaaggagcagcagcccttcagccttgagagagaggatttcatggtaaat

SEQ ID NO: 252740 - DNA, 507 bp, Homo sapiens
attccgcgttccccgggagcaaatgatgctaggaaaacagggtgcgggctcttatttggccggagtggagtgaccaggtcagcgccgcagctgctaaccaccaccaaccacagttttgaaagttcctgggctttttccggcctgagggccgacgctgtttgcaaaatcacaagcactccttagagcggggttaggaatctagagtttccaaatccctggaacctttagcatctcgccaagcctccctcatcaaaggagggaagtgaaatcagagccccactccggctgttttagaagttttcccgaatccgtgatccctttacaaagcccgggccctggcctgcggggcggggcgcgcgaacggcgagctattccaccagagatccctccacgacctccagcggcatccgcgaccctgcagcttgctctccagccacggcgagcacgggccgggggagaggcgagcgggaagggcgaacggcgacccccgcgctgccccgcggccgc

SEQ ID NO: 252741 - DNA, 216 bp, Homo sapiens
ttattttttgtagagatgaggtctatgttgcccctgctggtctcgaacccctggcctcaggcagtcctcccgcttcaacctccaaaacgctgggattacaagcataagccactgtacctggcctgtttttttgtttgcttttttaaatattagcagatacggaaacgagctgaacaggtcagctctacgggaataaatggtccccctttgaggaca

SEQ ID NO: 252742 - DNA, 448 bp, Homo sapiens
agtaaaattgggagatgattcatgtagattaactatatttttgtatcactttctagaatacagtactatgttgtttaaaagagtaagtaggtaaaggagtggtataattactttggatatttctgcgtcagccacagttaccatgaataaatgatctgtctttataaaggagatggaagtgaattcaagatattgagatgttagatttgactgggttgtcctttgactagaagatcaccagataaagaaaatgtaaacttcctaaaccagataagatgatattgttaaaaaatttttttggcccagcactttgggaggctgaaatgggaagattgcttgaacccaggagtttgaagctgcagtaagctatgatctaccatgcactccagcctgggcaacagagtgagaccctgactaaaaaaaaaaagtcgacgcggccgcgaattta

SEQ ID NO: 252743 - DNA, 371 bp, Homo sapiens
gatgccatttataagatgcatctttattttacatgctgctatgaaagaaaaaactctgccaattgtaattctaagttgccgctgatggtaatggtgcatttagattccagagatgataaaaatatttaaaatgagtgtcttagaaccaaagaaatacaatatgcattgttgagttcgttgaataatgagtttgtaacattttatccagaatattttcaaaattatccattgttccatagaaattaactttgttgtaaattaataaatgtgtcaataatcatatgtgagtaacacatgcaacacgactctatagatatgcagagtttagaaatgcagaattgaaacatttatccattccagccacctcaccc

SEQ ID NO: 252744 - DNA, 250 bp, Homo sapiens
cttagcatggcccttgggttttattgtggttgcaacagaaagccatgggagagtttgtttccaaaagatgacactgactgctgggtggagatggcattagaaagggtcaagactgaaaggagggtgccccgttgtgttgctatttcagtggtctgggatggatggcagaatgcagagggaaggaagtgggtgtatctaaacaagaagatggagaattgacaggagctgctactggactaactggaaagca

SEQ ID NO: 252745 - DNA, 613 bp, Homo sapiens
caccaacagtggctaactgttacacgacagtcaaagtattcgagagaactgcctggagacagagagcgagggtccacagacacattagcaccatactgataggtcatgcagcaggatgttccctcccgagttcgagtgtaaatcaaagcatgaaatgatacagtgcaagggaatctacacccggagcttctacagagacaagttggcgatggctgactccttcttcttcaagaggtagatgatgttggccacccacgcttaggttcccatcacactgatgactccgggtttggcgagcacaggagcgcaaaccttttcacattctttctgtgatccaaatttgttttcgtttccaccacaacctccataccagaatcttgcacagcttttggtgtttggatcatagtaccattttaatatgaaatccctgcaacttcctcctcttaggtttaagctatcctcccgcctcagcctccagagtagctggggctacaggtgtgcaccaccacacctggctaattttttgtatatttggtagagacggggtttcaccttattgcccaggccatcatgtatcttaagaaaaaaaaatacaaagtacagagaaacattt

SEQ ID NO: 252746 - DNA, 585 bp, Homo sapiens
caatcaagcaacatcagttaatactgagaatacatgtattttccacccatcagtctaactccatgtaatcttttccttagaaataaaagcaccagtaagagtttacaggagtgttagctgcaacagtgtttcaattttcaatgttagtagtggcaaaaaacgtggaaacaaagggaatgcctgttaataggggtattgttatgtaaattatggccgaggcattttatggaatgttgtgaagtgattaaatggtaggagttaaatctactggtgattagaaaggatttccaagtacattctgaaaggatttctatcatgtgtctttttttttttttttttcctgagacaggatcttgctctgttacccaaattggagtgtactggtgctgtcttggctcactgcaacttcctcctcttaggtttaagctatcctcccgcctcagcctccagagtagctggggctacaggtgtgcaccaccacacctggctaattttttgtatatttggtagagacggggtttcaccttattgcccaggccatcatgtatcttaagaaaaaaaaatacaaagtacagagaaacattt

SEQ ID NO: 252747 - DNA, 560 bp, Homo sapiens
cagtcccaggaccggggtgaggcacagcacagaaggaggcgtctcgcagggtcgcacaaggccccctcaggagatgcctccctagacctttcatcccgggtgcctgccgggcctcccatgtgccacatgtgccacgctgttaaataacagccacatgtgaatgagacaaagacacacgactgccactcagtttccagtcagggcagggtaagctggcttatctcagctgagctggtggccttgtaaccagaagcacagaaagctgacattgtaggagtcctgtgcagccttagaatggggaaacgaaccatgttcttggaagtttttgaactcctggagctgctcaacacagaacctccctactgccacttcctcagccttaagcgtggggaccctacagggaaatctcatctgtgtggcccaatgtcttgttttatttttatttttggagacggagcctcactctgtcgcccaggctggagtgcagtggtgtgatctcggcttactgcaacctctgcctgtgggttcaagcgattctcctgcctcagcctgccaaatag

SEQ ID NO: 252748 - DNA, 613 bp, Homo sapiens
tggaggaggattttggttgagaaattgggaggaggaggaagtagcaactaagactgagacgaatggccagttaggaaactcaagaatatgaaacactagagaacaataaagtgtttcaagaagaacttatgggcaactgagtctattacagttgataggtcaagtaggaggagaactgagaagtatccataggatttgacagcattcaggtcatggggaatgaggagctatttttgtggagtggtaggcacaaaaacctgacatggtggttgtaagaggaatcaaggagaaggagaagccatgattattaggggtatttgagttcaagacatattgaggctgggcatggtggctcacacctgtaatcccagcattttgggaggccaaggagggcagatcactcgagcccaggagttgagtctaacctaagcaacgtggcgaaatctggtctctacagaaagtacaaaaattagccaggcgtgtaatgtagtcccagctacttgggaggctgaggtgggaggattgtttgagcccaggaggtcgagcaagcatgcagtgagccatgatcttgccactgcactccagcctagaagataaagtgagaccctgtatt

SEQ ID NO: 252749 - DNA, 223 bp, Homo sapiens
ggtactgtccccacatgagtgattttacaagttgcatgagttagcatctatatgctgttgtgagtcccctatgccttctctctggtagctctctccgagctttggtgaacctcttgtttaattgtctgttagctccatgaggatatgccacactcttttgttttgttttaggaacagagtcttgctctgtcacccagactggagtacagtggcacgatctcag

SEQ ID NO: 252750 - DNA, 467 bp, Homo sapiens
aggagactgagtttctactccccgaggacccataaggccggtttcttttcctctctctgttgtgatggctttcatttgtttcaaaaatgctttcttgtagacaggatggatattatctgtaagttaggcggttcaatctaccctctaggggcagtcaattgcctaaccagacattcacatttcagctctggtcagcgagcacttaatcagaaagtccaccctctggaggcagctattacaagtgcttcgtctctctttatcgcccatcagcaccagcggtttggctaattgacataatgaaatgttagaaatagattctcattggtgagattaacagcattcaagataatgcggattggctgggatatgtcagacactctcctagcttgcatgaacaggatattgagaatgtagcaagccttggtacctatagccataggaaataaaaccatacctttgatcttaaa

SEQ ID NO: 252751 - DNA, 485 bp, Homo sapiens
agtctctccgtagagagaatacgataactgaagagggctttatatgctgagatgaaatttagtttgttcaaatccgtaatgaattgccatcgggaaaggaattttctagagagatcttagtcatctaatttgcggctggcctacttgacctttttcttctttactcctgaatcttgtttataaaaaatgcaatgtaataaaatataatttatattgtatgtaatataaattatttatacctctgtgaatatatatgataaacaaatgaatatatacaatgtaatgttatattacatcatgggtcattttcttcctaaactataatcatttttacagttttaaaccaaaaaggtagtgaaaataagcgagcccatattaaatttctaggaagtatccctaaattgtttcctcagtcttttgacttatttcacatggaatcctaacatacgtggttgtctgtttttccctgcagcccgggggatcca

SEQ ID NO: 252752 - DNA, 245 bp, Homo sapiens
ccaaatcctgcgctcattcatggcaccctgcactgcatacccagagagcatatgtgaaatgtaaaagctctgggttgtggttattttttccctttttactcagtagttcaaaaagcagaggtttttctgtaattcaaaagcacccatccacatctcgaggaaggaacaggtcacccaggctatttcttttatacagtgtcattattctctacctagcacctgacaaataccactcttgtgacgtc

SEQ ID NO: 252753 - DNA, 387 bp, Homo sapiens
attctatgtcattttcatgtaattatgattctagtaaagagaatgtagctaaaattattatgtatatctgacatggcttctatttttaatgaggagttttacttaattcacatttgttgtaatgatcgaaatatttaatcatgtataacctgcttgtttatttttcttcttcttttgtattaagcttattttattagggtattttttcttcattctttctttagtaattctgcattccatttttctcacatcgtgtttgtttaaatacagtatgtaaacttacaatttccaattctatgttgacattaagtatgtcctaaaattgctctttctgaattagattctcagtaatttttcattttctttctacttccctgccccttcctg

SEQ ID NO: 252754 - DNA, 121 bp, Homo sapiens
tttcttttacccattgtgtgtttttgataactttgtcaaaaatcagttggctgtaaatgcctaggtttatttctggactctttattctatttcatttttctatgtgattgtttttatgcca

SEQ ID NO: 252755 - DNA, 323 bp, Homo sapiens
ggttcaaattaagcactaggctgtagaggtaccaattctttgtttccggaggcaggatgctttcttggcatagatatacaccctgaggaaggatgtggctagcaataattgtcctctcctcttttaatttaaacttttaattttagaatagtttggatttccagaaaagttgcaaagatagtacagagtttttgcgtactccttacgccgtgtctccgttgttaacatcctgtatcattcttgtacatttgtcacaactaaggagtcaatattggcacattgctgttaactaaactgtatactttattcttatttaactagat

SEQ ID NO: 252756 - DNA, 351 bp, Homo sapiens
caactttgtgaagaaatgcccacaaggatcactgaagagtggggctgagtcaaacattagctaaccacttactatgtgccattcactttatagtcgttatctcagccatgttacccaggctgatctcggactcctagtctcaaagtgatgggcctcccaaagtactgggattacaaggcgtgacccacccagcctattatctcatttttaacgtcacaacaacacttcagaggaagatgttgtgattcagcttttatttctttatttatttttgagacggagtttcgctcttattgcccgggaggcggagcttgcagtgagccgagatcgcgccactgcactccagcctgg

SEQ ID NO: 252757 - DNA, 187 bp, Homo sapiens
tacaggcgtgagccaccatgcctggtcaaacataaacttactttcttacctcttctgctgaactctatttgcttcttttctcaacttctgctgaactctattttgcttctttttcctggataaagctcttctttatccagaagacttttagcaacaaagttacccaatgcccttccctagtctctcc

SEQ ID NO: 252758 - DNA, 464 bp, Homo sapiens
atattttctcccattccgtgggttatctcttcactttgtggattgtttcctttgctgtgcaaaagctttttaacttgatgtgataccattttgctttggttgcctgtgcaaccaaatgggatattactcaagaaatgtaattacttttacatttatttaatgtagaggattactcaaaaaatctttgcccacttcaatgtcctgaagcttttccccaatgttttctttcagtagtttcatagtttgaggtcttagatttaagtctgtaatccattttgatttgatttttgtatatggtgagggataggggtctagtttcattcttccactaactccccacccatcttacacccattctttccctacctcacccaccattctctccccctctctctctatctcactaccatcagaccacttctcactcattctcactcccaccactctctccacctcctcccccg

SEQ ID NO: 252759 - DNA, 410 bp, Homo sapiens
ccctccatttcctatatttactcttccagcagacagggacatggaaaaatccgtgacctagcactgacccagcagataagactaaccaccataagtacagtttttgaaagaaaatgaagtagttaaggctaaagctttaacatggagtcaagcgtttgtaagagcattgcactcacacctgctaaaggtcaagccacaggatgttgctgtagacctggataacaatggactgaagtcaagttagcaggtctaatctgtgccaagtcccaaatttgaaaagagggaaggtttcttggaatctaggtcttcagttgggccaggttgggtccaaaaacaatgatcactgagtactaagaaagccaaaggcagcagaacatagaggagtagaaacaccaagaaaaggctcaaat

SEQ ID NO: 252760 - DNA, 396 bp, Homo sapiens
ccttgctctgcgttgcaagggaaggggtgtgtacaggctgctgcagaggctgctacaaaacctgaagcgccacagcccgcttagctccgtgaagagaggagtaagcacaaaggttctggagccatctcaagatggagacgggcctggagccctgtagttttcttgcctatagggaagggtgtgggcacagtgcaaatgcccaaggcacaaagagaaaccattcccacgtgggcttttgctgtgtgcctttttcaaacaatgcaaagacgaaagaagattttaagaaattaacacagctccagtgttcctcagttgaagaaggaacatttaggaaaagggataattcatggactaaaagacctttctcccctagagggacgaagctaaaacatagca

SEQ ID NO: 252761 - DNA, 6850 bp, Homo sapiens
  misc_feature (731)..(731): n is a, c, g, or t
  misc_feature (1350)..(1350): n is a, c, g, or t
  misc_feature (2925)..(2925): n is a, c, g, or t
  misc_feature (3166)..(3166): n is a, c, g, or t
  misc_feature (3229)..(3229): n is a, c, g, or t
  misc_feature (3231)..(3231): n is a, c, g, or t
  misc_feature (3433)..(3433): n is a, c, g, or t
  misc_feature (3646)..(3646): n is a, c, g, or t
  misc_feature (3695)..(3697): n is a, c, g, or t
  misc_feature (3787)..(3787): n is a, c, g, or t
  misc_feature (3861)..(3861): n is a, c, g, or t
  misc_feature (4019)..(4019): n is a, c, g, or t
  misc_feature (4117)..(4117): n is a, c, g, or t
  misc_feature (4177)..(4177): n is a, c, g, or t
  misc_feature (4211)..(4212): n is a, c, g, or t
aacatatatcctgtccttagatgttatttagcctcagagtgaactgtgtgatacacacacaaacacacacaagtatatatgaagtttacactcttttgttagtctcttgtgtagtgaatttatttttgtacacctgctacccttctcttttgtttgtttttgttttttgagacagtcttgctttgtcacccaggctggattgcagtgatgcaaccttggcccactgcagccttgaccccctaggctcaagtgatcctcccgccttagtcccccaagtagctgggaccacaggcaagtgccaccatgcccagctaatttttttgtagagatggggttttgccgtgttgcccaggctgtctgagatcaagtgatccaccagcctcagcctcccaaagtgctaggattagaggcgtgagccacactgcacccggctccctgtacccttcttaatacgaacttaaagtgttcgtaatgagccaaccgttgtaaggtttttggacttcttataaaaagccagattcaaatacagttgtttagacaaaaatgtcttagtatggaaatatgcatgagcatattttcctgccagatttgtggttagaaaagaagcaaattttcctcctagagtggaaggaagaaaaaaacaataaagaaaagaagcaagctattcaagaagaaggtagtatagtggtagctttttgttgagaccagtcaccagcctggaactttctttngtaagtaattagattcattgaataaaatgttcaaccgagcttggtgcaatctcatagttacaaaacactcttgccaaagaaagttgcagtcttaatatccgtaatcgaatcatttcctgttcgggcttgcaggtggggaacaatctgaaactgcagtcctataagattagttataaagaaaacgccttggtgggagaagccttgatgataatattgaatagacagcctaacaagtgtggggatgaagaaggtacaccaggatcctgggactaaccagatttaaaggcgtaagtcgggatctgcaagcccactcccttggggtgatctgaataaagctactctagggcattcaggtatgtgctgaacacactcgggcagtgggccaggcagatggctcattcctgcaccgaccttcgaaggcctgccaggttgaaaagctaccactggggaggcatggctgtgctctagcaagaacaagaacatgcatttcatgtagcatttggtccttcccagttgagggagatgccttaggactacgttaatctctgagtccacttagggcttgggatgtattctcacagcccttgctcctcctccatcttagagtttatttttaccntcattgcaacctcctctaagtgattcttccagacccatagttagcctttgagattccgcagttctcctccctactcttccccaccatgtcttcattgagacccacatttttaggtttgactaaaccttccatctaggaataggtaggaggctaagcaatttaggccgcattcatgtatcctgtcatttgcttcactgcatcttcttggctgtggtaaaggaaatttaggtgtgatacactccttaggcttccctgccctgcccccctttccttttgcccttttgattttttttaatctgatactcaggctctcctcccgccttcacacaccattggagtctcctaagctatttctgtcagtttaatgatccccagctgttgccacagttcaggctgttttcatgcccaggagaagcatcgaagaggcagaggaaaaggggtcttgtttgttgtctgtcccacagtgtgtaaaacaaatcaaattcatttttctgaaactactagtgagattccttagggatggatgttaatactgggatgatttgaaaatcaggaggaggaaaagtacatggtagtatcagggacatttttaaaataagcattctgctgataggtgtggcactctgcatcactcagaattatgctagaaaattgaggtatgtggtatggaggaattatttgatcactttgcattcttttagattttttttttttttttgagacggagtctcactatgttgccaggctggagtgcagtggcgcaatctcctctcactgcaacctcctactcccagatgcaagcgattctcctgcctcagcctcctgagtagctgggatttacaggcacgtgccaccatgcccagctaatctttgtatttttagtagagacggggtttcaccatgttggccaggatggtctcgatctcctgacctcgtgatccgcctgcgtcggcctcctaaagtgctgggattacaggtgtgagccaccgcacccgcctctacttttagattttgagctggaatttcccttctactcatgtatgttgaaggagtatctaaattaaaagaattctgtaataggaaatatatggaaattgtttctgaagtatccagaaaaggcatttatttaagttctgctttaacttaatgcaggtttgtttcgtaaaattttgtgcaaaacctgcagtagtgaaatgttccatttgcaaattcaaccacacagacttcaggaaatacaaagttgcggtacttataacatgaactcttctacagttacacctacctttgcttttgaaaagtctttactaaacctgggggatgtggagtgggaaaatcctacagtagttaaatgggctcctaatgtattataatgatctggcttctcctttatgtgtttgatcttgagaattttaacccattccaacaagtttagctgatttgtagcttttacgctcagacactacatgaagtttaattttatggatttctttcttccacagagaagacaaattttgctgcagactttatcaaattttatttttaaatttttatctttttgagtcaaatagctaaaantttacatcatttaggactgaagagtgagaatttactgttttttttttctttatccatagaaaacttgatacataaacatttgaataagcttcagattgtttgtctatctaattatctatctatctataacccaacccatatggtctaatttttaatcacctttctattccctactgcttcccatagaaaagggccaggtgtagtgcctcatgcccaatcccagcaaagcctgtaatcccancattttgggaggttgaggtgagcggatcacttgagtccaggagtttgagaccagcctgagcancntggtgaaacaccatctctacaaaaacaaacccccaaaaagcaaaaattggtcaagcatgctactgtgcgtctgtagtcccgattactcaggaggctgaggtgggaggactgattgagtccgggaggtcaaggctgcagtgagccatgatcgcaccactgtactccatcctggcgacagaatgagacctatctttttattttnattttaattttttttttttattgagacagtctcactctgtcacccaggctggagtgcagtggcactatctcggctcactgccagctctgcctcctgggttcatgccattctcctgcctcagcctcccgagtagctgggactacaggcgccccccaccacacccggctacttttttgtatttttagtagagatggggtttcaccatgttagccnggttggtcttgatctcctgacctcgtgatccactcgcctcggcctcccnnngtgctgggattacaggcgtgagccattgcgcctggctgagaccctatcttaaaaaaaaaaaaaaaaaattactttaggtctgtcatagtngctcacgcctgtgattccagcactttgggagactgaagcaggaggattgcttgagaccaggagtttgaaaccancctgggcaatatagtgagaccccatctctacaaaaaaatttttttaaaattagccagacgtggtggagagcgcctgcagtcctagctatttgggaggctgaggtggaagaatcacttgagcccagaagtttgagattacagtgagctgtgatcctgcnccactgcattccagcctcggcaagagagtgagatcctgtctctgtgttttgtttttttgagacgggctcactcttgttcaggctggagtgccgtggcncagtggtggctcactgcagtctgggtcaacaggcatacactacaggcacacacaaccagntgttgtctccctgtgttgcccaggttggtctccnnctccagctctcaagtaatcctcccaccttgacccccacaaagtgctgggattataggcacaacccactgtccctggcctaatttaattttaaggaaaacaattttttgtcacttttggtttgctctagaatgactaccctattccaagttttgaatctgtacaacaaagttgggtgcagaatgtcagcatcagtgataccagcagggattagcaaatgagattcaaggctgcccatattttctcagtgaatgggcagaactaatgcaataaggaaaatgctgttcttggtgcctttaactttggaagggagtgttcagatggccctacctaaaagtgctaaaggaagcacattcctagtttatctccaccctgttcaggcatctggtgcaagtgcatgctatgcccagatcttacatgatggagttggttgcacattgctttatagatcctcaggaaagagactgatgacattgaagtaattggcactttgagatctgtttgccaccattagaataggaggtcacctcaaggggggagatgagcagctacccaaaatgaagtggtgagcttcagatttttgaggatgtggggaataatatttatttatagttattaatatttttattatgactgtggcataaatgtgatatagtagaaaaagcacaagctttgatatcaggccaacctgtgtttgaactctggctctacctgttaccacttgtgcagcttcttcatctatgagatagtacatatctcaaatagccattgagatgaaatgagtcaccgtagtagtacttctacccagtgacaacacaatgtaagagctaaacacattagagtcctcatttctttttttttttttttgagatgggagtcttgctgtgtcacccaggctggagtgcagtggtgcgatctcggctcactgcacgctctgcctcccgggttccagcgactctcctgcctcagcctcccgagtagctgggactacaggtgcccaccaccacgcccagccaactttttgtatttttagtagagacggggtttcaccgtgttagccaggatggtctcgatctcctgaccttgtgatctgcctgtcttggcctcccaaagtgctgggattacaggcgtgagccaccgcgcctggtcagagtcctcatttcttctattttagttttcttttcaaggcaagccttttctcagtgcctttgcacttgcaatttcttatgtctggaatactctccagatcatttttatggtttgtcatattatttaggtttctgtccaagagtcatcggtctcttcaaaagggccttctctgtgtaccctatctaaaattatcaccacccctgtcactctctgttctcttgttccactatatttttcttcacataatgtactccctgaaattataatacgtacaccttatttattatgttttccctgctagagcatatgttctatgagggcagggacctcatctgtccatgttgttgttttattgcctataaatattgaccttatctgttcatgttgttttatcacctgtaagtatcacctatacatattagttcaataaatgaatgaacgagccaactgacaatcttcctagtgcccgaaaagaacctgtggccgaatgcaggaaggaagttgtaccaggaagcaaatgctctctgcttttgtggagtggatgttcccacactgagagccagataggcagtagtcctgtgacgtcctcttacatccttttagacttcttcctgtctctctgtctgggaagagcccctttgacctttatttagtatttgttgttattttttgagacagggtctcaccctgttgcccaggctagactgcagtggcataatcatggctcactgcagcctcaacccctcagcttccggagcagctaggactacaggcaaggactactacacctggctaatttttttaaaaaattattttttgtagaaacgggggtctccctgtgttgctcagaaaagtcttgaactctggccgggcatgttggctcatgcctgtaatcccagatactcgggaggctgaggaaggagaatcgcttgaacccgggaggcggaggttgcagtgagcggagatcgcgccactgcactccagcctggtgacagagcaagattctgtctcaaaaaaaaaaaaaaaaaaaaaaaagtcttgaactcctgggcgtgatcctcccaccttggcctcccaaagtgcagggattacaggtgcgaaccatcatgcccagcctgaataacctttagatgtgaccaccgttatcctgttaaaatctcgattccttttggaattagaacataagcattgttttcagtctccagagttctactgtgtcatatactctacatgttccatactattcactgaaatcacctggattttcccctagttagtaagtatgtagatcacttttttccatccatatcagcatgtcatgctgataacactatcaatatagtgtcattttaaaacagaggagtgggggtgcagtgtttcatcatgactgtaatcccaggaatttgggaggccaaggtaggaggataactggaggccaggaattcaaggccagcctgggcaacaatgcaggaccccatcttgacaaaacat

SEQ ID NO: 252762 - DNA, 399 bp, Homo sapiens
gtttggcttaagccttataatctaaaaaatatcagccaggctattctatcttctaagacctggctgaatcatgagccagttctaaatctaaagagagtgagagagggaagaaatctggcacaaacttacagtctctttaattacatgtaaaatgcatgtgactgtattacctattggcttagccccatggagggtttagaaaaatgtgtagtctttgtggaagctatccaattatccttctcccaaaaagatgttttaaatgtggaatagtattacattcccctgcccctttatgagtccttcataacttactaaagctgaccaattgttatttatgtaacctggctcattcattgtcaactaagaacctaattatatgcaatttattgtaaaaaaagc

SEQ ID NO: 252763 - DNA, 725 bp, Homo sapiens
gaaggaaactgacattcacagtacccagctggtatagttgaacctagaattgaccagactgtcccctccaaagcctggattcttattccaggagggccatcaggaaagctgacaaacacaaagccattttccaagagcccttgggactgaacaggtcaagggtcctctgaagattgtctggattcaggatgcaagggtgggagtggagcatgtgcccacaatccacagtgtgttctgtggctagatccttgccaaatgcaaccacctcccttcggctgaattctgtaaggataaaagagtccaccccaaaaagcatggccggaaagtcaggggagggctccaagccttcctggtcaaacgatccatcagccagaaaaacccatgtatgacctcaacaactaaggattactgtttcattgtatttcagaatgtgtagtttcataagatctgggtctgatttctggtgttagtttctgagtccacatgtgtggaacagactccaacccttaccacatagaataggaactttggtctatttggggaggtgtaggcattacattgggctaaaggttatgacagggtttgctatcatgacttaaggtgatcctcactgaatttgttattccaccatcattatctcactgtttcagagcaactgatacattttttattttgacattttactgtaaaaatgacttttctctatgtcttcttccacagcatga

SEQ ID NO: 252764 - DNA, 449 bp, Homo sapiens
tttaggtccagtggatcagaatacagggaaaaaactaatgagaatccctcaatggatccttcacccaccaaacaagatttcttcagaaaccgacttgctcttgcaaatgaccttgaccaaggaacagctgtgtaaaacatacttaaagttgtattgtcaagtggtaagatgaggataaaaagcttgtatatatctgtgtaggaatatatatatatatctatatctatatatatatatatatcgatgtataaatccctgaggaaaactaatataaatacttacatatgaaactaaacatacaagacattgaagagatgaagattagtttctggttaagatctggctttttgaacctcaacactggggaaaagggaaatgaagacttttcacatcattacagaaaaacacaataaatttggaggaaaataaatgtttgtaagaatgaaaac

SEQ ID NO: 252765 - DNA, 535 bp, Homo sapiens
tgcactgaacccctgccctttcattcttgggcctgtgctaatttctgtgcattcccaactgtgatttttcaccaatttaggggaacctcctctgccagggcctgcttctccccagcagtgcttgcaggggcctgggctggctggcatccctgggtcgatgggtgctcctctccctgcaggctggccactcagtactccttgtccctggcctcgcagcccacccgggaagccacagtgaccagccaccaggtgtgccatcgtggaggaagtccaggttggagaggtggtcttctgtgagcaggtccatctctccacacactgaggcccctttctgcctgtgacagccccacctcgagggtcagggcacagccatcagctccagctcccagcatgctactgccacgccccgagtgtccgtctgggcactggtccatgacctgttgtctttctgtatctactttctgcagcccctcactgaggaggcctcctgggtttgtccagtgcctgctattaaagctttgctccaagttcaaag

SEQ ID NO: 252766 - DNA, 489 bp, Homo sapiens
ctgttctgacaataatcacagatgaaatgacttgctgtgccatccagtaaaatgctagttcagctcacaagtgactctcttctttgtttcttaaatgcttgacccagaattttgcatgtagtcatcaagacatcgccccacagctgagctgtgtcatggaacagccagcccatctaaaaggctgcctactcatcagcctgctcagcctgtgtgggctgggaatgtggtgccatgcaggggaggcattccccccgttgcatggtaccacataccctttgggaaagagctctgtgcctgccccataaacactctgtggcaccattcctccctcctgactctgcctgtcttctgccatcctttgatgtgtaaattggaaaactgtcatcacctattgatctcaaaaatgtcatcctatgtgaaaagttagtgcactctggaagaacaaactggttattaaccataattcagttattattaaaccactatctt

SEQ ID NO: 252767 - DNA, 493 bp, Homo sapiens
gcagcatcagcctgcatttctgttgatttctcatttatgtcctttccaaacatttagtagtttttattttaattgtttgtatttgatagcttgagcccaggctctatattgtcttacaagaaattggggtgatggataatttctcaaatgcagattgttctttaaagattaactctaaattcacttaacttggattgcccccaagtcagaacagtcattcgctaagtctttcagattgatgaatgattggtcccagtaccaaaaatgtcaaatcaaagcttagaattgaattttcaaagattgttcatggatttacatatattgtatttcttatacaatatatcacatttcttactctgtatattcatattgataaatgggtggaaagtctttgaccctgactgcatttatgttaaatgtttgtctagaatatggatttggtttcatttgtattgtaacacaattaactgaatgattaacatgaaaaaaaaaa

SEQ ID NO: 252768 - DNA, 856 bp, Homo sapiens
gagatgggggtcttgctatgttgcctaggccagacttgaactcctgggctcaaatgatccttctgcttcagtctcctgagtagctgggactacaggtgagcaccaccatgcctgtcttttttagaaaaacaaatttaaggttgaagccagaaaagccagattttcagcctgccagctacgcgtttgcaattttggtctatacaatttgagtagagactggagcagcaatcctgtctgaactcctacagtgcttatagcctgtgtcgcatcattagctcttagctactctttgtcttgctattcattagtttgtaaatcatttttcctaattagatgggacatagaacaggtgagaaatcatgtcttaaactttgtgtaccttaaaggtgcacaataggttttcagtatatactaggataaagactaattgattggctgattactcagaactatcactttctcctttgattttggaggagcaggtctggggaattcattattttacctcaccatttcagttttcccctctttacaaagagctcgggattcatcaatctccattaaacttcaaaatgaaatagtccacataagtcagagatgcaaaacccactgtattaattaggaacttttctaattgcaagtaataggaaacccaaattcaaactgccttgggtaagacataatttactgattcctatagctaaaacctgcagaggtcaggatgatgtcaggcatgactgaattcaggagctcaggcaatgtcattggaacttgatctgtctttccctccgtggcttggctctacttttcctcccattagcttcactctcagtagttccccttctgtcgtcttctc

SEQ ID NO: 252769 - DNA, 497 bp, Homo sapiens
aaggaacaaactacttttatatccaacaatgtggaggactatcaaaatattttgctggatgaaagaaatcatgaaacaaacattctgtataatccatttatatgcaggtttagaatgggcaaaactaacacttacactaatacaaatagttctagcatcaagggtggtataaattggccaggaaggagcttgattgataaaattcctctgtgtcttgagtgaatgtatatatatgtatatatttgtcaaaacttactgaaccattcagtcaatatttgagcattttactctatagcagtatcttgatcttttaaatgaaaaataacttggaggacatttcagtcatataatttttatagcactgtatttgactaacactattcattaaccatttcagtacattcagggctcttttcaatttttaagaggaattttaattttttaaaaaatttttgtgtgtacatggtgtatatatttatagaatctgcaaaatgtgc

SEQ ID NO: 252770 - DNA, 247 bp, Homo sapiens
gtgtaattgggacagccaccaccttaaatacttgtccttcctttttgctggaaacatttgtattattctcttagctattttgaaatatacaataggttattctaaactataatcaccctagtgatctatgaaacactacgtcttatttcttctattggattaaatgatttaatacctgcaatgctcttagcattgtgcctggcacatgataaataaatattagctgtcgttattccgacccaaaaca

SEQ ID NO: 252771 - DNA, 373 bp, Homo sapiens
gaatttaaggcaatcattccctttgtccaaactatcttctttgactaggctgcacagaaggatttccaacccccagaacttgaattcccccaggtgtatttgtcttcctggttggtactttcagaatcattttaatgtaagctgctttcttgacatttgcattccagcacgtggcacagtgccatggctggtacatcgtcaagtcttcaataaatatttgtgaaatgaagggatgaacttgcagaaagacacaggctgttctcttggatgaactcatcagagttaaatgtttcatctttgaagataacgcgggggttatcaggcacatcagaatatacctgcattaacactattgccagcatgagcaattcga

SEQ ID NO: 252772 - DNA, 441 bp, Homo sapiens
ccaatcttctctgcatagcatgatgcatgaacaatgaactgtcctgggttttaaaccttaagagtttttcaatcaaaatagtgtgactacttctctttatggtccaggcttaaatagcttgagactagctctgatagttttagcatgaaacaagggacaccttttggaccaatccatttgagttgggaattgtaggagaccatcatagatttggtggacccaaaaccagtctggggtcaggaataagaaaatgtaatagcatggcaaatattaatggaaccatatggtttgggtggtggaaacggacaagtgtaactcccagaaggaggaaattgttgctttcagaagggaagggtgttagacagataaatgactatatgactatatgactatataccacagcaagccatagctaaatagtagcgtatgtaattttttttt

SEQ ID NO: 252773 - DNA, 283 bp, Homo sapiens
gtcccctgtaatacaaaacaaaacaaaaaaaaaccctaatctctgtggccctgatttgctcctttcaccttggtggtgagaaaaatgtgagcagagggcaaagtcggccttttgctcctgcactttactttcctggcccacttcctcttaggtgcatgtgcctgcatgacctgggctctcctacaatttgatcacccaatctgatttccactgttagtgacttcataaacaattgtcccagagacttttttttcattctaagtgggctcatggaaagcagata

SEQ ID NO: 252774 - DNA, 350 bp, Homo sapiens
ctgaagatcagggagattagtaccatgatcaagagcacacaggtaatgcataaggcagcagggattggaatgtgacttagtttagtgctcatttcactgggtcacaggcgtatatagatgaaataagagccttggcttcttggagctggtcagactctttctggattgttttgttcagtgatgggtggtaaattggagaatgttgagagaggcgtgactgggatgtatccctgtgcagtacagatagaggtgaaagattttaaaatggatatctctttgagaggtaattcattggtgtcagctggtttcaataaaggtgctatctaaagaaaaaggtgctatctacagaa

SEQ ID NO: 252775 - DNA, 1291 bp, Homo sapiens
gcttcacgtggcgggcaccctggtgcccagagagagaaccagagctgtccgtcctgcagatggacacaggggagccacagcacggctcgcgctggtgcccagagagagaaagagtgaagctgctgaccctgaaggcaaggcagagtctgccatgcagctgcagatgtcggggtgacaggagccgcagagccggagcaaacggctgagataagagcggacagcgtgagagaagctgcccatgaaagcgctggtgtgaaaaagctgttaatgaaagcggctgctgaataaaaccatattcacctgcctagagctccccaagcgttctttccgctcatccacccactcccctcggaccgcagcatgggctggacctggaccccaggatctgaaaaatgtatttgttgaagaaatacaatttttgtcctgtagaacctgcaatttgctaattgcatttatgtggtatctttgaaaaaaaaaaaaaaaaaaaaaaaaaaaaaaaaaacaaaaaaaaaaaaaaaaaaaaaaaaaaaaacaaaaaaacagaaaaacacagaactaacaagacaaaacaagagaccacaacaacgcggacaaacatacacaccgagagcggggcagatgatgagataatcaaagaggatcataatcgggcaacaacgccggccacaccgcgggaatactcagggaaagagaaacagttacaacatcgcagggctgtcgaactcatctgctccccagctccctaacagagccattcgacagccaccacggccccacccgccacacatgcgacaccaagacgaacaaagggcacacaaaagagacgctgagactcagtcaacaacagcccacaagacactacggcacacacagcccatagcaattacgcgcagagcaatcatcaacacaaaagaacatataaagaaaccagcgcatgagccaagcaccacgcaggtagacgaggcatacgagcgcacgcaagcgccgcgcacgcagacctatatgagcctcatgaccccctcgcgcccacccgtcggcagtcgcgcgttatccaggctcagggtctagcgcctgcacaccgaagccgcgggacgatgaatggcagagaccaggggagggcggcagagagaagtcgaaggaccaacgcgcagggcgacacccggccctagacggagaggaacggcggacaataggtgcgaagccgcagcgacagaggcatgcggacgttggtacgcgctggacgaacgatagcgcgaataaagcgtaaggagaccggccgaccagcacgaga

SEQ ID NO: 252776 - DNA, 501 bp, Homo sapiens
gcttcacgtggcgggcaccctggtgcccagagagagaaccagagctgtccgtcctgcagatggacacaggggagccacagcacggctcgcgctggtgcccagagagagaaagagtgaagctgctgaccctgaaggcaaggcagagtctgccatgcagctgcagatgtcggggtgacaggagccgcagagccggagcaaacggctgagataagagcggacagcgtgagagaagctgcccatgaaagcgctggtgtgaaaaagctgttaatgaaagcggctgctgaataaaaccatattcacctgcctagagctccccaagcgttctttccgctcatccacccactcccctcggaccgcagcatgggctggacctggaccccaggatctgaaaaatgtatttgttgaagaaatacaatttttgtcctgtagaacctgcaatttgctaattgcatttatgtggtatctttgaacatgtctctgtcctctgtatttctggtagtt

SEQ ID NO: 252777 - DNA, 498 bp, Homo sapiens
ttccatctgtgagtttgatcaaagcaactttatctgcgaaattttgaagaatcagcttcatctccacttggcagcatgtggtaaatgaaggtatttctggaaatcccatcttcccagaattcagctaggatccagaagtgatgctgttacgtgacgtcttcaacctccctccctctgcccatctcagggacctctccagaagccagtcccaagagtggcattggttagcatatctcaaatacagtgggagaagcctcttagctcagctccagttatttctctattgtagaaaaccaagagagagatgaataaggaatgaaaacatactccacatggactcaataaatcttgggtgaaatgatgctgtctgacaaggtaaataaaaaatgcagcactcaagcaccagcactggggatgagatgaggacacaccaattaccagcacttctgcctgctttgctttgttgacaataaatatcaagttatgtcatcaaaaaaa

SEQ ID NO: 252778 - DNA, 523 bp, Homo sapiens
aacagactaatgatacatgtgacaacatggatgaatttcagtcattttgagtaaaagatgccagacatgaaagagtattatgtaccatatggttgtattcatataaaattctagaaatgcaaactaatagtgaagtaacaaaattcagattagcagttgcctgaagctaggccagagacagggatggccagcaaaggggcacaaggaatcttttagagttgataaaaatgttctgtatttttattgtgttggtggtttcatgggtgcacacactgtcaaaatgaacactgaatagatacaattattgtatgtaaataatatcttgctaaagttgattttttaaaatacagaagatagatccatatctgaatatagttcatgtttaaagatcagatcattttattaattgaaatcatttcaagttatagagaagtatataccaatattttatttcttgtaattgcttcattgcaactttaaaatacatcatcactcttagaccatcatagtaagtacaggaaaa

SEQ ID NO: 252779 - DNA, 498 bp, Homo sapiens
tgccattttcaaaggaaaagaatgcagacacctcttaaaagagcaggtagttagaatgcaacactggaagaatgtgagtttgagactagaaagaaaaattgaggtagcattcatatggcaacttcatatgacttgatgtgagtaaaagagatttctgctggaggatggggaagtggtctgcatgagacaaaagctaaaattataactttggggaacttttggaggctgaggtcagagaaatctaaggagtttctagtgcagagtcctagaaataaaaggtgaagagatttttggtgcctgatccctcgtgtaagaaacataaaagtcttcactacatcctaacagatgtgagattcaactgttctccttagtgtgttctctctgcaattccagaccccatgaaataaatctctgaagcttgcttgtctcccaaacactgtgtaaacccactgaaaacttaagtaatggagtaaacagctttctgtggcttcctgcttt

SEQ ID NO: 252780 - DNA, 409 bp, Homo sapiens
tgcttaagccacccagtcggtggtattttgttatggcaggcatggcaaactaatacaccaaacgctggtgcatggaaaatatcactgtcagtacagtgtctcagcagaagaggactggaaagggacacgagtgtgtcctacccaccctctgcttcctaaaggtcactctacaggccccggttaaaaatggacattttgagtttatcccaactcctgtcaaaaaccaactcacagggtgtgttgtatctactcttagggtttttgtgcagtggcgcgatctcggctcgctgcggcctccgcctcccgggttcaggagaatcgcttgggcccgggaggcgaaggttgcagtgggctaggatcgcaccactgcactccagcctgggcaacagagtgacattctgactcaaaa

SEQ ID NO: 252781 - DNA, 761 bp, Homo sapiens
ctggaaagtatttgatattgggtttcttagacatgtgactgttacaaggcatccatatttagcacagtaaaaatatcaaaaattttttgagactttgaataggatatttcattttgagtaatgcttttttataaatgcttgaattctagttaatcatatgaacttgtttattgaaattaatgtttcaatagtagtttttactttaggtgataaaggtattgtccactttaggaaataccctctttgtgtgttggtaaaagtatatgtcattttgttatctttttcttattcttttagatgtgattgtcatttctttactccagaatttgaggagactataaactattctgtactctgaatggtttagcaactcagtgtattcagtaagtctcaatttattgtaggtttctaataggaaaaaaaaactccatgttcttaaatgaacgtattactgttttagattgctaatagcaataaaaactgctactttagaagttaatgtgcttaaaagttggaatatacttactagtaatctggccaggaaaataattagccaacattaaataaacacattggtgcctgatttaggctaaagttgcctctatgggaagtatcttgatttaaaatcactgcttaaaattcagagtctgcttttgtgacattaaatttggggcgcatacagttggccctccatatccctgggttctgcatttgagggtatgaccaaccacagatagaaaatattctgaaaaataaaaaat

SEQ ID NO: 252782 - DNA, 529 bp, Homo sapiens
acaccaacttctctcaaatctgaggagctattgtacaaacttgaataagtcagttactccttctttgccttagggactaggaaaaacaaaacaaaacaaaacataggcaggactgttagcataaaccagaccagggacctgaaaagattaatattttccatggtcagatgaaagatggtacataaatgcaaaatggctcactgtacattattacatttcaattacacgtgaattagttatagagtgacattttgactgtttcctctgggtaattctcataactccacctgtctgacatttccttcctctctcaggtccatatagaacaggtcccactttgtaggagagaggccaccctgcagaatttcaaaacacacaccaggggaggccattgctgaggcacatgcgggaagtttcaaacactcacagatatcaagaggttaatcgcccccagggcttgatcattgaagaactacccactgaagaacagagaaagttcttcataaaaaaaagaaaaagttggcggccg

SEQ ID NO: 252783 - DNA, 368 bp, Homo sapiens
tgggattcctagccagtcctcaatactgtcccacctccccgctttacttttctcacccaggaaaccaggataacaacagaatctactcccagcagtgttgtgaggatttggagcattgcgtcagggaaagcccgttgctgagtgcctggcacgtggggaagagtgggtggaagaacatgcttcctctcatcactgtgcccccatctgagagctttcaggacatcaagaattcaagaggggatgaagtccacgctgctaacaccatcacattgtatttgaaaacacaatctttagaggaaaaaaataacttcagatggatatatgattatgtaagaaatcaggctggccgtggtggctcatgcatgtaa

SEQ ID NO: 252784 - DNA, 477 bp, Homo sapiens
catcaactgccttttgctcctcacctactagggagcaaagctagagggcatcttagagatgtgaggtggactagtttgtaaataaaatagcattaaaaatatatccaacctagagaatgaagactatggaccctccatcgttggttgagggactttgagagtttttgagagttgtgtttttcaagcttaatatagctttcctttctagcctgttccttcaagtgacacaaacaccctttttttttgagaaatatttagcttggtctaggctactgacagtacctagaaagaaaaagaaaaagaattattcttgcttattattttataaaacctttactagacttggagactgctgcagcgacagtccagttagtggactggaagaccaatcaatgaataatgattgactgtttacaaatgagcctagcacggtgcttgacccatggtgggtgtttaataaatgttagctgactcaga

SEQ ID NO: 252785 - DNA, 232 bp, Homo sapiens
gtggaggccattttgaggaaaggagcctatttttcaataacagaggcatctaagtaaattgaagctttatgagaactagatgcatattgttgcccattgtacccacctgataatacgcaagacagtgatgctacaatattctttagtgacctcttgttttctcatcccataaagaaaatccaagaccgaaatctcagaattgggagagtaaaagttcaaaagaaaggaaaag

SEQ ID NO: 252786 - DNA, 271 bp, Homo sapiens
gtaatttaatactatactccaatattataaagtgtggctatgaagcatatataaccaactcaatataaaaagcctggctaggtgtggtggctcatgcccataatcctagtactctgggaggctgaggtgggaggactgccggaggccaggagctggagaccagcctgggcaacagagcaagagatctctcccccactctcaccctacaaaaaaaaagcctaaggccttttcacccagtgcattttctttgtttaccactaaacgtcagcta

SEQ ID NO: 252787 - DNA, 366 bp, Homo sapiens
ccttgagtgagaatagatgagagaaaatgtggagctcctgacatagtagcagaggaaaaatgatcactaccacagtgtgctactctgatgcttcaaaaagatcaagacataatgctaaagcctgatcaaaaggcccctattacttgcctgacgctattcttggagcaacaagtacttagtgccaggcatcttgaaacatcagtgtgcagttatctaatcatattgatattctgatggtgagtaacatgttatataatctttctgtgcctttcttgatggggtcagattctataccacacaagtcacagaattccaaaaagctattgtgagaataaagctaaaggcaacaaaaggatgaatcactag

SEQ ID NO: 252788 - DNA, 658 bp, Homo sapiens
tgctgggattacaggccaccatgcccaccctaaaatctctttttctaaaagactttccctctcactttttccctctcctctctttgctccctccctacatacatagtacacacacagttttttgtgttactgtatattaggaatttttattcacgtattaggaaataaattacagacatcaggatacctcactccataatttcttaagcatgtatcacctgagaacagtggtgttttccacaataccattattaagttcactatcacattcaaaatattttacagtgatataataatattataaacagtccatatttaaatttcttcagttatctcaacatgctttacaacttacccccacaatcctggattccttcaaggaacatgtgttgcatttaattgttgtatgtttgtagtctcttttaacctagagcagttctcttctgttttttttgtttttcatgtcattaatatttttgaagtgtccaggccgattgttttgaagaatgttgtacaatttgaatttgtcatgattagattcaagtcaaatatacttggcaagaatactacccaggtgatgttgtgtgcacataatgtgactttatctcattattgataatgttaactttgatcacttggttaaattgatgtctgcttg

SEQ ID NO: 252789 - DNA, 397 bp, Homo sapiens
acccctcagacaccgagttgtagaaggaagggctttattcagctgggatcatccgcagactcatgtctccaaaaaccgagctccccgactgagtaattcctgtccctcttaagggcttacaactctaagggggtctgcgtgagagggtcgtgatccattgaggaagcagagggtactgactgggggccgcatgcagcggtaattagatcagaacaaaacaggacagggattttcacagtgcttttcgatacaatgtctgtaatctatagacaacataaccgagtaggtcaggggtatatctttaactaccaggcccagggtgtgacaccgggctgtctgcctatggatttcatttctgccttttagtttttactaaaagcggtgcgcccaaaaaaaa

SEQ ID NO: 252790 - DNA, 491 bp, Homo sapiens
actcaggatgctgagacaggaggattatttgagcccaggagtttgagaccagcctgggcaacatagcaagatcctgccttttaaataaaaaaatatagccaggcatgatggcatgcacctgtagttttatctacttcagaatgaggcaggaggatcatccaggagtttgcggctacagtgagctatgactgaatcactgccctccaggctgggcaacagagcaagaccctatctctttaaaaaattttaaaaaagaaattaaatctcagtgatattaagggatttaataaaggccattaattaataagtgtttgaactgaaccagaacttgaagcccagactccaaattcagttttctttcaattattcttttcatgaagatttttgggagtaagtatacttagcactctacataagacccgaatattacatttcagattctttaagccattatatttgacatgagatataggaagcctgaaaaataaaca

SEQ ID NO: 252791 - DNA, 1182 bp, Homo sapiens
ttgatatattgcattcttgagcattaggcttctaggtgatttgttaaactcatagcaggttttagtacacagtgctgtttatgacagaaaaaattttatcctacctctgaaataattgtactttctgtgattcagataaaaactttatagaaactccctaatgaaaatattgaagcattaaccagaaaatgagtcagctttttgtttccaaaatgatgcaacaggaaaacctttaactacttataatcccgtatagtcaccatcaccacgaagtattgaaaatctgttttctcttttactaagtgtctgcacggtcacttatgtatacccaaagccagaaagatatttttatctcagggaaattccagaaatggaaacatttttgtgtaatattgattcatttctgtctcaccaaagatgtgttttccacgtagcaaagaacatcagccccacgttatagggaacaagcgagtcccaaatcgtaccatctgctgagcactgagaaaggatatggacaagtcagtcagcattcacaattaagagaaaaacatctgtgctttggaaaatgttcttcaaggatagagaattgtgccctatgtccaccaaatttgcatgagatctttataagattagacagccagtggataaggccccttatctttcttcatggatggctgaggaaattctccgccttccctgacatcagctgcataactgtatttctgcctcgtggaaataaagtagatgatcaggcacttgcggtttgttcttaatacaagaaagacaatttgatttttaaaagttttgatttgtagaataatgtaagacaatatgtttctttctactttggtttttccattcaaaagcttacagatgaattcattcgtttaaaactgccaggctgagtgcggtggctcatgcctgtaatcccaacacttcgggagactgaggtgggcggatcacctgaggtccagagttcaagaccagcctgaccaacatggtgaaaccccatctctactaaaaatacaaaattagccgggtgcagtgccacatgcctgtaatcccagctacttgggaggctgaggcaggagaaccacttgaacccaggaggcagaggttgcagtgagccaagattacaccactgcactccagcctgggcaacaagagtgagactttgtctca

SEQ ID NO: 252792 - DNA, 615 bp, Homo sapiens
agtaattaccataaataagtacttaagtgaattggaacgtttgtatttcgtatcataaagtttgtggtaagttattttgtttaattaatatcccatgtgcaaaatgagttatctctggcaaatccaaacgcacattgtgtgtgtgtgtgtgtgtgtgtgtgtgtgtgtgaagcagtttgtacttttgaaacttgtaaaaggtttttgcctttccctcccttcattgatttactgtactataacagtaaagtccagtctgtagttaattagattttatactggtctttggaaacgctcttgatttcttttcatcattgctttccactcttatgtccacttatatcaccagctgagattaattgaggaagaggccagtctaaattaatcaggaattctaattacacaatagaattagtgacttcatttatttagcgcattttattgaagccttcttgcctgtgtagcaccatgcgaggcatagtggagggaggtggtgggtgcatcagctcttaagaaccaccagctggaatttggttatgtagcagtacttctttaaagatacccctggagtcagattggatctcactaactgttaccagtgatgaggtgtttcct

SEQ ID NO: 252793 - DNA, 1891 bp, Homo sapiens
actcttcgtcatcacctctcctattcgcctggacaagctcatgtttgcaggagcaccatgtcttgctcgtctcgcgcctcctcctccagggctggaggcagcagctcagccagggtgtctgctggtggaagcagcttcagcagtggaagcagatgtggtctggggggcagctcggcccagggcttccgaggaggagccagcagctgcagcctgagtggggggtctagcgatgcttttgggggcagctttggagggggctttggtagctgctcagtagggggtggttttgggggagcttcaggctctgggacaggatttggtgggggttctagctttggcggggtctctggatttggcaggggttctggattctgtgggagttctagattcagcagtggtgctactggaggcttctacagctatggtggtggtatgggaggtggtgttggcgatggggggcttttctctggaggggaaaagcaaaccatgcagaacctcaatgaccgcttggccaattacctagacaaggtcagagccctggaggaggctaacactgatctggagaacaaaatcaaggagtggtatgacaaatatgggcctgggtctggagacggtggatcgggaagagattatagcaaatactattcaataattgaagatctcagaaaccagatcattgctgccactgttgaaaatgctgggatcattttgcacattgacaatgccagattggctgctgatgacttcagactgaagtatgagaacgagctgtgtctccggcagagcgtggaggctgacatcaatggcctgcggaaagtcctggatgacctgactatgacccgctctgacctggagatgcagattgagagtttcaccgaggagctagcctacctgaggaagaaccacgaggaggaaatgaagaatatgcaaggaagctctggaggggaggtgaccgtagaaatgaatgctgcgccagggaccgacctgaccaaattactgaatgacatgagggcgcagtacgaggagctggctgagcaaaaccgccgagaggctgaggagcggttcaacaagcagagcgcatcactacaagcacaaatctccactgatgctggggcagccacttctgccaagaatgagataacagaactaaaacgtaccctgcaagccctggaaattgagcttcagtcccaactggccatgaaaagctccctggagggaaccctggctgacacagaagctggctacgtggctcagctgtcagaaattcaaacgcagatcagtgccctggaggaggagatctgccagatctggggtgagactaaatgccagaacgcagagtacaagcaattgctggacatcaagacacgcctggaggtggagatcgagacctaccgccgcctgctcgatggagagggaggtggttctagttttgcagaatttggtggtagaaactcaggatctgtaaacatgggatccagggatctggtatctggtgactcaagatctggaagctgttctggtcaaggacgagattcaagcaagactagagtgactaagactatcgtagaggagttggtggatggcaaggttgtctcgtctcaagtcagcagtatttctgaggtgaaagttaaataaggaacttccagatcaacaaaagtgtctttcaaagaaaaaaaaatcaagaaggacacaagcgaagaaatggcatcaatctaggcatctttctggataatttcaggaaaagcttcagtccagaaatggatgactagccaacttttctgcatcttcttatttcctcattagaatgctcttgaaatagctgaattaacaactttgctttaattgtttctatgcttcaataaatttacttttgcaagttaaaaaaaaaaaa

SEQ ID NO: 252794 - DNA, 511 bp, Homo sapiens
tgtaatttaaaagtgaagacatactttgcttgtcatactaaaagagtccgctattttttacataatcttacccagacagaacacgttgaatgcatgtgattgaatttctcttgctctgtgtttctgtgagagtttccagactgacattgcaatcccatgattttcagattcaagcaagactagagtgactaagactatcgtagaggagttggtggatggcaaggttgtctcgtctcaagtcagcagtatttctgaggtgaaagttaaataaggaacttccagatcaacaaaagtgtctttcaaagaaaaaaaaatcaagaaggacacaagcgaagaaatggcatcaatctaggcatctttctggataatttcaggaaaagcttcagtccagaaatggatgactagccaacttttctgcatcttcttatttcctcattagaatgctcttgaaatagctgaattaacaactttgctttaattgtttctatgcttcaataaatttacttttgca

SEQ ID NO: 252795 - DNA, 2675 bp, Homo sapiens
  misc_feature (808)..(808): n is a, c, g, or t
agacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggctctcaactgaaggccaagccccccaagaagccggagagcagcgcagagcagcagcgccttccactcgggaacgggattcagaccatgtcagcttcagtccagagagctgtggccatgtcctccggggacgtcccgggagcccgaggggccgtggaggggatcctcatccagcaggtgtttgagtcaggcggctccaagaagtgcatccaggttggnggggagttctacactcccagcaagttcgaagactccggcagtgggaagaacaaggcccgcagcagcagtggcccgaagcctctggttcgagccaagggagcccagggcgctgcccccggtggaggtgaggctaggctgggccagcagggcagcgttcccgcccctctggccctccccagtgacccccagctccaccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcaca

SEQ ID NO: 252796 - DNA, 2193 bp, Homo sapiens
agagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcaca

SEQ ID NO: 252797 - DNA, 2111 bp, Homo sapiens
agagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcaca

SEQ ID NO: 252798 - DNA, 321 bp, Homo sapiens
actctcctaagtgtatgatctgactgcctctcccgaccctttcccaatttaatctgcccaggtggagtccatattcgccccatggtgcactcctgcagggcttcctcccatgcctgcccttgatcacattctagaattcaccaggagcccagcaggaagatctgcctggcctcacagatggctaccttttgaaatattttgggccagacacagtggctcacacctgttatcccagcactgtgtgaggcagagatgggaggatcacatgaggctaggagttagagaccagcttgggcaacaagacttgtctctaccaaaaaa

SEQ ID NO: 252799 - DNA, 453 bp, Homo sapiens
tgacgttttgtacaccctttgtgacatgaaaagtcacacccccctagtatattacgaataatatcaaaggcagttgatgcacacggtgtacacatcctgttacattaggcttaatctttttctgtgatttatgaataatatcacagaaggtgtacacacatggtgtacactccaggtgacattaggagcaacatccccccaatatattagaaataatattaccagggttgcatacacatggtgtactctccctgtgacagtagcagcaacattcagctggaatattacgaataacatcagagggggtgtacacacataacgtacgcaacttgtaaaattaggagtagcatctccctacgatgttatgaataatatcacagaatgtgtacacacatggtgcataccccatgtgatgttaggagttacatccttctagtatgttaggaataatac

SEQ ID NO: 252800 - DNA, 822 bp, Homo sapiens
ggagatgaggcgggaggacttggggacagctgtggggacacggcccagatgttctggtcccagcagaagtgactggcggggaccaggatgctggagggtcagctcgaggccagggagcccaaggagggcacccacccagaggacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacgcccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaagattatgcatccatcttcccgaagtctgcaaaactccggtggcagaaaatcaccagtgcaggcttcccaggccgccacg

SEQ ID NO: 252801 - DNA, 624 bp, Homo sapiens
ggagatgaggcgggaggacttggggacagctgtggggacacggcccagatgttctggtcccagcagaagtgactggcggggaccaggatgctggagggtcagctcgaggccagggagcccaaggagggcacccacccagaggacccgtgcccgggagctggggctgccatggagaagacacctgcagcagccgaggtccccagggaggacagcaatgccggggagatgccggtgagctgatctctgtggggatagagttagtcccaccaggcgggaccctgattcctgtccctgaggcctgtcattggacttccctcgccagacccctgtaggaatgcgccaccctgggacgctgatgctaaacttcctctcagaggggcacgtggctcttttcccctctgcaaccttctctctttgttgatgggaggcaggacacagagttaaagaaaatattaacattccagcttttctcttctaatccaggagaaggcaccagactttaaaaacttcattaaagaaaatcaggttgacatgcctcacatcatcccagcaaccaccttcctcactggaccctgttggacagtgcttgctctcatgaaagtgccatgggtctctgtggccagg

SEQ ID NO: 252802 - DNA, 962 bp, Homo sapiens
ggagatgaggcgggaggacttggggacagctgtggggacacggcccagatgttctggtcccagcagaagtgactggcggggaccaggatgctggagggtcagctcgaggccagggagcccaaggagggcacccacccagaggacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacgcccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaaggtgacctcggaaacctgggtcactctacactggcagcatggaaaattcagattcagatgaagttccacttaggtctcataagagtactcaatttgttattcgaaatagacctagtaatttattaacctaattatgtttctatagataaaactttgaatttctgcagacatgtctttaatgctataaaagcaaataaattgaattgggttttaaaaagc

SEQ ID NO: 252803 - DNA, 490 bp, Homo sapiens
ctttcttaatttaaggctaaccctcaatttgccaagtctcatttactcctcataattcagaagcaaacacctctactgagtttctgtactttttaagttaatatagtcatttgcataggttaagtaaaaatctgttttccttttactaagatataattggaaatattaatcataaatccaagattatacctacagtgtcatattgagaatgcttctcatttagtcaaggtacaccaagctcacacttaggaaatacgtttgcatagagagccaatgctcggagaaaacgctcagcgaaactggccacgttacctgttacatatttctagcttcatcagtaaggaatacccgtcctgacagaccaaagatcttagcagattttacacatcacaagcaaagtagaattccccaatgttaagggaaaaactttcttgggcttggtttcctggtcttggtataaaaaattaaataatacatacttatacaaatt

SEQ ID NO: 252804 - DNA, 354 bp, Homo sapiens
atagtaactacaaccagtcttccatcattccatggaaattgcatgtatgccacgttgccttctcagtttccaagggaccaattaatgaacaggctactcacattttcagcatcctactcctgacacactcccacccttctttctatttatctgtgattcatagagatttgcctatgactggattcctgaggagaaaaaagtctggattacagatggcattccttgttatggaaggcccttccttctgaaagtctatttctatcatgttctttccctgtgctgtcaaagggtcacccctttgtacaaaggagaagagaaatccatcaagtaaataaaatttcatttacctttgta

SEQ ID NO: 252805 - DNA, 476 bp, Homo sapiens
tctgaaatacttaatcacagacctaaaatgtagatctatgggtaattttaaatgttgcctgtcaaggcttaatagggacttgacaacagctaggatggaaattatttcaacacttaaatatgcttactttgtgccggacgctgttctaagtcttttacaaatatttacttgatatttgtattttgtgtactattttgatttctgcaacattattaggcttcatactcttctgtgggaactgggttcaaatggttccagatgaaaatacaaatagtcctgtgattagttttgttctacatcttatgacagatacttcatgaaaggaaatatgaaaaggccacatcttgctttgaaataagtgagatggagcctctccctctttttactgttaatgttcatagttttaaaaatcctagaattttgctgcttttcaaaatgttaagttggaaagcaagaataaaatgacccttttttca

SEQ ID NO: 252806 - DNA, 374 bp, Homo sapiens
tgagcaaagggttccagactggttattatcaagtatttgtagtgaaagtcactatgcaagaagtgaaagaatgataggattttgggaaagaatcataactactgtttcacaaggtttagtagcaagaagacaagacaaattgaaccttgggagactgccagcatgaggaaaggctttgtcaggagacagagaaatgaaggcacgtttgtgggcagagcaaatgtaagaagaaaggcagaaatatggacaatgattaattaatgaaataagttttaaagaacagaaaaaaagggttaatatcgaagtccagatagtgagttaagcactaaaataggaaggcaatatgtctgtttttatcttttctttgagacagt

SEQ ID NO: 252807 - DNA, 610 bp, Homo sapiens
gaagagaagactttctagtggatcccagtagtgaaggttctaagctaaaactgggcagcatttgggcacttcaggatgtctgtatcctgagctagacgcatgttaagaatgtattatgcctttcacgtttatcttgtgtgatgtgttagaatgatacaaaagacataaaactaggtccccccacccccattgaggaggaagaggttgacatcagtcatacttgcagtcaccctaatgcccaactcagtgtctgcattcaagaagttctagtatagtagtgaggatagtaaggatacttagcccacggtcatcagaaagggacaaatattctggggcttgtaggacgagaaaggggatcagagataacagtcacttggtcagatgataccgtatattttaaaatgcttcttgctgtaaacttgtgtgctatagctgtgtctaagccttaaacatcctagatggttttttcttaattgtgtcattattcatagtttttttgtgctaaggactggtcattgtttactgccaaggagagggtccttgaaagagaaagggaaagtactgcccaaaccttcatatgtggcattagaaggacttggccttttgtcat

SEQ ID NO: 252808 - DNA, 393 bp, Homo sapiens
aagaaagggctggaaagtgagacaaagaaagacccttggttaaaacaactcccccaggtggccccattgcctgccctgagaggcacccacagttccctgcaggtgggggaagaggccaagcaggagtgggcaggacaggcagggatagctgctttcccttccccaaatgcagccggccggagtgaccaacccatgaatcttgctacttaaactctgaccttctttggtagccatgaagcatatgccactctttgggtgccttttcctttattgtgagaacatggttggagtggaagggaaacacctggaccttgattgctatgattgactctgcctttagctggggacctgagtactgaacgtgccccagaggttgtctcagaaaagagaaag

SEQ ID NO: 252809 - DNA, 504 bp, Homo sapiens
aaaaaagaaattaaatgaaagttaaaaatttagtctctcagtgtattgatttgctagggcagccatgacagtctcacagatggagaggcttgaaaacagacatttatgctgccataattctggaagccagaagtctgagatgaaggtgtgagtagggctgggtcctcctgaggctgacggggatctgcccaggcctctcccagttcctgctggtggccggcgtccttgatgttccttggcttggagaagcgtcagccgcatctctgcctccatctccacaaggcgccctccctgggtctgtatccaaactcccccaactccttcaaccttttttattttaagagatgaggggccgggcgccgtggctcacgcctgtaatcccactactctggaggctgagtcaggagaatggcgtgaacccgggaggcagaacttgcagtgagcggagatcaggccactgcactccaccctgggcgacagagagagactccgtctcaaaaaaaa

SEQ ID NO: 252810 - DNA, 639 bp, Homo sapiens
aaaaaagaaattaaatgaaagttaaaaatttagtctctcagtgtattgatttgctagggcagccatgacagtctcacagatggagaggcttgaaaacagacatttatgctgccataattctggaagccagaagtctgagatgaaggtgtgagtagggctgggtcctcctgaggctgacggggatctgcccaggcctctcccagttcctgctggtggccggcgtccttgatgttccttggcttggagaagcgtcagccgcatctctgcctccatctccacaaggcgccctccctgggtctgtatccaaactcccccaactccttcaaccttttttattttaagagatgaggggccgggcgccgtggctcacgcctgtaatcccagcactttgggaggccgaggtgggcggatcacgaggtcaggagatagagaccatcctggctaacacggtgaagccccatctttactaaaaatacaaagaattagccaggcgtggtggcgggtgcctgtagtcccagctactctggaggctgagtcaggagaatggcgtgaacccgggaggcagaacttgcagtgagcggagatcaggccactgcactccaccctgggcgacagagagagactccgtctcaaaaaaaa

SEQ ID NO: 252811 - DNA, 240 bp, Homo sapiens
tacattggcagctgcctcgtctaaatcaacacattccatgtgcatcttctatccttgggtttaatgttgctaaatgagtaactctagcatttgtacaagaccccctaagactctggcagcagtcgaccaagcccagggacataattgaatctggagattcctgaggccttgttttgaaaaagacttgaaatacacataggaagaaaggcccaaaaataaatgttcacttgtctctgcaaa

SEQ ID NO: 252812 - DNA, 193 bp, Homo sapiens
tcacttcaagacccaagccggctatcacactctgatagaaagtagacatcccttgttttcttgatcaccttgtacttgtatgaaaagaaattaattctgtcattaatgtatgacactaatcatacatcaatactgtatgtattgctttcattcaagagtaaatattcattcaataaattttgtattgagtata

SEQ ID NO: 252813 - DNA, 683 bp, Homo sapiens
tcctgtttgtctgaaatttggaatatgaaccacttttgctttttgagaaaatttaagctattatccagtaactcgtctggatctgcactgcagtagcagtgttgtggcttcagtagccatctgcttcgagatggaaagtctttggtacccatggcagtggaggagatagggaatggctttaattatgtctgccatcacacagctatgtgaatttgatctacaactttaaacagaaaagagaaatttacagccaatctacagtctatattaataggatgtagccaatcaatgacatttccaaactaatgggctataattaccttaaataatgcaaaaatatttatgcaataaagaaaaattaagtcactgtattaaaactttctaaatttatacagcattctttcacataatttgtcatcatttaccaccaagatgcttggacggagccactgacagataacttggctcactcaaactggttcagctccactcagggcagacagtttagggaagtgagaaaatgcaggggtctttgcctgttcccaaatccctactgatatcctcacaactggaagttggaaggcaaggaagcaaaaccttcccctgaagacagagagagggctgagtgaagactaaccttttagggaagatggaaattcaagtgtaaattaattttaaaaata

SEQ ID NO: 252814 - DNA, 176 bp, Homo sapiens
gacgagtggtgaccaccccttccagcaggcaggttcccagccccagccaagcagtgtttctccaggagccggacagcctctctgtctccatggcagccttcctatctgctggcctcggcatacttgcaccctcagagacctaccccctacctacaaccagctctggctgggagccc

SEQ ID NO: 252815 - DNA, 480 bp, Homo sapiens
  misc_feature (152)..(152): n is a, c, g, or t
aaaacttcctcgagtcagcctctccaggcccagctcctcctgcctcccagtggcctctttcggcccagcccagctcatggctctcggcagtcttcccaggccccgcttttgacttttggtggcctcttcaggcccagaacttgacctccagntcgccttggcaggcccgcctcctgcctctcgaaggcctacacgggcccagcctcggcttcacagtggactctccacgcccagctagtctcgcctcactgcagcctccccagtccaaagctcctcgtttcggccacttcggcaggccagctcctgctggccagtgcctctttaggcccagctcattcctcacaagcctttccaggccccgtttttcccttctggcagcctcttggcctctaatttttttatctttcgtgtataaatcccaaaatatggaattttggaatatttccaccattatataaatattttggtaggtaatttatt

SEQ ID NO: 252816 - DNA, 211 bp, Homo sapiens
catgattccctctgttgtagctgggtacaaaataagccattgccccaaagagactgttctttcttgatggaaaaaaaagttattgagaaaataattggggaaaacaaatgtgtttcatgaaaaagaaaactgtttaaggtgatttcctttaagcctaagtgtttatggaattagattagtaatgtctcaaaataaattaagttttaagttt

SEQ ID NO: 252817 - DNA, 221 bp, Homo sapiens
gcacattttgtttttcaggtaaatactttttaaaatggaagaaaaaatagaaatgctaggcctgtcatttaaatcctgaaaattacagaaaacttagcacccagctgccagtgtgctatgaggactaactcacatcatgtaatatttcctgaacagtgctctgtaacagacttctgaacacatagtacgtgctcaataaagattgtattaactcatgtgta

SEQ ID NO: 252818 - DNA, 1236 bp, Homo sapiens
agccctgcgcagcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaa

SEQ ID NO: 252819 - DNA, 1284 bp, Homo sapiens
agccctgcgcagcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacagttctgccccgacatctatcctgccccgacctctgacctctggccccaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaa

SEQ ID NO: 252820 - DNA, 1421 bp, Homo sapiens
agccctgcgcagcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacagttctgccccgacatctatcctgccccgacctctgacctctggccccaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactcagagtccccagagttcggccagtgggtgcggctgctctaccgcctgcgcttcctctctgcttctgctgtgcccttcacgccaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaa

SEQ ID NO: 252821 - DNA, 1187 bp, Homo sapiens
agccctgcgcagcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacagttctgccccgacatctatcctgccccgacctctgacctctggccccaggtgactcggttgggagaagttgccaacgaggtcaccatgggggtggcagcctccagtccagccctggagctcccggacctattgcttctggccggccctgccaaggagaacggacacctgcaactcttcggctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaa

SEQ ID NO: 252822 - DNA, 1465 bp, Homo sapiens
  misc_feature (1290)..(1290): n is a, c, g, or t
agccctgcgcagcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacagttctgccccgacatctatcctgccccgacctctgacctctggccccaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaaaaaaanaaaaaaaagaaaaaaaaagtgggggctttttaaagtgggggggggaaaaagggggtattggaagtgggcatgggtcaatagggggtttcgggacccagggtttttggtcacaggggggcaattgggggggctcgcaatagggggcggataaatgcgaagagcaggttacctgttc

SEQ ID NO: 252823 - DNA, 1139 bp, Homo sapiens
agccctgcgcagcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacaggtgactcggttgggagaagttgccaacgaggtcaccatgggggtggcagcctccagtccagccctggagctcccggacctattgcttctggccggccctgccaaggagaacggacacctgcaactcttcggctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaaccaa

SEQ ID NO: 252824 - DNA, 639 bp, Homo sapiens
gcccttacacacttccaacttttgctttgtgctgctttatttctcttctctgttttctgccaaccagaaaactgttttcctactgttggacaagctgttcaacagtgtcttcagatcttagctagttttgttgatattttctgttctttctccagagagagagagagagactgggtgagactgagacatcctactacttgtgtgtttaaggctaatctggctgctaaaggcagctggaagctgcttggtcttcagctcctcttgcatgtcagtaaaagcaagacacagctggtctcaataaacagactatccacaagtgatgtttgcaaagttaaggttgggaggtggaagctccatctcctgaccatccaaagactggtggatgcctaaatccaacatattaatacaatgagtgctacagagataaccaaaggtacaatgctagaacagttacttttggttatcagaggcctgcacttgatcaagttctaggcacacagtactgacatttaaatttaaatgctatatgtaaacttcccatctgttcagctgccttccttgtaaaataaaaataaaacttgtcttaatcttctcagaaaaattcactgctacatagctaccttcaatgtaagaaagtag

SEQ ID NO: 252825 - DNA, 418 bp, Homo sapiens
cctggtgggggctggtgctgcagtttcgtcagcccttggctccgggctctgcaggcggaatcccgagcctgcgtgagggccgccctggcctcggcgtgtgtcctgggaaggggcgttggaagcctctctgcttgtcttggctgcctctgctcgctcagctctgcccccactggggccgccagcctctgcactcccccttggaggagccaggcagggtttgggtcggagctggggtagaggaaggctccaggcggcttgccgcaggatctccctgctgtagccagcccttggggcgctcagcagggtgggggaccatcagtcagggtgggggaccctcagtcaggataggggggctcctgttctttccactgccaccgcactccagtctgggcgacagagcaagactctgtcccccgca

SEQ ID NO: 252826 - DNA, 2319 bp, Homo sapiens
agaaaagaacactataattagaacactaacattggaagtaaaaacgttgtttataagtaattacttgtaaaattttaagtgaaatgtttttcttcaggcatgtcttcaggcttttgaaaagttcacaaataagaaaacctgtcctctctgtagaaagaaccagtatcaaacccgagtgatacacgatggggcccgcctgttcagaatcaagtgtgtgaccaggtgaggacgccaggcccgtttggcgctaagcagacacagatcaggctatgacaactaacttgttttttgaatagtgggattttatctctcttcttggccaccataatttccccagggccttgtacagcacagggcttataacaactactgaagtattggttgacatagagtcatcataaattagtcattttcaaatatctgtgttttagaatccaagcctactggagaggatgtgttgttagaaagtggtacagaaacctgaggaaaacagtacctcccacagatgccaagttaagaaaaaaattctttgaaaaaaaggtaggtaaagatcattatgttctccagatatggtctccgtgcgggtggttcacttggggtcaggaaggctaacagaggtggtaaaactttgagacttacttcactttgagggctttttaaaaatgggtgagatgctgctaaaaatcctgtttaactttagttggctttccaacctagatgttcaaatacttctagactttcttttctagttaaatcataaaattaggttaaatcaaagcaacttctgtttggccattttgtgctaattgtttaaataaacttatctcttcagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgcacgattgcgtcatccttcctttacattctttccagttttttatcttcagtcgttgacagtcagttgtgttctctgggctactcttagtaatttctaatatgtcatagtaggttgtctcttaaatcagaagtgattttttgtcacctcttatacaattttaattacagatttgatagtcattttaccttatatatataaatatttttcatgtgcacacatcattttataagaactcttgaagataaaggcccactgaaagtgttggtggtctcagcccattgaactggacgagaactggcccaggttgctggaaacaagtgaagcaaccattacaatgtgccttgtgttatcttgtaaagtagccagtgaaggttaagtttcagcgttcagtgctcaggtgttcaaatgctgcagccttcagcttcatggaaaaaggaaacgaaaaataacaaaaagcaagtgaccaagagcagtcggggcagggagacctgatcaaacaagttcctcagtttctaattcagtgtctcccacagagagatggaactttacaaggcagattcatagctctgtcccactggacgttgggtccgctgccctgtggccatcccacctccccacaaatactgttttttgttttatccttggttcatcccaactgctgcctcctcgtcctgagccctcatcgctcggaacgccccgctctgatccccgtgtctgcttttctgagcacactcttgcccgcccccgcatgtcctgcccgttcctactggttccctctgccttgcttaaaatgtgccagtttttcaaagcctagctgaagctttcttccaatttctttggtcttctctaaacctctattgtatgtttaaacaacaccatctaagagatcaagaagaacagaagtatgaatgctattct

SEQ ID NO: 252827 - DNA, 2306 bp, Homo sapiens
accctggaacgggaacgaccacagccaccgcagggaaacaaccggggcccaggcccagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgcacgattgcgtcatccttcctttacattctttccagttttttatcttcagtcgttgacagtcagttgtgttctctgggctactcttagtaatttctaatatgtcatagtaggttgtctcttaaatcagaagtgattttttgtcacctcttatacaattttaattacagatttgatagtcattttaccttatatatataaatatttttcatgtgcacacatcattttataagaactcttgaagataaaggcccactgaaagtgttggtggtctcagcccattgaactggacgagaactggcccaggttgctggaaacaagtgaagcaaccattacaatgtgccttgtgttatcttgtaaagtagccagtgaaggttaagtttcagcgttcagtgctcaggtgttcaaatgctgcagccttcagcttcatggaaaaaggaaacgaaaaataacaaaaagcaagtgaccaagagcagtcggggcagggagacctgatcaaacaagttcctcagtttctaattcagtgtctcccacagagagatggaactttacaaggcagattcatagctctgtcccactggacgttgggtccgctgccctgtggccatcccacctccccacaaatactgttttttgttttatccttggttcatcccaactgctgcctcctcgtcctgagccctcatcgctcggaacgccccgctctgatccccgtgtctgcttttctgagcacactcttgcccgcccccgcatgtcctgcccgttcctactggttccctctgccttgcttaaaatgtgccagtttttcaaagcctagctgaagctttcttccaatttctttggtcttctctaaacctctattgtatgtttaaacaacaccatctaagagatcaagaagaacagaagtatgaatgctattct

SEQ ID NO: 252828 - DNA, 1748 bp, Homo sapiens
cagcttctattgtgaaataaacacagaagttgggcctcattgggcctccaccacctccactgtcatcagatgaatgggagaagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgcacgattgcgtcatccttcctttacattctttccagttttttatcttcagtcgttgacagtcagttgtgttctctgggctactcttagtaatttctaatatgtcatagtaggttgtctcttaaatcagaagtgattttttgtcacctcttatacaattttaattacagatttgatagtcattttaccttatatatataaatatttttcatgtgcacacatcattttataagaactcttgaagataaaggcccactgaaagtgttggtggtctcagcccattgaactggacgagaactggcccaggttgctggaaacaagtgaagcaaccattacaatgtgccttgtgttatcttgtaaagtagccagtgaaggttaagtttcagcgttcagtgctcaggtgttcaaatgctgcagccttcagcttcatggaaaaaggaaacgaaaaataacaaaaagcaagtgaccaagagcagtcggggcagggagacctgatcaaacaagttcctcagtttctaattcagtgtctcccacagagagatggaactttacaaggcagattcatagctctgtcccactggacgttgggtccgctgccctgtggccatcccacctccccacaaatactgttttttgttttatccttggttcatcccaactgctgcctcctcgtcctgagccctcatcgctcggaacgccccgctctgatccccgtgtctgcttttctgagcacactcttgcccgcccccgcatgtcctgcccgttcctactggttccctctgccttgcttaaaatgtgccagtttttcaaagcctagctgaagctttcttccaatttctttggtcttctctaaacctctattgtatgtttaaacaacaccatctaagagatcaagaagaacagaagtatgaatgctattct

SEQ ID NO: 252829 - DNA, 2105 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaaaa

SEQ ID NO: 252830 - DNA, 1733 bp, Homo sapiens
agcctcgtcaccgcgcgcttcctgcatgagtggaacctcagaaaacggtcagcggggttcagaaggcaggagataacaccaagaccctaccagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaaaa

SEQ ID NO: 252831 - DNA, 1945 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaaaa

SEQ ID NO: 252832 - DNA, 1422 bp, Homo sapiens
agaaaagaacactataattagaacactaacattggaagtaaaaacgttgtttataagtaattacttgtaaaattttaagtgaaatgtttttcttcaggcatgtcttcaggcttttgaaaagttcacaaataagaaaacctgtcctctctgtagaaagaaccagtatcaaacccgagtgatacacgatggggcccgcctgttcagaatcaagtgtgtgaccaggtgaggacgccaggcccgtttggcgctaagcagacacagatcaggctatgacaactaacttgttttttgaatagtgggattttatctctcttcttggccaccataatttccccagggccttgtacagcacagggcttataacaactactgaagtattggttgacatagagtcatcataaattagtcattttcaaatatctgtgttttagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaaaa

SEQ ID NO: 252833 - DNA, 1413 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtttagcatacgagggtgagctagagagctcctgggctgtttcctagggacgaggcccagagctggagcctaagattccaagcttcctttttccagtttcatcctcctgtgtgagcctcacacacttccattttgttttccattaattaaagtgtgtgaagagctaaacaccctcattaaatagttttgtttgtttactaactggtattctcaagtactaaagtttgtacaaaaggaatgtttctgttcaacaggccccatgcggctgtgcagacaactggggggcttcccaggagcagctgtgtcccagcgcgggaaggatgaaagcagagggactcttaagtggttttgtgatttgagtcagaaaagaaaaaaaaaactgtgcttgaatgtctccaaagaatttgtgagagaatctttaagaaaagtaaaatcttttaatgatttttattcatga

SEQ ID NO: 252834 - DNA, 2552 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcagaatccaagcctactggagaggatgtgttgttagaaagtggtacagaaacctgaggaaaacagtacctcccacagatgccaagttaagaaaaaaattctttgaaaaaaagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgcacgattgcgtcatccttcctttacattctttccagttttttatcttcagtcgttgacagtcagttgtgttctctgggctactcttagtaatttctaatatgtcatagtaggttgtctcttaaatcagaagtgattttttgtcacctcttatacaattttaattacagatttgatagtcattttaccttatatatataaatatttttcatgtgcacacatcattttataagaactcttgaagataaaggcccactgaaagtgttggtggtctcagcccattgaactggacgagaactggcccaggttgctggaaacaagtgaagcaaccattacaatgtgccttgtgttatcttgtaaagtagccagtgaaggttaagtttcagcgttcagtgctcaggtgttcaaatgctgcagccttcagcttcatggaaaaaggaaacgaaaaataacaaaaagcaagtgaccaagagcagtcggggcagggagacctgatcaaacaagttcctcagtttctaattcagtgtctcccacagagagatggaactttacaaggcagattcatagctctgtcccactggacgttgggtccgctgccctgtggccatcccacctccccacaaatactgttttttgttttatccttggttcatcccaactgctgcctcctcgtcctgagccctcatcgctcggaacgccccgctctgatccccgtgtctgcttttctgagcacactcttgcccgcccccgcatgtcctgcccgttcctactggttccctctgccttgcttaaaatgtgccagtttttcaaagcctagctgaagctttcttccaatttctttggtcttctctaaacctctattgtatgtttaaacaacaccatctaagagatcaagaagaacagaagtatgaatgctattct

SEQ ID NO: 252835 - DNA, 499 bp, Homo sapiens
aagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaaaag

SEQ ID NO: 252836 - DNA, 1801 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaaaa

SEQ ID NO: 252837 - DNA, 1253 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtttagcatacgagggtgagctagagagctcctgggctgtttcctagggacgaggcccagagctggagcctaagattccaagcttcctttttccagtttcatcctcctgtgtgagcctcacacacttccattttgttttccattaattaaagtgtgtgaagagctaaacaccctcattaaatagttttgtttgtttactaactggtattctcaagtactaaagtttgtacaaaaggaatgtttctgttcaacaggccccatgcggctgtgcagacaactggggggcttcccaggagcagctgtgtcccagcgcgggaaggatgaaagcagagggactcttaagtggttttgtgatttgagtcagaaaagaaaaaaaaaactgtgcttgaatgtctccaaagaatttgtgagagaatctttaagaaaagtaaaatcttttaatgatttttattcatga

SEQ ID NO: 252838 - DNA, 2049 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaaaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaaaa

SEQ ID NO: 252839 - DNA, 2698 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaaggtaggtaaagatcattatgttctccagatatggtctccgtgcgggtggttcacttggggtcaggaaggctaacagaggtggtaaaactttgagacttacttcactttgagggctttttaaaaatgggtgagatgctgctaaaaatcctgtttaactttagttggctttccaacctagatgttcaaatacttctagactttcttttctagttaaatcataaaattaggttaaatcaaagcaacttctgtttggccattttgtgctaattgtttaaataaacttatctcttcagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgcacgattgcgtcatccttcctttacattctttccagttttttatcttcagtcgttgacagtcagttgtgttctctgggctactcttagtaatttctaatatgtcatagtaggttgtctcttaaatcagaagtgattttttgtcacctcttatacaattttaattacagatttgatagtcattttaccttatatatataaatatttttcatgtgcacacatcattttataagaactcttgaagataaaggcccactgaaagtgttggtggtctcagcccattgaactggacgagaactggcccaggttgctggaaacaagtgaagcaaccattacaatgtgccttgtgttatcttgtaaagtagccagtgaaggttaagtttcagcgttcagtgctcaggtgttcaaatgctgcagccttcagcttcatggaaaaaggaaacgaaaaataacaaaaagcaagtgaccaagagcagtcggggcagggagacctgatcaaacaagttcctcagtttctaattcagtgtctcccacagagagatggaactttacaaggcagattcatagctctgtcccactggacgttgggtccgctgccctgtggccatcccacctccccacaaatactgttttttgttttatccttggttcatcccaactgctgcctcctcgtcctgagccctcatcgctcggaacgccccgctctgatccccgtgtctgcttttctgagcacactcttgcccgcccccgcatgtcctgcccgttcctactggttccctctgccttgcttaaaatgtgccagtttttcaaagcctagctgaagctttcttccaatttctttggtcttctctaaacctctattgtatgtttaaacaacaccatctaagagatcaagaagaacagaagtatgaatgctattct

SEQ ID NO: 252840 - DNA, 3211 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccaggtgaggacgccaggcccgtttggcgctaagcagacacagatcaggctatgacaactaacttgttttttgaatagtgggattttatctctcttcttggccaccataatttccccagggccttgtacagcacagggcttataacaactactgaagtattggttgacatagagtcatcataaattagtcattttcaaatatctgtgttttagaatccaagcctactggagaggatgtgttgttagaaagtggtacagaaacctgaggaaaacagtacctcccacagatgccaagttaagaaaaaaattctttgaaaaaaaggtaggtaaagatcattatgttctccagatatggtctccgtgcgggtggttcacttggggtcaggaaggctaacagaggtggtaaaactttgagacttacttcactttgagggctttttaaaaatgggtgagatgctgctaaaaatcctgtttaactttagttggctttccaacctagatgttcaaatacttctagactttcttttctagttaaatcataaaattaggttaaatcaaagcaacttctgtttggccattttgtgctaattgtttaaataaacttatctcttcagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgcacgattgcgtcatccttcctttacattctttccagttttttatcttcagtcgttgacagtcagttgtgttctctgggctactcttagtaatttctaatatgtcatagtaggttgtctcttaaatcagaagtgattttttgtcacctcttatacaattttaattacagatttgatagtcattttaccttatatatataaatatttttcatgtgcacacatcattttataagaactcttgaagataaaggcccactgaaagtgttggtggtctcagcccattgaactggacgagaactggcccaggttgctggaaacaagtgaagcaaccattacaatgtgccttgtgttatcttgtaaagtagccagtgaaggttaagtttcagcgttcagtgctcaggtgttcaaatgctgcagccttcagcttcatggaaaaaggaaacgaaaaataacaaaaagcaagtgaccaagagcagtcggggcagggagacctgatcaaacaagttcctcagtttctaattcagtgtctcccacagagagatggaactttacaaggcagattcatagctctgtcccactggacgttgggtccgctgccctgtggccatcccacctccccacaaatactgttttttgttttatccttggttcatcccaactgctgcctcctcgtcctgagccctcatcgctcggaacgccccgctctgatccccgtgtctgcttttctgagcacactcttgcccgcccccgcatgtcctgcccgttcctactggttccctctgccttgcttaaaatgtgccagtttttcaaagcctagctgaagctttcttccaatttctttggtcttctctaaacctctattgtatgtttaaacaacaccatctaagagatcaagaagaacagaagtatgaatgctattct

SEQ ID NO: 252841 - DNA, 1520 bp, Homo sapiens
atgcgcagtatggggcggggcggggcagggctggtgagcaagcccgcggggagcgagcgcggaggcgggcgttgctacggcaacggtgggcggccaggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttgggataccattcataggatgtacagccaactttaaaccagtatgacctcatcttaactacatctgcaaagaccctatttccaaataaggtcaacatccagaggttccagcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtttagcatacgagggtgagctagagagctcctgggctgtttcctagggacgaggcccagagctggagcctaagattccaagcttcctttttccagtttcatcctcctgtgtgagcctcacacacttccattttgttttccattaattaaagtgtgtgaagagctaaacaccctcattaaatagttttgtttgtttactaactggtattctcaagtactaaagtttgtacaaaaggaatgtttctgttcaacaggccccatgcggctgtgcagacaactggggggcttcccaggagcagctgtgtcccagcgcgggaaggatgaaagcagagggactcttaagtggttttgtgatttgagtcagaaaagaaaaaaaaaactgtgcttgaatgtctccaaagaatttgtgagagaatctttaagaaaagtaaaatcttttaatgatttttattcatga

SEQ ID NO: 252842 - DNA, 418 bp, Homo sapiens
agagacgaggaaggttaccaaaatagatggtcaggctcgagagcgcttccctgcaacctccaccgagctcaggtgtgagcttacccgcccccgcctcctcctcagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggtaggtttggctggcagcctggcaaccagcagactcagctgcagctgcagaggctgtggggagtggcatgtggggggaggtcgaggactcactttggggagcctaggagtgtcaggcccggggtgcagccgtggaggctgtgggg

SEQ ID NO: 252843 - DNA, 5757 bp, Homo sapiens
  misc_feature (1595)..(1595): n is a, c, g, or t
atcaccctctggacaagagaacgggcgagcgggagctaggagggaagagtggagaggaccggcgaggcgcgccagccggagccacctccttcccggccgccccctccccactccccctacacacacacgctcgctcgctcgccggcgcgcgcacaccccccgcgccggacccgcacctcggcgggcgccacacactcggcagcccgagccgcggtagccgcagcgggatggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtcatacttatcctgacgaagctgtatgacttcaacctgggcagcgtgactgagagttcactatggaggtcgacagattatggcaccacctatgaaaagctgaatgacaaagtgggtttgaagactgtcctcagttacctctatgtcaatccaaccaacaaaaggaagattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaagctctacagctccatggactttggaagacggtggcaactcatgcatgaacgcatcacacccaacaggttttattggtcggtggccggattggataaggaggcggacctggtgcacatggaggtgcggaccacggatggatatgctcactacctcacctgcaggatccaggaatgtgccgagacaactagaagtgggccttttgcccgctccattgacatcagttccctggttgtccaggatgaatatatcttcattcaggtaacaactagtggaagagccagctactacgtgtcttatcgaagagaggcctttgctcagataaagctgcctaagtactcgttgccaaaggacatgcacatcatcagtacagacgagaaccaagtatttgctgcggtccaagaatggaaccagaangacacgtacaacctctacatctcagacacgcgtgggatttacttcactctggccatggagaacatcaagagcagcagaggtctaatggggaacatcattattgaattgtatgaggtagcaggtatcaaagggatatttctggcaaacaagaaggtggacgaccaggtgaagacatacatcacttacaacaaaggcagggattggcgcctgctgcaagctccggatgtggacctgagaggaagcccagtgcactgcctgctgcccttctgttccttacatctgcacctgcaactctctgaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgacagtttttggccacttcagcctccgctccgaatggcaattggtgaaagtggactacaaatctatcttcagccggcattgcaccaaggaggactatcagacctggcacctgctcaatcagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtgtgactatgggtatgagagacatggggagagccagtgtgtcccagctttctggtacaatccagcatccccatcaaaggactgcagccttggtcaaagctaccttaacagcactgggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgtcctgtggagcatgttcatctccgagttccatttgttgccataagaaataaggaggtcaacatcagtgcagtcgtgtggcccagtcaactggggacccttacctatttctggtggttcggcaatagcacaaagcctctcatcactttggacagcagcatttccttcacattccttgcagaaggaaccgacaccatcacagtccaggtggctgctgggaatgccctcatccaggacacaaaagagattgcagttcatgaatatttccagtcccagcttttatcattctctcctaatctggattaccacaatcctgacattcctgagtggagaaaagatattggcaatgtcatcaagcgagctctggttaaagtaaccagtgtcccagaggaccagatcctcattgccgtgtttcctggtctccccacttcagcagagcttttcattcttccacccaagaacctgacagagaggaggaaaggcaatgaaggggacctggaacaaattgtagaaacactgtttaatgctctcaaccaaaatttggtccagtttgagctgaagccgggggtacaagtcattgtgtatgtcacacagctgacgttagctccattggtggactccagtgctgggcacagcagctcagccatgcttatgctattatcagtggtatttgttggcctggctgtgtttttgatctacaagtttaaaaggaaaatcccttggattaacatctatgctcaagtccaacacgacaaggagcaggagatgattgggtcagtgagccaaagtgaaaacgcccccaaaatcacactcagtgactttacggagcctgaggagctgctggacaaagagctggacacgcgggtcataggaggcattgccactattgcaaacagcgaaagcacaaaggagatccccaactgcactagtgtttaataccagcaagccacgtggtcaaccacctttctgactttttatttttgatgattactattactattattatggaaaaattaaaatgtcttttttaccttttgtttaccaagggccccttcataaatagcaggcaaatgcctagctttgggagaaaagggcattcttagctgattgaaatgagacaaagggaataaatggctgtatttgtgctaagagcaaaggatgcatcttcccacagcctcctcgctttactctgccattggtagcttaaagactttctttttccttgtggtctcccttttttcaaaattgaagttgggttggctctttgtgaacctctcatccccacagcagaatcaccaacactctccgcttcccccagcacacacacatacaacacagatcatttcccagttagatccgcaggaagtaggttggtgggggtggatgtagctgcagaaagcatgcacaactttgtgaaagaggccctgccttgtgcatgtccatagtgaggctacagatggcttattgtatataattacaatgtaaatagctttttatttcctaagaaataatttaatgtttagtaaaaaagaaaacagaaaaaagaaagatgcgtgtgttggcttacgcactggccctcagagctgaccaacccgccaggcctgctcaatgcattgggtttggatgctctcctgttgtctgtcacacttaactcttgcatctccttgtccatgccatagctggtttctacttatgtatataaaggggggtggggggaggggcttctctggggcaattgataaaggaaggactctagtgacatcatagaacatggcagtcgtttttgttccaagaatgatatgaaaggtgaagaagaggcccactagaggcttcatactgagacccagatgggggaaaacagcttcctctctaaaaggaaaaacttgatatttatcagtctgagaaaatatttttttctaaagaaggcagtcagtggatcttaaaatgacaatctgtttttaaattggattctatgaaaatgcataatgcttatggtgaattctcaggctattctgagctcagaaaagtcccctgggcactaggtaaagcccagtgaatgtctcttggcatgggaggagttaaagaggttggaagggaagaggcatttgtggaattatgagttcatgcaaaactctccaggccaagtaggggtctagcctttaatgatattagtcaaaggcaattttagcaaagctgtgctatttgcttgtcagatgtacacaacttccttaaagtcaaatgtctgccttcagttcccttaaggtagttcttgcctctggggtgagtggctttcaaagccttttagcttttccagcacctcagccccttcacacatttacacataccaatttttttcaatagggtcacgttaagccatgctgtaagcattgtttttattttcaggcttagcctgagcacacttatttttgaaaatgatataatgtatatatatgggaggaaaggccacattttgtacctgttaatttttgtgggatgttgttcccattcttctttgtgagacagagagaatgtgatatagagaaatctggctggctacagtgtagatcagtattaggaatatttctaaagatcctgcttttttgtttcaagggttaaatggggcagacaattgcaatacttgtactaaacactggaatacaaatgcatgactcatatctatatatacagtatatgtacatatactgttcttggttttattgttccacttgaatatttctactgtaaaaaaaagacagtggttttgaaattgttgaaaataaatgtatttttgtacatc

SEQ ID NO: 252844 - DNA, 515 bp, Homo sapiens
ggagaaggagcagaatgacatgcaaaatccaggatgcccagtcttatccttatttctagaatttaataatttataatgtgtttcaagtatactaatactcttcctagatactggaagaataatcacagttttaagaaacggtataacgtttgtttgtttgtttgtttttcttttccaagttaggatgacagtctgagagtttcaggaaaggaaataaagttgatatcccacacaagactgaatgagtattgttacttcttcttgtagcctctcatcactttggacagcagcatttccttcacattccttgcagaaggaaccgacaccatcacagtccaggtggctgctgggaatgccctcatccaggacacaaaagagattgcagttcatggtaagccctgaaaattgttctgtgatgctccttcccgctcagttaatctcctgtgtccactctccctacaatcattgagtgtggtggaaattcctcaggccctgtggaaaagtacataggtcaa

SEQ ID NO: 252845 - DNA, 276 bp, Homo sapiens
tcatttctttcttttaacagcttgattcttggatttaaacaactttatttttagggaaatacaaccccctcaggttctttatgactcagtccctacaccatgtggccactgtttcctgggtgccacacctctgaatagattaacatgaaagaatgctgtgcgctatttagattactagggagtagaatattgaatacattgcttaaattttttaatctaaaatttaatcagaaatttactttgggagtagacaaaggaaatctttgaaagtgttaa

SEQ ID NO: 252846 - DNA, 366 bp, Homo sapiens
acatgttcaggctgcctgctgaagctaggaagtccagaatgagatttatcaactctcaaggccacggaagaccctagagattgttgtctaacctcattttctacgtgtggagaccgaatcagggctgtgtagagaaaccagtgcgcgttttgatgccactcattctgggttttcaggtctgctcatctgtttactagaaatgagtggttctggatgaagtttcctgactttactgaacttcagtttagtttcctcatctgtaaaatgcaggctgtgctacttaaatgggggctttttgtggatattgaaaataatggatggaataaataagtgccttgcacatagtaggcacagaatacacaatca

SEQ ID NO: 252847 - DNA, 787 bp, Homo sapiens
ctgtcacgtacgtgctccacaaggcatagtcatgctgttggctcagaggaaacatcttaaagcagcaatgtgtaatgcattaaatggcctgattatgtcttaagggaagactcacctatagatttcacttaatggttagaaatgattcaggaaacctgaggaaattgcctacaaagaggcaaatataacgagagactctgggcatctttcatatgatatgaggagtattaaatgaggaaaaaagaaaaacctaacacttaagagcaggtactgggtaatgttttacatatctttgttagagtaaatatcttggaagcttaatttagaatcaatacactctttggactttgatttagaaagattcagaaatgtcaaacccctttcccatataacttttataaagttatataaaagtttacattaaacctttaagttagtattctgtacattttgtcttaagtgacattttggtgaattttcaagaggtagacattgggagactattccctgaggtattaatggaagaatgctccttgagagttgaagtcccatgatatttgaatagaagacatctctcaaagtaatttttattaaaacaggctgagaaacgcatacccaatcatacttaggcaacaatgccctaataaaatcagaaacttttatccagaatggtttgtcaggtgcaaaaggcagatcagagtactaaaagccatcatgaaatagcctggaaaagtcctataaaggaggactacagccctcagatgaatgtatcatccatctaagggga

SEQ ID NO: 252848 - DNA, 228 bp, Homo sapiens
  misc_feature (71)..(71): n is a, c, g, or t
  misc_feature (157)..(157): n is a, c, g, or t
atcatattctaaaatcctgtaacctaaaacagagcaggctaagtttccaggccagccagcataattctgtnttatccataatatgtattatgccttgatgtttgatactcttccctctggaaacacacagaactagcagaaggaagaaaaaggtttnttccacgttgccgagcagtagggcaaaatagatctcgggatttcgggatctctcctatttgccaaattctt

SEQ ID NO: 252849 - DNA, 787 bp, Homo sapiens
gcacacagcttagcacaaagcaggcctcagatgcacgctggacaaatgtgctggtatcctctgcatccttatggccagcatgatccatccagaaacccagtggaactgagccgcgagctggattccagctcacagaacacaccaagaactctggtgaaacatcaagaactctggggggtccccccagaaaaatctggggggcactgcagagcttctgacacggctctgggggaaatcccacacggatgggcagctgcctgcatctggcactgtggaggtgggcgggcagccatggaggatggggagactcatctttctagacttctcctggggaccgcatttcctccagcctccaggtccagaccaaaatagaatgaggtaaattcagcccctttcctgcagcacactcaaggaataaacaagcaccacaaatacagtcttcgggctgggtcatctttccaacctcatttttttttttttttaagagaaccacaggctgttttaagattccaaacccagagacagaaaaagtgcagcaaagcagggcgacaaggggaaagaaacttgacagtgctttgcagacagaaacaagtgacgcaatttccaaattcaagattctcaaaaacagaggctgggttggaacatctagagaaggccagagcgggctgttctaagacttattctcacggtagcatcctgaagccgggggggtccaggaagggggcaggctgaggacatcagcttgcacttggtaggccctcaccaggtcccagaagctgtgccggtg

SEQ ID NO: 252850 - DNA, 433 bp, Homo sapiens
caaagaatcccttcataatataagaataaaaactccaaatattcttctacagtctcatgaataaacaagcaccacaaatacagtcttcgggctgggtcatctttccaacctcatttttttttttttttaagagaaccacaggctgttttaagattccaaacccagagacagaaaaagtgcagcaaagcagggcgacaaggggaaagaaacttgacagtgctttgcagacagaaacaagtgacgcaatttccaaattcaagattctcaaaaacagaggctgggttggaacatctagagaaggccagagcgggctgttctaagacttattctcacggtagcatcctgaagccgggggggtccaggaagggggcaggctgaggacatcagcttgcacttggtaggccctcaccaggtcccagaagctgtgccggtg

SEQ ID NO: 252851 - DNA, 411 bp, Homo sapiens
cattttaattttaaaaccctccactttgagggaacttctaaaaatgaaacttttgtatcaaatccaattttcctaattcaagatctcaggattatataggacattcaaagtcttatagaagtgggcgtggtggctcgtgcctgtaatcccagcactttgggatgctgaggcgggaggatggcttgagctcaggaatttgagaccaccctgggcaacaaagtgagacccctgtttctacaaaaaatagaaaaaattagctgggcatggtagcatgcacctgtagttccagctactcgggaggctgaggctggaggataacttgagcccaggaggtggaagctgcagtgagctgttattgcgccactgcactccagcctgggtgacggagtgagaccctgtctcaaaaaaaaa

SEQ ID NO: 252852 - DNA, 229 bp, Homo sapiens
gggataatttagaaacttgctagtgtcttaagatcaattactcaccaatgagagtggcattgaactgtgaatgttcctcctagattttccatgaagactaatggttttgtcttgtcttgaatttgttttaattacaatttgtatacatcctgttccaccctgaaatttttattttccaaatggtttttcatttaaagagactaaataaaggttctgactgagttgtact

SEQ ID NO: 252853 - DNA, 445 bp, Homo sapiens
tagaagaaaaagaaaattgacagaattatcagccaagtttcaggtagttctgcctgacacatcttttgaagcagtgaaagtcatacagtgaatgatcacactggcctcatttgcaacaatggctgctttaaatcaaatgagcaggacaggttaggaatattgcattagctcacccctttctgcagagatagactcactctcagggtaaagttgcccagagctcaaaggatgcactgtttcatgcaagagctgccttacaggatctgagaaagagaagccgggctctgagccttcatcttcagcccactccactacaactgtgattggagcctttcaaggctttgtttcaggttgagtttggggagcagttggccagatctgttccttgatgaatgtcttcactttaatctgcaatgcaaagccatacgcttcaaagaaaggcaag

SEQ ID NO: 252854 - DNA, 794 bp, Homo sapiens
acatgggatttcagccttggtttggttatccaaggagcagtgctgagtttcttgccaatgggacatgggatgctggtgatttccaggaagtgtcctcacaatgagtgaagctaccacttactgtttattgtgatgaaatgctagccaaggcatatgccatgcgagttaacggatgctatgcttcaccactgtggcaataaagatgactctgaagaatggcatgggacggaacctttcaaatgcacctgagcaggggtctccaccacagggccacagagctggtggtgagcagcaaagtgaggggaaaattcgtttgtatttatagcccctccccatcgctcgcataaccacctgagcgtcatgtcctgacaggtccagctactgccttccagtgacctctttaggctcatctcatgcttcaccgtgcctcgccaaaccaagctgtgcgtttcagcagcctctgcaagcagaggccgagctctgcgtcctgatcatcctgatggcctctttaggcccagctcatttctcacaacggccaccttaggcccagcttttcccttttggtggcctctccaggccgagaaattcctcaagtcggcctcccccaccgcagttgctgcctcccggcctcttctccagtcccagtcctctctcgcagctgtgtctacaggcccagctcctgcctccaaagagcctcttttgactcggctcctacccagctcctggcagcctttgtaggcctgaaatctcttccagtccagcactccatacccagtctcgcatacaccggcctt

SEQ ID NO: 252855 - DNA, 380 bp, Homo sapiens
acagcattggaccgtgacacatttatccaaacgaaggaaaaattccactcatgtcagccagcccacattttatgacaattggaagagtagatgttacggacgccaggttaaatccatctacacttcgagttgtcttttacaggctactgctgacagccagaatgaaaccaggaggacacttagtctaataaaccaggtttccccctccgggttactgacctaaaaggcaagttaggccctaacatggacataagcaaatcccagggttccttactggccctcctcctgccacccccatcaatggctatgggtgagggaacatttgaatttcaggggtaaagtcctcaaaaagcaatcatgttatggctttccaacgtgga

SEQ ID NO: 252856 - DNA, 338 bp, Homo sapiens
ccactcactttttttttctccttgatactaaaggcatcaaaagacactcactattggtcaggtgcagtggctcatgcctggaatcccagtactttgggaggccgaggcaggcagattgctcaagcccaggagttcgagacagcctaggaaacacaggaagaccttgtctctaccaaaaattaaaaaaattagcctgttgcagtggcatgcacctatagtcccaggtacttgggaggctgaagcaggaggatcacttgagcccaggaggttgaggctgcagtgagccatgattgcaccactggacaccagcctgggtgacagagtgagatcctgtatca

SEQ ID NO: 252857 - DNA, 454 bp, Homo sapiens
agcatgaaaataattttaataatatattttattttaacctaatatatttgaaatattatcattttaacatataatcaacataaacaatattaattagaccttttataagctttttttgtactaagtgttcacaatgttgtgggtatttcatatttatagcacatctaaattcaggtggacatatttcaagtgatcaagatccacatatggctaatggctatgatattagacagtgcaagtataaactataggatcttgtggaacaggaatggcatctcatgatagtatgtttccattttaatcactggaaaaccagttccacaaagcaaatagtttcatggttaagtaaatttgagaaatgttgcacattatcttctgaatagagatttataatagatgacccatatatcaaaatcaccgagaagtcttgcaataaagaagtctgttaaacatt

SEQ ID NO: 252858 - DNA, 2322 bp, Homo sapiens
  misc_feature (2314)..(2314): n is a, c, g, or t
  misc_feature (2316)..(2316): n is a, c, g, or t
  misc_feature (2318)..(2322): n is a, c, g, or t
attctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttananannnnn

SEQ ID NO: 252859 - DNA, 440 bp, Homo sapiens
ctagtaaatgagtgactctactttgatttgacagaagaaacaatggaaagaggagagatggaagtttttctacctaaacttcctaagaggatgtgtttaggggatgtgttggtaaaaagttattagcattaatgtttacctcgtatctttctcatagataatgcaaagacctttaactccacttatccctccttttaacttatgttgttattgccttgtatttaaatactatatatgaggctctacaagacatcattattttatgcaggcattgtttatttaatcagagttcagtaaactttttctgtaaatgccagatggtaaatattttaacccctgcaggccttatagtctctgtcacaactactcaactccactcttaatagtgccaaaatggctatagacaatatggaaatgattgtgtgtacccatgttccaat

SEQ ID NO: 252860 - DNA, 139 bp, Homo sapiens
aaaggatagtctctttaatgaattatgtttggaaaactggttatccacatgcagaagaatgaaatagcaccctgatatcagaccacatgatttccatatggaaaaatcaactcaaaatgagttaaagatttaacatgaa

SEQ ID NO: 252861 - DNA, 400 bp, Homo sapiens
acggatagcggagatgcagaaagatggacattttatatactgctggtagaaatatatatttatacatttttgaaaaccttttgataatatgtattaaaggcctcaaaaaaatatataatttattcttgatataaatactttttaagaaagtctcaaaatctgttaagagcacagtgatatatatgcaaagatgttcattatagcattatttatattaacaaaaaatgttagttagttaaattcccaaaataaggaagagtttaaataaattatgttacatatttaagacaggttattccaccataataatgtttttcaagaatatttgacatggggaaatacaaaggatgtattatgttgacacaaaagtaattgcagtttttgccattacaagtaatgg

SEQ ID NO: 252862 - DNA, 692 bp, Homo sapiens
cggagccaagagattcccagcccagtgctccaaaatactcggcctgggggaggctggtccgtgagcgtgcgcccggaccgttccgccatgcatagtggacccagcactacagcaagcctggcacgacctctaaggcggttcgcggcaacgtccgcacgtcggctcgttggtctaggggtatgattctcgcttcgggtgcgagaggtcccgggttcaaatcccggacgagccctcctttaccttttactgagacaagagtgtcttcaaggaatatgttacctgaccagcgctgcaggaggcttgactgtaagtcatcaatgtacagtaagctcttttgtggcaccgcggtagcagaaagcatctcaatccccagacccgcctggcatgtcaggaagagacgaggcacgcccagacttgggcaggtccctccctttctgcttcctgacttccttcctggtgtctcaactcggccaccacagcctggtttcgctttgattgacacgcgtcaatctatagttgtggatgacagtgttcgggagagcccaggaactgtcaaaacttggttctctgcagtcctgaaggcactctgtctctttcggtcactccatctgacgattggtgcctgaaatacacctacggtttctggtcagcgtttatcagtggttggaagaacagaacccctaggaaccctg

SEQ ID NO: 252863 - DNA, 483 bp, Homo sapiens
ttgatcttgagaagttagaataagcaaaagttgacatagtttaccattttttgaagtgtacagtctaatgagagacaaatgtttacactaatgatcgtattattacaaattaagaaaggttcttataagaaaaggaatgatttctatgagatcacatagataaatctggcctagcttgggtggtaaggaaaagcattgaattctgaactgagatctgaaacaccagtatgagttaactagactaagagcagcgtgaagaatattcctggaaagggtgatataatatacaaagaccctggggcaggaggagagacaaggcatttgaatgaaaaagagaaaacaacgaaatcagaatgcagaatgtgaacacacagcagtaggatttgggatttgggtattaggcatgagtgaaaccagtggtcacattaagggtgagggaagagagagacgctctcatattgttttatactcagtacctgtttt

SEQ ID NO: 252864 - DNA, 465 bp, Homo sapiens
aaagtcagaaagggagcttgttgatggctgctgtcaattttattgctttaacctgtttactaggatagactctgtaacatggtgtgtttattggttttatgtattgcatgttgttgctgctctgacaagctactcctataaaaatgtgttattattgcacgatgtagctcagtgagctgaccctgcatttcaaagggtactggagcaaatagcactgaagtccataaaagctgactggcctccatcacagaggactctctgcatgagctgcaactcctacaacccaggagagaattacacctttccctgtgccagcagccactgcttagtacagcacagcccttgaacacaggcaatatctgtaaaattccaagacagaaaactgtcgtgccattcttatttgtccaactctccaatcagtgtagtttgcaattttgatgtttataaaagtatgaaacaaatggc

SEQ ID NO: 252865 - DNA, 590 bp, Homo sapiens
  misc_feature (1)..(1): n is a, c, g, or t
ncaatatcttaaggctgaataagtttacggcaaggcacatcaagaaatagattacatttattcccttggagagctgcataatatgagtgctgtaggctgatacaactcaaatcaacaaatgctgtgtacaaggctctgtggtagctcgtgccgaattcggcacgaggtggaactggggagcaggtgttttgtgtttcaccagctctgggttctcaagactctgtcatgagaccaaagatttcactgtgctctcaagttattgcaaaccagcaagccgcgaacttgttaaatttcccaaaatgtgctttaaatagaaatcccatatggtcagtgttgcgttctgtggccttacccttatcttagggtcatccatagtgtgagtttaggcttagtctcactttctttactgttttatcagatagtttattgggtacctgcatgggccaaacactgtccatttggctcctaccttctctagaaatagaggaagtagaaagatagtaatgatgggtttaacattttgaaagctaggttagttatggataaattccagaggttttagaatttggagcaaaaacaacattggaatt

SEQ ID NO: 252866 - DNA, 1037 bp, Homo sapiens
actgaattagatctttttacaaaatgaggccctcaccagaagctaagcagatgtcggtgccatgcttcctagacttctaagccttcagaaccatgagctaaataagcctcttttcttcataaattactcagcctcaggtattctgttacagcaacagaaaacactaagacgctgtgccaatgcgcgagtccacggctcttcacgggacctggcatgggacgcactggctcaggggctccaaggccactcagctcttcctcagcacagtttggctcatctctctgctgaccagcttcctacgcttagggtttccagtccccaagacttccgtccgtaatggacataatggtctataatggcacccagccctagtcctcctcctggaccaatcagtgcagcccccatagccaccaggtccatccctcaggttctagattccaaattccaaagatgagaatctgaccagtcccagctcttttgccagggcacacgtttccaagggcatgggccagccactggacaggccctcttcgggtgagcgatggcaaaatatagggtccctcctaagaacagtcattaggagagcagcagctgtgagggctgattagcccagaagggaacattggatgtgtcagccaatcctctagcacaacagaattaacataaaacaagcattttggatgagggatactcaacctgcactgttactcactggagagcgtctgagtgacccacagactcacaccccttcttacccacctcatctgcggggaggcggaccaggacatgtagagcaagatgaggaagagcagcaccacgaaggcagccaggctcacccagaatgcgatcacgatggaatctgcgggaggaggagatgcatctcagcgctgggttatgtcaacataaagcaacgctgaggggcagtaaggagtcccagggtattgtggaatgagggccctgagtttcggttgtcctccagcctctcagctgttaccatggggaagatctcccattaacaataactttgggaaagaaca

SEQ ID NO: 252867 - DNA, 470 bp, Homo sapiens
cagactcagacaaactgtcagacatgttaaccctgctcgttaaatacctggaggggaaaaaaggtagaagtaatttatactttctaagtcatatataatttggcaatgataacccgattattctgttatcttctaccacctattacctaataaaaggggagaggggctcaagagtataattctacatgttataatgagaaacaataagttctcatgaaataaaacatgaaccatctacccagagcataggttgaaatcagagagtatgcagtaagcactctaaggagccaatacatataataaagtctctcatgatattgacaggcaaaatgatgagtgaaatcttcactcgagaatacatttattctattttactcaacaagcctggttaattagtttcaaaaccacagtagattaaaaatactttaatttggaaatgaagcttttaaagcaggccgactgacagttaa

SEQ ID NO: 252868 - DNA, 340 bp, Homo sapiens
tctactctctatcttataataattactcagaataaaacaaagcaatgcattcattcaaatataaacaaaatggaatgcaacttaaaacagaaaacaggttcaaaatcaaaatttaacttcccattttgcttgtatgagatcagaatcaattaaaaagcatacctttgtctcccaatgataactgtgccttgtttttttgaattgttacttccttaattttaaaattgtaaatatttaaggtataaatgatgttttgatatatataagcatagtgaagtgattactatagtcaagtaaattaatatatctatctccttacataggtagatctttatttaat

SEQ ID NO: 252869 - DNA, 501 bp, Homo sapiens
ccttatattgaatgcctgaagaaaaaaatttttttgtgatgactaaaggtgctattaacctaaaatgtttatgttccatgtttttacaacttgtctgtgccatttgcactgaagagctaaggctattctgcaaattaagggatgattaatttctacacagtacagaatacacagaaaacaggtactcccaaattatgtaatccttgcctttttatgaagtagcttatttgaatatagattcaattaatcagtgtcacagtagaaattgtgataagtctttctgggatttgaagaggtctcatggaccctctataccacccaggttgagcagaaagaatcatcatttgagagattttctaaagaatccctcttttcttgcttatgaaaaaatccacgtacaatttaatcactttgatactaagttgggcttggataatatcattttggtatacctaaaacactggtttcattaaaaattttgcacatttaaaatgttcatgt

SEQ ID NO: 252870 - DNA, 508 bp, Homo sapiens
tccagggtgatggcggaatgggtcacggggcctcctggtccagcctggaggccggaaagccgcagcccagtgtgatgtccacagtggagacccaagccagcctcatcagggctggggcaggaagcgcctgctggcacagggctgggccctgcactgagtccctgggcaggggaatgcaggtcaaggcgggaagggcctgccttgaggggcactgggcaccacccccgggctggagaggagctgagggatgggctgggggggcagcggggaggtggagcttcctcaaggtcattcagattgaggggagcgcccagaccccccgcacccaccgtgtgaccccctctgtgcacgtgtagcgatgggatcctcttggccatgcatgtttgtacgtccatgtacgaaataaacatcttctcatgagacgcgcatgtgtgtggcgtctgtgcatatacatgtgcgtacacacagcccccgcgcacgcacgcatgcacttccacccctcaggaca

SEQ ID NO: 252871 - DNA, 1244 bp, Homo sapiens
agttcacggagggtgccggggaatagaagctctgtcagtctcgtctggatcttggtcctcagcaactgtctggatcctgacaggtgtgtgataattacttagtgaattcatgggtgtgggccgtgatagaattaagtgatttgatgtcctctcgataaatccaggtaacgacatagggttttttgagtttgaccctctcctgaaatttgccatctgacaaaatgacatcatggcagagttgtaaactgctgtggatgtattttatttaatttctcaaattaaaataaaaggtaacggtacacttaagagtggtcactacagccaagctaattgacacccactgaactttctggaatgggccataggatgctggacaataggacagatttggaatgagcagtcttccattccaactttagtttctgcaaagctgttgagagcatggagccaggctgcggggtctgggttcaaatcctgactctaccacttaggagctgtgtgtacatgggcaggacaactggcctgcctgagtctcagtgtaggtgtctgtaaaatggaatgataatagcttccatctcacagattcactgtgtgggtaaaatgatagatatgaaatgctaagaacagcacctgtacgtagtatgtcctacatatcttactgttatcattagcatattttgtttattccaagatacattttttttggcccatttgatatctatgaaatctaaagattttttttcctgtcttgggagatagaataatgatgtgccttacaatggattgtgttttagattcactgaaattcattattgttgtttttatccctggtctgtaacatgatatttggtaaataacaaggactccatacgttttgcaaagagtaaattctctccctccctactgaggccttggtctaggtctctccaggcctttccttcctggagccacagtgcttagagacaggccactggggtcagcatttgagctcagctatgatcagaaaaaagcaccgttgaggttgcagtgagccgagatcacgccactgcactccagcctgggcgacagagagagactccatctcaaaacaaaaacaaacaaacaaacagaaagcaccgtcgagaaatggctccagcgctgactagcggccacctcatttccccccttgaccactgggccagttgggtggctaggttgcctcattttgcatccttctgtatccccaaatctgaaataaaagctgg

SEQ ID NO: 252872 - DNA, 958 bp, Homo sapiens
  misc_feature (955)..(955): n is a, c, g, or t
  misc_feature (958)..(958): n is a, c, g, or t
agttcacggagggtgccggggaatagaagctctgtcagtctcgtctggatcttggtcctcagcaactgtctggatcctgacagtgcagtaagagcttgcctggcctgtgtgcagagctgcctcatcctgaaattctgggagttgaaagccccagggcaacccttaaccaatgggggaaaagcattggtgtgtaaatcccccagcttccctgggtgggctgcagctgagccatattctacatgacacttccgaggatccccagtgggcatgacctcaatcgcccacattggatgccacaacctgcactggcttttctcccttccctgtgggtctctctctgcacttcctcccttgtgcattctaggttcaccttccaaataaatgatgtgcactcagaaaaaaaataaatacaaaaaaaaaaaaaaaaaaaaaaaaaaaaaagagaggggggcgcgcgctctcataaaataattattccctctcggggggcgccccagtttgtacgcgcgcatccccccattttttttttgttcaaaagaggggtgcccccctatataagagggagggccgcttttttatatataaggctcagaggccgcggggcgccgcgcggttttaacaaaacggtctgcgggatggggagaaaaatcgttggcactcgtcgtggggaactcttgtggggggaagcggacccctttacttctgtggggggggctggacacattatgtgtggcggaacaaaacctatcccaatataggagagaatttagaacgccttctagagggcgataaaatattataatcattcttatgacaggggtttatacgtggtgtgttaacaactgagggtgaaaattttgtcgtcgcgggattggaaaaagtttgggacttcaagggaaggatgttgattcttgggaacaatttttttccggggggaactatctgttaaaatacnggn

SEQ ID NO: 252873 - DNA, 473 bp, Homo sapiens
  misc_feature (26)..(26): n is a, c, g, or t
aagcttgcggccgcagctccctcacnaggctcgcctcgcacatggccgagtacgagtgcttccagattgaactatccaagaactacggcatgtccgagtggcgagatgatgtgaagaaggtcctgctcaaggcgggcctacagaacctacccatcaccttcctcttctcagacacccagatcaagaacgaatccttcctggaagatatcaacaacgtcctaaactctggtgacattcccaatctgtatactgcggacgagcaggaccagatcgtcagcaccatgcggccctatatccaggagcagggcctacagcccaccaaggccaacctcatggctgcttacacagggcgtgtgcgcagcaacatccacatggtgctgtgcatgagccccatcggagaggtcttccgagctcgtctgaggcagtttccctccctggtcaactgctgtaccatcgactggtttaacgagtgg

SEQ ID NO: 252874 - DNA, 326 bp, Homo sapiens
cagttggggctgccctagagagagaggtgagaggataggaagagagggcaggaagcattggccaaggacacttgtgggctataaaagcctcttgcatgaaagatgggccagttgggactttcatattatctgtgagtaataaaaaggttgacaaaaagatcattattacccaaaactcaagtatcagcagggtgggctgaaatcaatagggccatagttgtgaataagatgtgtagcaatctgtacttgggaaatgcattttttaaaaaccacttataaactgatcttcattacttaaagataaagctgctaatgtatacacaaga

SEQ ID NO: 252875 - DNA, 449 bp, Homo sapiens
tggtgtggtagcttgggcaaaacattggatcataaatcaaaatacttgagttctaatgagaacacatggacaaagggaggggaacatcatacaccagggcctgtcagagggtagggggctaggggagggatagcattaggagaaacacctaatgttgatgggtgcagcaaacaaccatggcatgtgtatacctatgtaacaaacctgcacgttgtgcacatgtacccgagaacttaaagtataataataaataaaatacttgtgttctaggaccaactctgtcagtacaagttttatgaactttgacaaaacctaaggcactcttgttgacagcttcatctgttgactgcactaataatatctttcccatgtacctctcaagacttctgaagttcaaatgaagattaataaataaaaaggctttgaacattaaaagttctatatatatg

SEQ ID NO: 252876 - DNA, 382 bp, Homo sapiens
ggagtatctattgagcttatcctgtccctgtgtcaccattgtacattgggcgtgtggtcttgtctttttagctcacaggtccctgagtgaagaggagccacccctgaggagttgtacccaaggagactcagccacagccagacctactgcacattttgagatcatggtcttggagcctgatgtcgtgattgggtgctttgggaagggtgggtgtattttacaagtgggaggacagagcatctttaggagtagagagcaaactgtggtggagtgccacattaatgccctcagccagtcatgcctctttcacactgactctggcttggccataagacatgttttggccaacaggagttcagcaaacgtggtgcaagcgatttcc

SEQ ID NO: 252877 - DNA, 637 bp, Homo sapiens
cgtttgagagctagacataagccatgtgaagggtgtatggttgttcgcatttgttgtaggaggacacatgaaccaaaagtgccgatcagtggctgtgtcttccctccagaagccagcacagagcttgggcgtgggacttagctggatttcctctctgccttttggggtgagatacggctgatgccttgatgtggaggaggaagcagcggcatcgagcccatgcccacagttggcctgaggcccactcagcacctggtgccaacccagggcagtgagaggagacagagcctgtccctggctcagaaccagttgcggtggagagcggaggagggaggccatgggaaccactcctcttgccctgctgagggtgtctgggtggatgagggccaccgcggacccaggccaggatggctgctgtgggggaggagaccgccagggcagcagtgacagccaagagcagtgagcgagagaaaaaagaccagtgttttactggcttatggggaggcagctatcaccagggctacaagactctgcaaagaaacccgtgcacttccaagttcgtggtgaaaggaaagacacttggcagctgggcaggattttattttttgagacagagtctcgctctgttgccaggctg

SEQ ID NO: 252878 - DNA, 433 bp, Homo sapiens
cgtttgagagctagacataagccatgtgaagggtgtatggttgttcgcatttgttgtaggaggacacatgaaccaaaagtgccgatcagtggctgtgtcttccctccagaagccagcacagagcttgggcgtgggacttagctggatttcctctctgccttttggggtgagatacggctgatgccttgatgtggaggaggaagcagcggcatcgagcccatgcccacagttggcctgaggcccactcagcacctggtgccaacccagggcagtgagaggaggtaggaattccaggaatgagccggctggccctgggctggttccaacaggctccctgccctggcagaggctccaaatctgagcttccttccagaggaggccaggccaggtgcagcgatggggttgggagtctaaggtagggacaggaaggggt

SEQ ID NO: 252879 - DNA, 397 bp, Homo sapiens
tgtttgctgtggtctgcaggctgggtgtctgagaacaagcctgtttgggggttagaggcccagctttatccttgggcaagtcacttcatctctgggccgccctttcctaacttcagattcagaggtcaaacccactgataattaagggctcttctatccttaaagatctgtgtttgcataagagttcggttttgttttttgttttttgtttgtttgtttgttttctgagacacagtttcactcttgttgcccaggctggagtgcaatggcatgatctcggctcactgcaacctccgcctcccaggagaattgcttgagcctgggagacggaggttgcagtgaaccaagattgcccccctgcactccagcctgggagaccgagcgagactccgtctca

SEQ ID NO: 252880 - DNA, 437 bp, Homo sapiens
aatcatgaattagaaaactcaagctacatcataatcatgaattggaaaactcaagctataccataatcatgaattggaaaactcaagctataccataatcatgaattggaaaactcaagctataccataatcatgaattggaagactcaatactgttaacacatcagttctcctgaacttgatgtactgattcactgaaaccccaatagaaatcccagaagtttattttgtagatatcaacaaactgattctaagatatggaaggcaaaggagtcagaatagccaaaaccattttgcaaaagtagttggatgacatagtatctaatttcaaggcttaatataaagctatagtaattaagagaaagtaatatgggcacatactgttacactgacacatggatcaatattatataaagagagcccagcgatagatccat

SEQ ID NO: 252881 - DNA, 443 bp, Homo sapiens
aggggaaatcagctttaaacagttttctaaggtatggtgttcattacatactggggaaaggatcataaaatatatagacatgttgaaataaaataagaatccagtttggaactatgcctgtttgtaagaccatatttcaaaaatataagagtaaatggtttctacctatctgaattaaactttaaaaaattgagaatatttttgtcaacaactgtcatattttgttatacctcaactttgaaaaatttctgaatgtgtgtgataaaagattgatgaattctaatacctaaactgattattgctaggcctcaagcatcaaaatgcctgacatgataacttttttttttcatttgtaaaagattatgtagtttaatatttggggctattaaaataagcccacaatacatctgcattttaacagtagacaacaatatttttcttat

SEQ ID NO: 252882 - DNA, 463 bp, Homo sapiens
gggaaggctctggacccctctgagggtgagtgcacacctgcagcctggagccctgctttcagagaaggattaaaacggggccaaaaatggaagccctggagcacaaggtcctgcagaggcttttaactgctgaaaggttgccaacgactacggtcaatgtcttgggagcccctggagccccggcccctagcctggctgtgaaaggtataagctacagaagacacccaccagccccaacttcccgcctgctgcaccaggtccatgaacctattccactttgcatgggaacacagaaggcttgggagtcaaggccaggcacaggctgcatggatgggttcccttgggacagaaacctggagtgggacagctctgcctagcctttcccaggtcaggtgggggtcctgagctcaggccaagggtccctcgtggaccagcgatgcaagaacttgggagtgagtccttg

SEQ ID NO: 252883 - DNA, 368 bp, Homo sapiens
agccctgtttcctgatctttgcagattttcttttgcaaataagaaagtttctgtaagagccaagttgtgatttgaatacccagcaagtcatggtggcttatgcctataatcccagcactttgggaggccgtggctggcagattgcgcaagttcaggagttcaagaccaccctgggcaacataatgaaaccctgtctctgcaaaaaaaaatacaaaaattagccaggcatggtggcgaatgcctgtggtcccagcaactttgaaggctgaggcaggaggatcacttgagcccaggaggttgaggctgcagtgagctttgattacaccactgtactccagcctgggtgacagaaactgtcttaaaaaaat

SEQ ID NO: 252884 - DNA, 496 bp, Homo sapiens
agcattgtgcaaattgacttgtcagactctaatttggaataagggcgattccaatttaaaagtccttatttcctacctcggtggagcttgcagtgagccaagatcgcgccactgcacaccagcctgggtgacagagtgagactccgtctcaaaaaaaaaaaaaaaagagtccttatttcaaaggtgatggctctagtttacattctccgtcatttacatgctctggccatggcatgggtaaagtcactcagaaagcgtttaaagaaaagccagagggaggtcacagaaccttgtggaaaacttatatttaaggggtaggtaaatcttcatatttagaagagattatgtttcaaaacttactaaaaagacaaaaatgggctgggcacagtggctcatgcctaaaatcccagcactctgaggccatggcaggaggattgcttgagcccaggagtgcaagatgagcttgggcaacacagtgagaccttatcactaccag

SEQ ID NO: 252885 - DNA, 467 bp, Homo sapiens
agccaggtcacccctcaaaggtgaagtgctagaaagagcatcatgtaagtgactatttgccacatggctgaaaggaattaaaatagccctctattggtgtgctatatagcagatggaaaaaatagaacctcagcacccaaaacattctcctgttggccaaacttgcacttttaaataagaggaaaagcagggagatcaaagacagttttgccttcttttttgtgctttctttctttttctttctttctttcttctctctccttccttctttctttcttttttttgaggggaaaagaccctgcagggtcttttcccctcaaaatatcaatctttcagactataataaagcctttcctataattgaaaaaaaaaacttttttgttaaaggtaacgggggttgttacttggcctttgaagagcgtacctttgtaagtatttgtaagaagcctatgtgaattaggaaatgc

SEQ ID NO: 252886 - DNA, 432 bp, Homo sapiens
catatttacactcacacactttaactttatgtacagatgggcatataaacatacataattgcctatgaagatatgtggaaaactgaaaagagtaactgaatccttgaggaaaagggaaatatgaaagacaattttactttttaactaatttatcattacaaatcttgtatttttatgaggaaaatacaattattatgtattacttgtatcattgaaaataaaaatctatgttgcatacattataagatactgtctctcatcttgcgggaaaatgacttaaggaaacccataatttaaaatgaagcagaatgaatttttttgttataagaactatttgtaagattcacagaatactcactgggggttaaaacagctgaacatcaatttactgtaaagtgggactgcttttgccacacgtcaatgtcacttcat

SEQ ID NO: 252887 - DNA, 417 bp, Homo sapiens
ccggtgtcctgccaagctccatcgaaactaaatctagaatgaatgtttacttctgctgtgacatataattggagaccaggcctggccttccagtcactggattctaagttggactgtgagagtttttgcagctgactcatttatcaaatgcccggctattggctcacgcctacatgatgctgggtatgtttgttaatttgagggaagcaatggaataataataactaatgatttaaaaaacaaagtaagtgcattgactgtagtggggttctgattttaaatttttttaaaaattaataccaggagcagtggcttatgcctaaattccagcaactcgagaggctgaggtaggaagatcacttgagcccaggagtttgagacaagcctgggctatggtgtgagacacccatctctaaa

SEQ ID NO: 252888 - DNA, 469 bp, Homo sapiens
tgtatttttagtagagatggggtttcgccatgttgggcaggctggtctcgaacccctgaccttagggaatccacctgccctggcctcccaaagtgctgggattacaggcgtgagccactgtgcttgcccagattctctaatatttatatgatgacttacatagattaaataaatataaaagcgtatctttcttaaaaatttttaaacactaggactaataaaaatattatactcaaataatttaaatgcagaagattgtacttacaaattatgtgaaatagattactatatttagaaagtgttttatttattacttatggggaagtggtggaaatgtgtaaaatgtcttatctcagttatgtttctgaaactctatgatctatacactggtttatgatattgtcttgtttcccttggacagaaaattctagtaagttataaaacaatttataaaatacatataaattat

SEQ ID NO: 252889 - DNA, 404 bp, Homo sapiens
gaaaaaataaaacaaatctacaatgaacacatcagtatgtatatttctacaaacttgtgtgagaagttctgtaagatcaagtcctaaaagcagaattgctggctcaaaggatatgagtaacatcagctgactcgaagttaagaagattggcctccacaatcagggtgggcctcatccaatcagtaaaaggccctaagtgcaaaactaaggcttccctgaagaagaaatgtccacctaacagacagcctccctgtggatttcagacttgcctagccagccccagcaattatgtaaaccagttccttgcaaaaaaaatctctttatatgtatataaacctgttgaaaattttatatagcatatatatatgtataatacatacatgtgtatacatgcataaaatgtg

SEQ ID NO: 252890 - DNA, 424 bp, Homo sapiens
ataaaatgaaaagtcaacccagagaataacggttcttcatctttttgaggggggcgttgggaggaggtcatggaaaatctgagagaagctaacgatgctcccccagattcccacacaagcttgcacacaagcaagtttactgatcatttcagaagggttcatcagctccctgaagctgatacacacacgatgaattaaaagctcctgtcacaggctaggcacagtaatcccagtgctttgggaggcagaggtgggaggactgagcccaggagtttgagaccagcgtgggcaacatagcaagaccctgtctttacaaataatctttttttaattagaagcatgatggcatgcacctgtagtcccagctacctgggaggctgaggcaggaggatcacttgagcccaggaattcaaggttgcagtga

SEQ ID NO: 252891 - DNA, 430 bp, Homo sapiens
aagagcaagcaacatccctcccactcacatgccttgcttcttagggagctgctgttgtggatggaagtgctgttctagggtataagtccccttcaagtacaaacataatttagagctatcttagaaaagttgtcactcatataacctgcttgtaagtaaactcaggaaactgaggaaacgacattgcttttggtgtcaaggcaaaaaattccagtgagtcacatatgtacccattacttcctgttatacacacacatgcacacccatgtacaaaaacacatagtggaaccacattacacacaaagacaatattcttaaatgatgcagatgaaatgaaagtcacatagagtcaaaatgaccctaggttatcccttctttagttgaacccccagtgaagccgttacattgattccaggatccaggttgtgag

SEQ ID NO: 252892 - DNA, 528 bp, Homo sapiens
cgctttcaaacacttcagtgtactttcagctctcaggaaaaatgcaaactttcatctgggcctaagaatctctatatgaactacccctgctcacctccggagaggcatccccttccaccaccctcccctccttcttctctatcctcattgctcctttcaatggtcctgacaggatccctttcagccacaggcccttagcaaatgctgctctcacggcccaagtcatcttccctggttcatgcctacttcggattaaagttacccctccggagagtgttcccaatcaatctgagttgaccaagtccttattacacactctcaaactccatgagatgtccttcatagctctcatcccagttataattagtttgcatttatttacacaatggctgtattaatgtctgtattctccaccagaatgagagcttcatgagagccaggatgtgtgttttctcaaaatctgctttattgtggtctaatttgtgtataataaacacacccatgttaggtgtacccatcaatgaaaaa

SEQ ID NO: 252893 - DNA, 367 bp, Homo sapiens
ataactccccaaaatgtttgaacagaaaagagcaaatgaaggcatttggtcagaaaatcaggattcaaattcgggctttaccagacactgagctatgtaacattgattaagccacttcatatccatttcctcatcagtaaaatgaaaagttaggtgtgtgtacacacatactaattttaatcagtaggttaagtataaaaaaatagaaaacttgaagaatgggagacagttctgtattcacaccaacttacaaataactcaatgcaatagcttttcgtgagcagtctctgtctcccagcaactgtcagatgcttgagacacagagattaataagtggtttggtctcctcttaaaagtgagcattaaa

SEQ ID NO: 252894 - DNA, 2873 bp, Homo sapiens
ccacgcgtccgataataaagaaacttgaagacggaggttcttccaaacaactggcagtgatttatggaattggtgaaacaacagttcgggatataagaaaaaataaggaaaagattataacttatgcaagcagttctgattccacaagtcttttggccaagaggaaatctatgaagccatccatgtatgaggaattggacagggcaatgctggaatggttcaaccagcaaagagcaaaagggaatcccatatctggaccaatttgtgcaaaaagggcagagttcttcttttatgctttgggaatggatggtgattttaacccctctgccggttggctaactcgttttaagcagcggcacagcattagagagattaacattagaaatgaaagattaaatggagatgagactgcggtggaagatttttgtaataactttcgagattttattgaacgagagaatttacagcctgaacaaatctacaatgcagatgaaactggactcttttggaagtgcttgccttctaggatttcagtaatcaaaggtaaatgcactgtccctgggcacaaatcaattgaagaaagagtcacaatcatgtgttgtgccaatgcaacaggtttacacaaacttaaactttgtgttgtggggaaagcaaagaaacctcgctcctttaaatcaactgacaccttaaacctgccagtctcttatttcagccaaaaaggtgcatggatggatctttccattttccgacaatggtttgataaaatttttgtgccgcaagttcgagagtatttaagatctaaaggcttgcaggaaaaggctgtgctcttgttggataattcaccaacacatccaaatgaaaatgtcctaaggtcagatgatggccaaatatttgctaaatatttaccacctaatgtggcctcattgattcagccttcagatcagggagtcatagcaacgatgaagagaaattatcgtgcaggtcttctccagaacaacttggaagaaggtaatgacctgaaatcattctggaagaagctaactctgttggatgcactttatgaaatagcaatggcatggaacttagtaaaaccagttaccattagcagagcatggaagaagattctccctatggtagaggagaaagagagcctggactttgatgttgaagatatttctgtggctactgtggctgccattttacaacacaccaaaggattggaaaatgtgactactgagaaccttgaaaaatggcttgaagtagacagtactgaaccaggctatgaagtgttaactgatagcgaaatcatcagaagagcacaaggccaggcagatgaatccagtgaaaatgaggaggaggaaatagaactaattccagagaaacatattaatcatgcagctgccctccagtggactgaaaatttattggattatctagaacaacaaggtgatatgattctacctgatagactggtaatacgtaaacttcgagccaccatcagaaataaacagaagatgacaaagtcaagtcaataatgtcatttcaattttattgttctgctcattgtgtttgtgacaaactctttgcaatatggcttaattttctttgtgttctgaattctcagacttggtcctgtgaaatacaggcacaaaatgtatctgaagtggtttgaggattatgtgttttcatcatctgtgtcttttgtccttttatttgtacagataatcagaagatgatactgaatagatataaattacatgtacacatgtattcactttttagaatctgcaattataccttctgtaacagtggcattcccttaattttctagtgaaagttagagataactgaacagactgaagcacttttctgaaatcttttgcttgatttatgaaggctgccatagttatcttttcttgtgttaaccatcttaaatgatgttttgtatattttaatagactgataggatgagaaagatttatattattagatttcaggatgatttataataattcaaaaatgaaattcaataatggggaaataattatgaattatagaaattatgccttcattctcttacatttgtgtgggttgcaagagggggagattattctggaaatgaagtaaatatgggaagttattgccaaatgagagagaaactatgggaaagctgatctataaagaggcattctgatcaattcatttgtaggaaactgggaaataaaaacctggggaactttaggttatttatacaaagggaataaataggctgattttaatttggtaagttgatctttttattatgaatttggtaatagtataggtttattatttattcatctaattttatagtacaggttttgtaatgttacatgtgatgatatgagctcccaccttatatgggggaacatcttgggaatttgagatttaataagttttttttttttttttttagtgtttttactgcatactcacaaatgttgtctataatttgaaaaatattgtcatatctggccctttgatgagaaaaggaaattacaataataaagttttatgattttaaataagtcatatgtttgtatcctgttttatgaagaaagcagaaataattactgaaagtgccagacactaaggaatattattgtttattattttaatacatataaaaagggattaatctgctaaaatgtaatctaaatcagaattttgataaattttttttgtaaactaagtatgtttattcaagacattgaaactactttgcacatatgaatattaatgtaacttgtaatttaaaagtaaagtgtttccatgctatttcatgttttggccaaaaatttttaaaaaataaattacaattgttctctattagt

SEQ ID NO: 252895 - DNA, 1295 bp, Homo sapiens
cttttatagatggtaatagcctttaagtttgtgattatttacaaatcaaatttcctttttattcctttaaattataagaatttagtataatgtagtattgctatcctaaagccatcttgaatacttgaaagattttgtcatagccattttgaaacccttgtatccctatattgcagggcatcttccaacagggttccattttgtttcagagtcttctatgaagtctccatgtaaacctccattgctgcccaccttatcatgttcattctgtcttgttttacaaaggcaaacatcacattttattttattctgtcactgtcttctcagtgccttctgtgttgtctcaattcagagtatctcctgcaaatagttctctttcagttttcagaggttatagggttacaattcataatgtttgaatgtgtaactctttatttttgttattatttttatataaaataaaaattattaactaaattttatgtgttattcctccactcccaactcaccattagtatcttatgatattgtctaatttattacatgaacacagtatatttctcttcacttatttatgtcattaatttctttcagcaatgttttgtagtgtttggtgtatagattttgcacattttttggttaaatttacatctaatttcatattttaatgctattgtaaatggtattgttttattaactatttccaactggttattgctagtatatagaaatacaattgatttttgtatattgctcttgtatcctataaccttgataaactaatttattggctctagttagtataacttttttgtagattacatagtattttctacatagccacattgtctgaataaagaaaattctacttctccctttccaatctggttttcttctatttatttttcttaccttattatatgagctataaccttcagtacaatggtaatagaagtgctaggagtggacatccttgcctttttgttggtcttaggggaaaagcaattattctttcacagttttgcatgatgttagctctagggttttttgttttaataaatactccttatcagcttgaagtgcccacctattcttagttagctgaaggttttcttttaaatcagtaatagattgtgtattttttcaaatgctgtttctacatctattgagatgtttatattgggctttgtttctttgttttaatgcctgttcatatagtgagttacattgatttttaaatgttaaactaacttgctttcttggaataaatctcacttgatcatgatgaattatct

SEQ ID NO: 252896 - DNA, 858 bp, Homo sapiens
tggctcacgcctgtaatcccagcactttgggaggccgaggcgggtggatcacgaggtcaggagatcgagatcatcctggctaaaacaaaacaaaaaactgaaaaataaatataatgtcacaggcaggtacgattaagggttctgttttaccacccaaggcacacagcagctaagtacccaaagtctctccacaggtaagtattgaagctcttggtaagtatgcacatccccaaggacctgactttggggccctgctctgaaagcccagacctcggggtctgcccttggagctgaatgatgcagtggggacacacagataaccgctggactcaatccctgcccatgagttgctcaccactcaagcggagagacagatgtgcctcttaagaaagaaagaagtactggctgggcacagtggctcacgcctgtaatcccagcactttgggaggccaaggtgggcggatcacgaggtcaggagttcaagaccagcctgaccaacatggtgaaacccgtctctactaaaaatgcaaaaattagctgggcgtggtggtgcctgcctgtagtcccagctactcaagaggctgaggcaggagaatcacttgaacctgggaggtggaggttgcagtgagctgagattgcatcattgcactccagcctgggtgacaagagcaaaaaaaactccatctcaaaaaaaaaaaaaaaaaaagaagtactgaaaaaaaaacaaaaaagacagatgagatgggtcccagccccactgaacacagttctcaattcagacaatctccagtgacgctgggaaaccaggtctcattacacaggtctctccacctgctcctgccaagaagaaacagacat

SEQ ID NO: 252897 - DNA, 2451 bp, Homo sapiens
  misc_feature (951)..(951): n is a, c, g, or t
  misc_feature (2420)..(2420): n is a, c, g, or t
ccaactgttgatgcatcttgaaaatcattcctcaagtttattatcacttccattccccatgtcagtggcatagctaattatttagaaggcaggtgtctctaggtaattatagttagttctgtatgcaattatcctttctgaaatgtgtgttgtatgccgtaaaaatacctgttacgttatagaatataacaaatagctaacacaatagttaatacttagttgatgctgactatatataattctctagtttattatcataataatacacctcacatcattgaagtcttttacagtttaccaagttctttcattcacggtgtttcatttgggtatcccaacaacattttcaaggcaaacgtgttaccatccttagtttgaagaggaggaacctgaaacttaggaagactaaataacttgtaaaagatcacagaagtgatatctaatagagacgagcttcaaattcaggtttattgaactcagaatcaatgctcctgccccctacctctcaggagtgataatggtaaagattgggggactgtaggccaaataggtcctctgacctcttttataattgtcagcttatctaacgtgaatgacttagataggccttgcagattgagtccttgggagatttcctgcctctgtctagtattatacccagcccaatttgtacctgctgaccttccaagttcctgtgggcatttgagtttctgacctttgcctttgaataagcctgccatttcctatagcatatgtgcattttttgcttcctggaactttctactactttatatttgttctgattacttatcagcaaacaaatcttttagactgccttgtagttctattatggaaaaagtgagaaattattatcctaagaataggcacaaaacatataatacagtgccttgcacttaatgtgtgcttacaaaatgttaattgatgatgaanaagatttaaatcttcctctaaataataagattttatagttatccatcaaaatctaattatgctgaagtcacttcacatcatcataaaaaagtgtttaacactgtttatcaacagataaactgttgttggcttgtaaaatcaaacttgttctgcacttggaattttatcaagttatttgttgggaaaagtttggattatgtggatacttttggtagaagcgttgtgtaaaatgtgtggagtaaaaagtttttgcagataatgtgtttgacataccatattattatattggatgagactttcttccacctgcagatgtttctctttgtcttcccctggtagggttccccttatataataatattcctaggagcaataattgttcccccagatttggatgtcttccagtagttcagagtttcacttagcaccaaaaattaataagctttaattaaaagaagtgattattgctgaaaatgatgacctgttaactccagaaaggcagggtgcttttatccattctcctccttcaaggttggcttttgaattctgaaccatggatttcaatgcagtccatcctcaatttgtaggaagcgttgttttatttggaatttaaaaaggaagctctgttaggtaacattgcagcacaagttctttttaatgtaagtccatgtattaatcaaaacagctgtgagggttactaggtagactgtgacaccgggtggcaataaaatgtcttcctcattacaattaataccgatgacttgcagagacctcctgtatgtgatggcctttctcgatgggcatcctcacttggtggtagggaaaatgagtatgggctgtatgaaacaatttcagcaccaccctgagcttaatagagccgtctttcattgcctgttaacaagctgtgctgctgccataaaatgttcaagctgacaaatgctgtcaaagctccttcaatgcaaagattttctgccgtatttaacatgttaacttttattttaatgatgccaaaacacacatcagttgtttgtgcaacatccagtgtggtctctggagccatcccattagctgaaaagtatagtcagtgtcctgttccagtggccattaatggtaaaattcttcaattaaaaactgtggagttatgctgattcaaccattcactctatcccagaagtaaaatagatatacctacttgctgtgaaattattgagtttgtttagcttgattttctgtgcattacattagccatgagtgtattatagaggctaagaatgataactctatgaaggtttattatgagattcccatatttggctcaaggttttatacaacttgatatgctacctactactagtcttccagttccactattgcaactagttaacacatacattgtacttattgtgtgccaggctctgttctgactgctttatatgtatctactcatttaattttcacaacagtcctanttattaagtgccattgtcctcacttaaaggt

SEQ ID NO: 252898 - DNA, 1211 bp, Homo sapiens
gacagctgttatgagctagaagcgcatgacttattgtgacgatgtcttgcctttctgtggtccaagttggagtacatggcaatgccctcctgctgatgtgcattaaggaaaatctaagtctaatatttggaattaagatatattttagggggaggggacagaagcaatgtaaaatagttgatttatgataaagctcagaatgtcctcttcatttattttcttgttttattttcctttctaaacagaaactgcatttaattccaaaaagtagtattcttatttattatttaaccctttgctgctgctaaaatgtgcacatattcaggctttagtttttccaaaaggcattttttttttggctgaaaaatattaaacatttgaccacagggaagaatcaagtttctaggatgtcataggtatactatgtagcactgaaaaaattgattttaggtgacagccaaaagtagtcttaaagtagcatgagaccttagataatcgacctaaaagaaagaaaattgtgaaaaagacaaaaatcttcatgcattcctataaaacgctactttaaggtctacttttggagttaattttgtttggtactttttttttttttaagacgagcaaattgttatatgcttttggcaattgatacaataaactgtaatggtctgtaaataaataaatattgactcatgcgatttatgtaaatagtggaactgggagagtggatggctcagggtttcggtgtgggcattgtctcttgggcagtagagtgagtcatccccagctcatgggtttgcatccagttcttgtcttaagagacccaaagcccagtgaatggcagccctgagccactgtggaatgggggttctggtttcacaaacagatgcttagatagccaaaccactgtcttgttggtgccaacacttgcactgtggtcaaagacttaccgagcatgggctgaacaaccttcccatctgtcatgtgaatgtccccaagcagtggtgaaggacatgctaggtcagtgttggggaacctgccctgccaggtcctgttttgtagataaacaaatggctgccttctggtgtttttattctatttcatctcattaacactacaaccttgtgttatttacttgataatctgtaattgtatgtaaatacatacaggattatgtaatttgtgtaaatacataattacagagttttgaaaac

SEQ ID NO: 252899 - DNA, 449 bp, Homo sapiens
gtcaagttttatttttgacctaggtactagttacagtgtgtttgccttttaataaatgtagtaaaccacatatttgctttgcatgattctctgtatctgtgttttattttaaaagaatttttatttatttatttttaagacagagtctcactctgtcgcccaggctgcagtgcaagacagagaaaaaaaaaaaaaaaagaaaaggatcggtcacttttgaagagcagtaggaaaccaattcatcatcttgaaaactggtaaattacagaaaaaaaatcaagcatttaccataactgcctttcttatacaaactgaactaccatgtaactaaataatatatgaggtaagtgtctccctataaaagtattcaaatacatgaaaaagaaataatagaatatcagcaaccttcaatgaattgatatagtcattaagcatcagtagaggcttat

SEQ ID NO: 252900 - DNA, 473 bp, Homo sapiens
gatggatcagggctggcaaccattactggggtggtttctttgggtcttttaagataaaagagatttgatatgtttattaagtaatgtggttaccctggaagctgggcatgtacttctcgtgataactgtatagcaattacttctgttggttacaagcctcagcttttgtttgctgaaatgttagatttggttatatctttgtaggtatgagatacttttaaagggatagtgtttagtaaatttagatatgtaaaacttgcctttcattggcaaggatcacaataacagctttgtaggatttctccgcagacaaataatctctacagtggacctcaagcagtccttctgcttcggcctcccaaagtactaggattataggtgtgagcttctgaaccctgcacaccgccagattttttgttgtttttgagtcagatttggtaatttgtatttctcaggcaatatgtctatttcat

SEQ ID NO: 252901 - DNA, 433 bp, Homo sapiens
gatggatcagggctggcaaccattactggggtggtttctttgggtcttttaagataaaagagatttgatatgtttattaagtaatgtggttaccctggaagctgggcatgtacttctcgtgataactgtatagcaattacttctgttggttacaagcctcagcttttgtttgctgaaatgttagatttggttatatctttgtaggtatgagatacttttaaagggatagtgtttagtaaatttagatatgtaaaacttgcctttcattggcaaggatcacaataacagctttgtaggatttctccgcagacaaataatctctacagtggacctcaaggtgtcatccaagaattcacttgagtcctatgccttcaacatgaaagcaactgttgaagatgagaaacttcaaggcgagattaacgatgaggacaaa

SEQ ID NO: 252902 - DNA, 520 bp, Homo sapiens
aactgcacggagtttaccattgctaacacccagtacctatagtcacctaatgtctggaacacagtaatgcagatggcaagtttcttttgaaaatgacttaagtagttttcttgtggaacatcaaactttattattccaagaaattaagatataggtaagaaaaaatgaaatgccaaccctaatttaaattatctacatcttcaagtctgttaacagtaggaggttagatgtctgtggccaattttaaattaggtttcagataattgatatgaaactgtttacacagaccactgaaaaatggtttaaaaaggtggtcgtttgagtaaggtaacaattcttaattaaaaaaaaatatacagaacaaaattctattaaagatatttgcatctctggttatgatacaaattctgaaaaatgtatataccaaatactccttaaggcagagctgacatttaactcttgaggataataaaaactggatcagtattttgttgaaataaaacttatgataaaagtgaaa

SEQ ID NO: 252903 - DNA, 547 bp, Homo sapiens
tcatgagtgatttacatgaactgtgttctcctcggggatctgtaaaaatcctgtgcctaacaggtaaggctgtttctttaatgccagtagggccttcgtccctggccagggtctcctcgccttagactggccccagtgatgctgtgaagccacttgggcatctgtagggccagcatatgcctgtcctgtcagggttgctcaccctgagtttcacatgtgggtggaagtggactgttttctggttgcctgtgaatatgccctgcacaaacgctgtctgcttggagggaagttgacgggagtgtggctggatgctgtctgcccggcgctgtcttcctgggctcagcatcctgggacacaggacattgtagtggagcatcccaacctgaaactttgtctcagtgtagagacccagaaagatggggtctgggtgaaggagtgtggagtatggctgctgctttccaggaaacggtttcccctggtaacagatggcattgggcttttagtcctgttgaaattttgttgtcagaagataaatgtaaatagactc

SEQ ID NO: 252904 - DNA, 711 bp, Homo sapiens
tcatgagtgatttacatgaactgtgttctcctcggggatctgtaaaaatcctgtgcctaacaggtaaggctgtttctttaatgccagtagggccttcgtccctggccagggtctcctcgccttagactggccccagtgatgctgtgaagccacttgggcatctgtagggccagcatatgcctgtcctgtcagggttgctcaccctgagtttcacatgtgggtggaagtggactgttttctggttgcctgtgaatatgccctgcacaaacgctgtctgcttggagggaagttgacgggagtgtggctggatgctgtctgcccggcgctgtcttcctgggctcagcatcctgggacacaggacattgtagtggagcatcccaacctgaaactttgtctcagtgtagagacccagaaagatggggtctgggtgaaggagtgtggagtatggctgctgctttccaggaaacggtttcccctggtaacagatggcattgggcttttagtcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgta

SEQ ID NO: 252905 - DNA, 476 bp, Homo sapiens
tgctttgtttgttgctcaggctggtcttgaactcttggcctcaagcaatcctcccacctcagcctcccaaagcacagggagtataagtgtgagccaccatgcccagccttctttgttttagactggatgctgctcagttcatgaattactaataaaagccaattagatctttaaaattaaatttgttgaaattttgttctttgacggaacatttccatcaccccacaaagaacatttcatatacatggaatcatacaatatgcagccttttgtatctggcttctctcacttaggatgttttcaaaattcatctacagtacagtatatatccacatttaatttctttctttttttaaattgaggtaaggttcatataccatgaaattaatcattttaaagtgtttaattcagtgccatttagcaccttcattatgttgtgcaatcatcacctctatctaattccaaagcattttcat

SEQ ID NO: 252906 - DNA, 608 bp, Homo sapiens
gtttgtaacatctggaagggagaggataatattactcgcaatatcgcagggggtgtacaccccttgtgatattgcttgtagtatctgttggggagaggatgttattcctcgcaatatctcagtgcgtatactcactggaatattagaagtaatatcctcgggagatattactcctaatttcacagtgggtgtacaccctgtgatattatttgtaatatccttggggtatgttactcctcatgtgacagcgggtgtacatcctgtgatattatttgtatcatttttagggggtgttactcctaatgtacagggggtgttcaccctgggatattattggtaatatcctagagatatgttaccgtaatgtcacaggcagtgtacacttagtgatactattcgtaataccctaggaggatgttactcctaatgtcgctgtgggtgtacactctgtgataatattcgtaatatcctaagagtatgttattcctaatgtcacagcgtgatattattcccaatatccaaggagaatgctactcctaatgtcacagggggtgtaaaccctgtaatagtatttgtaatattttagggggatgttacttgtaatgaca

SEQ ID NO: 252907 - DNA, 405 bp, Homo sapiens
tcactttattgggaaaagtttgttatagaagcaaactaatcgatcactggtgactgtttttcttttagcaaaggaaaaagacttcattaattgacgtatacttgctactgtttggtcctacttacagaaattcctctaatttacaggggcaggttattgtgcataccacagtatagcttggatttgtaatttcaatactaatgcatattcatcccatgtgctctttatagtttcttatgtcaattagttactttcttctgggatttagtgttttgtcttggattttatagaaatgtatatatacttttagaaggtacagggaatagatgaaattaactttagaattatataatttatctgatataagtgcatgtatagcctaaatatatttctatattgaaagat

SEQ ID NO: 252908 - DNA, 303 bp, Homo sapiens
gtaacataattttttattggggaaaatttctttggtttttacaagttgtaaagattgtcgttgaaatttcatttttaccgtggatgcaaagatatttttctaaatctggtaattgcagtctttaaaccaaagataacagtaggtggtagaaacattctgtgaaatcctgaccagtaggaatgctggaggtatcactttgtgttgaatggaaggagaaacgaattgttgaaaaggtcagttaagtgtttcctttgcttggccggatgggtaagaaaataactgcttttgaagcaggcttttgcc

SEQ ID NO: 252909 - DNA, 299 bp, Homo sapiens
gaccctgtctcaaagaaagggggacaacaaaagatccatgtgggtgggtttctcgggagcatcatgacgttagtctgtggagtctttaacgcgcccaagctgactgttggtagagccgtgaccacatctgctgctgctttgtatttgagactatttgagttgtgatgttcctgccaacgttccttggtatctctatacgaataaaatattccacaatcgtttactgtttctcatgatctatggcatcagtcttggcaagtcctttcgttgatgaatatttaataaatacttaactggtc

SEQ ID NO: 252910 - DNA, 592 bp, Homo sapiens
ttttagtttaggtatcatttatgctgcacacgacattactgacttaacgtggtgggaaatgtacaagatagaggctgccattttcctgtttgagctgggcccagattctgcttttatattgaacatcacgattccattctctagagaacattttatttttctcaagaaatgcattaagtccaactgctaaacatagatcttgaatctctagctgtaggattttcaacagtcttacttatggggattcaccttccttccacaatggtcttattatttaaatgagtaggacagatacaaataaacctgaacatagatcttgaatctctggctgtaggattttcaacagccttacttatgggattcaccttccttccacaatggtcttcttattatttaaataagcaggatagatacaaataaacctgtcctggtaggctggggaccacacggcagcgcaggccatcttcacaagggtccaaataccaacagcccagaagccacagggagagaactgagggagcgtttcaatctggtagtctatttagcttacagtacctggaagaaagaatataggaatctgtctggaggttct

SEQ ID NO: 252911 - DNA, 412 bp, Homo sapiens
ccctcctgttgttaagtttgtggagcaacttaactcttcaacactgctagtagacatgtatagtacaatagtattatcagtgtttcagagactgctcatttacttccaatatcagttttccctttcttccttagtaatagaatccactattttttgtagagcatttaaccacccagaataaagatgacacatcccagtctctcttgcagctaggtgtgatcaggtgactaagtgctggccaacagtatatacttggaagtctttcttctcctcttctcccttcttgctggctggaatgtgtatgtgatgagtgaagtttgaacatccatattgcactacaagatgaagaccgcatgctaaaaatggtggagcagcaagacggaagtctcctgtatccctgatgattttgtga

SEQ ID NO: 252912 - DNA, 673 bp, Homo sapiens
tcctcaatttgagatatatagctttcataaaattagggtttagtcctctatagtttgacattgtattattctgtttgaagctagtgtttgggttattgacagtttgtctttttaaatatttgcgtaactatttacagagaatttggaggaacctcattagaaaatcctagatgcaagtttcctgatttcaactcatcaagcctctaatctctctccactcttcttaggccccttactaagtaaatgaataagacaaaccctcatccttgatgtggacagccatcaaacctgatgggtgggaaaagggaaaagaaagaatgaagaaggaatcatatcttttactttgtttagctctacatctgaattttgtatctgaagtaagttttacagtgaactaaatattgtaaaacacttattactctcatattgacacaatttaatgtaatcgttaccaaaatcataacaggatttttaatgacttggcaatattattttaaagttcatctgggctactctggatgcactgcttatgggttaactttgctccacaaggagcgaaagaaagaatagaaagaaacaaaacaaagaaaggaaggaaggaaagaaagaaaaaaagtaagttcatctggaagagtaaacatatgagaataacaaagaatattctaaaaaataa

SEQ ID NO: 252913 - DNA, 182 bp, Homo sapiens
gcacaagctagaacctccagtacagtgtgaaatagaacaatgttgaagagtgggcattcttgcctgtttttccatctgaggaaaagcctgtggtaattaagtatgatgtgttctgtagttttgtttgcttgtttgttggtagaaactgtcagattaagaacgttcccttctccttgtttgtt

SEQ ID NO: 252914 - DNA, 485 bp, Homo sapiens
  misc_feature (198)..(198): n is a, c, g, or t
  misc_feature (200)..(200): n is a, c, g, or t
tgtgatgtataataagaaatatatgtttgtctttgtttcctggacacagctcctgaaaccataagtggtgggagcgataaacgtgaacaaagaatcttttgttattcaaaacagatccctttcgatcacacctaagtttatgtaaaggagatgtaaagtctctaaggatgagggctagttgccagggaacaaaacccntncgattagagggaagaaaggagagagagattgaagattgatttgatcaccgatgggcaacaatctaatcaatcatgcctactatgtatggaagcctacataaaaactcagaagggcagggttcagagagctttcaggttgctgaaggtgtggagggtggggcacccagagatggcagatggggctccatggccatacccccatatcttgttctttgtactttttcctctggctattcatccgtattgtttgcaatatcctttgtaataaaccaaacctagtaaata

SEQ ID NO: 252915 - DNA, 512 bp, Homo sapiens
gatgatgagacgttatttccatcaaaaattggtgtcccgttcccaaagaatttcatgtctgtggcaaaaactatactcaacgccttctttagggtttatgctcacatttatcatcagcattttgaccctgtgatccagcttcaggaggaagcacatctaaatacatctttcaagcactttattttttttgtccaggaattcaaccttattgatagaagagaacttgcaccactccaagaactgattgaaaaactcacctcaaaagacagataaaaggatgcagagctgtgcaaattgttcctcaaatgaagcagtgtggagtgtattggggattttgttatattttgtttttatctggattgtttttgtcctaggtttgggggcgggggcttgtttgggttcctttttctttattctgattatgtgaaaccatattctattgctaggggaagccaagaaccattctctatacacttgataagggtaaatttatcttagtgtttttaaacttg

SEQ ID NO: 252916 - DNA, 462 bp, Homo sapiens
gcggccgctactactactaaattcgcggccgtgcgacatagtcaggctctggcgagagcctttcctgggtttcagaacacttcctcactgtatcttcacatggcagaaagcaaagtagaggaagcaagctctcttgtgacttttataagaacgctaatcccactcatgacgactcctccctatgacctcatctaattataattattcccaaagtctctacctcctaacaccatcacattgaacagtaggatttaatcctattgaacagtagtggggaaaaagtggttcagtctataacacttgtatttaaatgtaaatttgtttttctcatttttgagttactttcagatatccatcaatatccatgctgacttctccccctcatatcaccttttatgatattgcatagtaaatttcctttaacttttagaatttaaaatattagtcatacatttaatactt

SEQ ID NO: 252917 - DNA, 2349 bp, Homo sapiens
ctgctcaataaacgacctttagtctcggattgccggcccggacattccactgaattctgtgaatgtgtagcagggttggaggaccctcggaataacccccttggggaggtggacaaggacaatctcagcgaagagcttgctcccctcctccccacccttaggaaacgtccgtgaaccggagtgagagggcagtgggagttcagggagcaaagtccaggcggaggagcgtgaggcggggcttccgtccgtcccgcacacttctgggattgttttctctttcagaaagcgctactgcggagtgaaccggtccttatatcttagtttcgtgactttgggggcggcaggcctgtgagttgttttccgccctggacgctgttttgcaaagatctctgcgcgcccaccgccaccctcccgggcgtgcgggccgggaagcagccagcggtgggaaactccgacgccctcctcgacacttttctccccccaactccccaagactcacttctagggaagtcctttttcccatcaagccctgggaaagactggccaggctgagagagggacccgtcctcctctgtgccaaaggcgggagcaaatcctggtgctgtcgcctttggatgtgagtcctggaaatggcgggggtgaggaaggtgggcaggggcaaggtttggccctcaggcgagaaccgacgccttgtcccggaagcgcagcacggccgagtgcgtccgggggtgcagacggcgccctggggtggtcctgccgccacctctcctttgactcaggagcgccgcgccgcgtccgggcgcgttctcagtcgcgcgaagccagagaggaccctgggcgtgattctccctccctggcacagacggagacccgagtgaccccggggtccgggtgggcgtggggaatggacccatagacccgggacgagcggcgcggagcccgcagctggccagcttcagccaccttgggagacgcagtgcagctgccgctgctgacagacaagaccaaggctcggctgggccccaccccagatccggcctgagcgccttccgcgctgctcggcctcaaggcgtgagtcaccaagggcaagtcccgtgacttggtcctcagggtctccggcctcggcacattaatcttcagacccggctttttcgacgccgagctgccgcccagccccaatggcagggccttccagggagtcccagtcagactgctccccagctcccgcagctgctcggtccctgcaaagcccccgggagcgtttctactctcccctgagcccacgccatcccgtcactcctaggaaacttttcgcgcagaaactcctggagaacagccccggccgccaggtactcgcccgcccggaccgcaaagcccacagagcttcaattcgcaggaaggggagtggggagccctgagctggggtgttcctggaagaggtcggggagcggggggagaggcattccaggctggaggcctggaaacgtttggaagctttgctaaccttggagaccatgtcaggaaagaagcgtacccaggccgtctgctgtgtgcccaccccgatccccatcagtgccccacgcactcgagctcttcttcggcgtctgcagcctcttcatccgcgcggagaggcggaggtctcccggaaacagtgtccgactgtggcaccccagagcgtccaatgcgagctcaggcctttcccgcaagtctggagttttcttatccagttgaggccgccttcgctgtactcactctctgcctcccaccccatcttctgccacccgacctccatctttgatggttagcgccttcagccctcaacagcttcgcacaaccaacccctagaagccgtggagtcagaccggccagggtgggacctaggttttaactcgggttctggctacacacgctgcgcctccatacagtttgtcccaggtttggcagcaggccggctaccttcaggaattctttgctttggcttctgtctgttcctgtctgttgggcaagtttctagctaccccactgagagaaccatagaacaaggaccctggcatggcatacagacaaggaatgtttgctgaattaatggagctggtgccttgcagcttcccttttgttccttgaagttgcccttgctctcctccacatcagctccctctcctcctcagctacttattccccaccctggcttcttctagtcgcagtccccaagtacttgctgaatcctgtatggacagcctaagcctccatttctgacaattcctgtggccccactccatttgttttttagacttctccctcctttttgtccccatcccccaagttataaaactataatgcaaaaaaatg

SEQ ID NO: 252918 - DNA, 480 bp, Homo sapiens
gatcatcccacaagcaatacgtttgataatagttttttcttttaacctctttaaggaatgattctgcttgagaatattgaaagtacttgccagaagttgtggatttcagttttaacaaatgctattaaagtggagaagcacactctggtcttggaattccatttgaggatttagaagggtcatgtttataactattcaggtgtgtttgttgctggcttgttgtaaagcaataaaatttttttggtctttttgtaagggagtgtggtgctgtaaaaaatctacctccctctcctcctcagctacttattccccaccctggcttcttctagtcgcagtccccaagtacttgctgaatcctgtatggacagcctaagcctccatttctgacaattcctgtggccccactccatttgttttttagacttctccctcctttttgtccccatcccccaagttataaaactataatgcaaaaaaatg

SEQ ID NO: 252919 - DNA, 2117 bp, Homo sapiens
ctgctcaataaacgacctttagtctcggattgccggcccggacattccactgaattctgtgaatgtgtagcagggttggaggaccctcggaataacccccttggggaggtggacaaggacaatctcagcgaagagcttgctcccctcctccccacccttaggaaacgtccgtgaaccggagtgagagggcagtgggagttcagggagcaaagtccaggcggaggagcgtgaggcggggcttccgtccgtcccgcacacttctgggattgttttctctttcagaaagcgctactgcggagtgaaccggtccttatatcttagtttcgtgactttgggggcggcaggcctgtgagttgttttccgccctggacgctgttttgcaaagatctctgcgcgcccaccgccaccctcccgggcgtgcgggccgggaagcagccagcggtgggaaactccgacgccctcctcgacacttttctccccccaactccccaagactcacttctagggaagtcctttttcccatcaagccctgggaaagactggccaggctgagagagggacccgtcctcctctgtgccaaaggcgggagcaaatcctggtgctgtcgcctttggatgtgagtcctggaaatggcgggggtgaggaaggtgggcaggggcaaggtttggccctcaggcgagaaccgacgccttgtcccggaagcgcagcacggccgagtgcgtccgggggtgcagacggcgccctggggtggtcctgccgccacctctcctttgactcaggagcgccgcgccgcgtccgggcgcgttctcagtcgcgcgaagccagagaggaccctgggcgtgattctccctccctggcacagacggagacccgagtgaccccggggtccgggtgggcgtggggaatggacccatagacccgggacgagcggcgcggagcccgcagctggccagcttcagccaccttgggagacgcagtgcagctgccgctgctgacagacaagaccaaggctcggctgggccccaccccagatccggcctgagcgccttccgcgctgctcggcctcaaggcgaaacttttcgcgcagaaactcctggagaacagccccggccgccaggtactcgcccgcccggaccgcaaagcccacagagcttcaattcgcaggaaggggagtggggagccctgagctggggtgttcctggaagaggtcggggagcggggggagaggcattccaggctggaggcctggaaacgtttggaagctttgctaaccttggagaccatgtcaggaaagaagcgtacccaggccgtctgctgtgtgcccaccccgatccccatcagtgccccacgcactcgagctcttcttcggcgtctgcagcctcttcatccgcgcggagaggcggaggtctcccggaaacagtgtccgactgtggcaccccagagcgtccaatgcgagctcaggcctttcccgcaagtctggagttttcttatccagttgaggccgccttcgctgtactcactctctgcctcccaccccatcttctgccacccgacctccatctttgatggttagcgccttcagccctcaacagcttcgcacaaccaacccctagaagccgtggagtcagaccggccagggtgggacctaggttttaactcgggttctggctacacacgctgcgcctccatacagtttgtcccaggtttggcagcaggccggctaccttcaggaattctttgctttggcttctgtctgttcctgtctgttgggcaagtttctagctaccccactgagagaaccatagaacaaggaccctggcatggcatacagacaaggaatgtttgctgaattaatggagctggtgccttgcagcttcccttttgttccttgaagttgcccttgctctcctccacatcagctccctctcctcctcagctacttattccccaccctggcttcttctagtcgcagtccccaagtacttgctgaatcctgtatggacagcctaagcctccatttctgacaattcctgtggccccactccatttgttttttagacttctccctcctttttgtccccatcccccaagttataaaactataatgcaaaaaaatg

SEQ ID NO: 252920 - DNA, 354 bp, Homo sapiens
gccctctttcttccattcacttacctgtctagtcaaacacccatcagacctttgccaggtgtccagcctgggcactacgtttcagaaaatgatgcacatagaatccctaactgaaaggagatcgcagctcatttggtacaaagtggtaacggcagagtcccaaaacacatgaagcaagaactgacagaactggagggagacatcaatcaataacaacagttggagaattcaataccctgctctgaataatggatagaacaattaggcagaagaccaacaaagaaagaggatatttgaacaacgtgataagccaatttgacctaataaatatctttatctgtgaaacaccctaaa

SEQ ID NO: 252921 - DNA, 650 bp, Homo sapiens
aattaaaatagtatattagaaaacagttgtctaacacacaagaaggcagtaatggaaagagtgaggaataaaaaaataagacacacagaaaacaaatagcaaaatgacagatgtaaatcccaccttataattatattaaatgtaaagagactaaacaatcatatggcaaagagtagaaatgtggatataaaaaatatccaacactattatgtctacaacgcactttatattcaaagacacaaataagttgaaagggaaaggatagaaaagacatgtcatgcaaataggaacaaaagagtgttggggtcgctgtaccaatgtaggttatacacagtaaacttagagacagaaactgttactacaaagagcagcattttataatgataaagcgtggattcatcaggaagacataacataaacatgttataaacacgcatgcaggtaacggcagagtcccaaaacacatgaagcaagaactgacagaactggagggagacatcaatcaataacaacagttggagaattcaataccctgctctgaataatggatagaacaattaggcagaagaccaacaaagaaagaggatatttgaacaacgtgataagccaatttgacctaataaatatctttatctgtgaaacaccctaaa

SEQ ID NO: 252922 - DNA, 488 bp, Homo sapiens
atccaataggattgctgtacctataagaagaggaagagacaccaggggtgggcatgcacagaggaaaagtcacgtgaggacacagtgagaaggtgatcatctgcaaaccaaggagagaggcctcaggagaaaccaaacctggtggcaccttaaccttggacttgcagcctccagaactgtgagaaaataagtatttgtttacgccagctagtctgtggtattttgttatggcagccctagcatatagatgatagatagatagatagatagatagatagatagatagatacatacatacatacatacatacatacatacatacatacctaatgttacttcataggagagaaaaagaataaaatcaagctcttcacattctatgctctgttttattatgagcaagtcactttcttttctgcctcaatgtcctcaattttaaaatagaaaaaaaaaaatcccctacatcccaaaagtagagagagaagatg

SEQ ID NO: 252923 - DNA, 746 bp, Homo sapiens
ctatgaacggcctgggcctgggtggtacaaagcatgtggtcttttcctcatggaaccgggcgactttagaagtagcattgatggttgtttgctgtgacacctgtgtgagtgttaacatgaacagtcaacagagtggccgcagcgtgtagcgccatttaggggtgtaatagagtgtcactcaatattagctcctcacaggcaagaacgttttcactgaaagtaagagagtgcacttcctggtgctaccttcatttcctgccctgggtcccatgttttaggtgagacacattcttaaattgcccagctgtctatgtgatagggctgagacagatcatctttctgatcttccggattatcgtgtctattgcctttccattacactaaaaatccctcctctgccatactcttagtaggaaagggtgattttttttttccccgaaaggaaaagggagcctataaataaaccgtattatcttcctatccccttctgctaaccaaacacccaagagccacactgagagaggaaatggaaggagaattgtcagttcccaaatgtgaggtgaaagctgtgcttttctttctattatctggtctgattttgagttctctaccctgggatgttacccagtattaccagctgtttctcacagtgaccgattgtggtcatgaatccttggggattcatgatatttttataatacatgcactcagggaaactcagtaaaacacattagtgttaataagca

SEQ ID NO: 252924 - DNA, 405 bp, Homo sapiens
ttcctgcacgttccttccttccagcagttttacccgaagatgggggaggttttttatttataatgaaaccagtgtgactgaatgatggaggaaaaaaggaagtcctcatgtcttttcaaaatgaagcacaggccgggagcagaggctcacgcctgtaatcccagcactttgggaggctgaggcaggtggatcgcttgagtccaggagtttgagaccagtctgggcaacatggcgaaacctcatctctacacaaaaatacaaaaacaaattagctgggcatggtggtgcgcacctgtggtcccagctactgggaagcggaggtgggaggatcaggaggcggtgactgcaatgagctgagattgtcccactgcactccagcctgggcaacagagggagatcctatct

SEQ ID NO: 252925 - DNA, 341 bp, Homo sapiens
tacttttcagtttttccattttatctgaaactttaagttggcatttctgaccagcctttcttgagaccatcattttttgggcacttactgtagacaggaatcagcaccctagcctccttcagcccaccccatgtaacactaaagagacaactggtgcttggcaataacaaaaatattagtgattgataaacttgtaaatttattaaaatggacagtgaaagaaaacagccaatttagttgtgaactggagaagggacgtgaggcatctgttgtctgcaatcttgtatgttgtggttgaccacaaaggcttggcatcaggttttacttccagcactacttct

SEQ ID NO: 252926 - DNA, 286 bp, Homo sapiens
ctatgaggatgcaacggcataagaatgatacaatggactttggggactcaaggaggaaggctgggagggagtgaggcataaaagactacatattgggtacagggtacactgctctggtgaactccaaaatcaccactaaagaatttttccatgcaacaaaacaccacttgttcccccaaaactattgaaataatttttttttttttttttggagacagggcatcactctttggctcaggctacagtgcagtgccgcgatctcagttcatggcaacagggtctctca

SEQ ID NO: 252927 - DNA, 479 bp, Homo sapiens
cccacttgcagatgatggaaggcttgctggcaattactgaaagaaaatgggaggtgggaaaatggagctgcatttatattttacttcctgaatgtcaaggtgatgctggcacaaatattaaagggaacattccccttctttgggatataggaaatgctgctgcaaacttagagataagggaagagatatgcagagttaatgaggaccagctttacctctcaagtgcccagaaatggctttaataatcaggtctgggttctttgaggcttcctttctttaacttagaccattccttcccaacagaaatacagatttctccttttaccttctggctggccattagatagggggctaaaacttcgaataaatctcactgtcaaaaacttttgatttatccagaatatttgggttttctcattttttttaaaaaggaaataacaggttattgaataaagaatttcattaatggttaaaaagct

SEQ ID NO: 252928 - DNA, 2491 bp, Homo sapiens
  misc_feature (1037)..(1037): n is a, c, g, or t
  misc_feature (1329)..(1329): n is a, c, g, or t
  misc_feature (1382)..(1382): n is a, c, g, or t
  misc_feature (2460)..(2460): n is a, c, g, or t
acacatacatgttttggtcttcttggctcatctatcaccctatgtacagaactcgcggtacacacaaataaaattaatatgatcacaacttaaagggacagataaggaattttaaccaattttcagcaaatggttattaatgtttactttcagaaccacacgcacagcatgtgcagctggtgactctgcgtgggccacctgctacctagtgctttttcaatcatgcctgattacaacgacgagggagaaaaacaccagatagctcagcctgatatgttttttatcattcagtctgcttttgggcagaggagttcaaaccacgagtgtcagcagtgtgtaagacagcgtggggctcgggccacctgccgcagtggacccctggcttagtttccatgtgctatcttagcatggcagaaagcggattccaaccagccacagcaggtgacaggagctgaagctcagcccttcctgaaagcaacccatgccctcgaggatgctgacggtgatctgagtacattttccagctcccttgttctgtgtaaataaatgtttaagaagaaataagcactagcagcgatccctagcactttatgaagaccaggatactgatactcccttcccgttggatggcacaccacagtttgtttgcatttcatttgctatttataacaatagaggaagaaagacaaaatgtttttgtttttgttttaacacgtgaagaacatgagatcggaagaggtaaagttaatttcccagaattatctatgctaagccttgaaaagccatgtttattacagatcagatatttactctaaaacaaaagtgtagaatagcagaaaaacaatggacttagaggtcaaaaggctataattttgtccacatacatctctatgatcccaagccagtcatttactttctctgagcctgatattctcatccataaagtggaaccacctgtcttttgcatagtcaaggaggcagtgcccatggaggagcactgagttataaagggctaactcctgtgagggatgactccngtcatggtgaccagttatcctctcctctgaattttgttcttcagaggccaacttgaaagagtttgaagcctgaggttggatttataggcactagaatacatcagcttcaaacattcacaaatcaggaactgatttcatctcctcttgaaacctatcatctgttagctaaaatagctctggttgcttttattccagataataacacttaaagttttaatgagagatgagcatgttcattaaaaaacaagtcaaatgaaactaaaaaaaaaaatcatttacttggaaatccatncctgtaatgaagtcatactattgtgtagacaacagtggaatgattaggtctgnttttaaaaaaagagttgtcaccagcaccctatgtagaaagactttttttcaatttccatgagagttgtgttcacttgcaaattggttgtgaggcagccaggtgggagggggtccccggaaaaattccaaccagactgcgccctgggaagggtgtgcactggggtggagccacagaagtgcgaaccctttgcagtggggaggagcctggcccctcctcttcctgggtggagctggggattcaagctgcgaggcagtaagcacactagatgaactctggccttgaggagtccctgtttcccttttttccttttcacccaataaaaccctgctttactcacccttcaaaccatctgccagcttgaattttcatggctgtgggacggacaaggaccccgtctttagctgaactaaggaaaagtcctgcggcagttgtgtgaggttattaacacaagctacacagaaacacatgttatccacgttaggccagcctctccatgcctatttgatggaagtgcaggcaaaatgtaagaagaataactctgctgtgttttggattaaaaggatttttgtggactagcatgattatttatttactgtacctataggcaaatgtattcatgaatggtagctcaaaatgttgcaagtagacatcagctgttttcagaacagctcagagagatgccaccctgccaatgagaagaagcttaggaagggggagccctctgcagctgctccgggtacttggcacatggccagaagggatcccacaccctgcatctgccatggcctctcaaagaaagagaagaaaatgtttcacccatgcatcgaacatgcctctatacaggacagtcataatttgggtgtttataggtcagggatgactgtgatgcatttcctaacttttattctctgctgtagctatgtaagatggggagtctttagctatatgccctaaaacacagaaataacctgaccccaggcctgttactgtggcagcttggttggcctttagaggttaacattcaaatcctcaaaaggaagaaactcgtatgagagaataacatcttcagatactgangcagaaagaatattaaagcatatggattcag

SEQ ID NO: 252929 - DNA, 207 bp, Homo sapiens
gaggtaggcgcgtcgtcgcggcgggtccgagtgcgccctcgccccggtcccggtctccgtggagtccggcgcctctcgggcgggccccccggaactcccggccgcccgcttgctgagcctgtccctccccagccccggctgccatcggcccggcacccgaaacgggccgtgcccccgcccccctgctcgccctccgcccccctgctc

SEQ ID NO: 252930 - DNA, 6561 bp, Homo sapiens
  misc_feature (1)..(1): n is a, c, g, or t
  misc_feature (3)..(3): n is a, c, g, or t
  misc_feature (5)..(7): n is a, c, g, or t
  misc_feature (10)..(10): n is a, c, g, or t
  misc_feature (5184)..(5184): n is a, c, g, or t
ngnannnctncctctcaatttttgggaatagtttgagaagaattggtgtttgtttttctttataaattgggtagaaatcagcataaaagcctagtctagggcttttctcttttgggagactttatgttactgagtcaaacctgctattcattttgggtcagttcaggttttctgtttcttcctagttcaatcttggtaggctgtgtatgtctgggaatttatccctttcctctaggttttccaatttgttagcctatggttgttcataatagcctctaatgatcctttttatttctttggtaacagttgtaatgtctcctttttcatttctgattgtatttatttgggtcttttttttttttttttttttttttggttagcctcactagtggtttatcaattttgtttaacttttcaaaaaaccaacttttatcttgttgattctttgcatttcttttttgtctctgttgcatttggttctgctatgttatttatattttttctttctactaattgtgtgtttgatttgttcttgcattttgagttccttgaggtgcatcattaggtcgtttatttgaaatctttctacttttttggtgtaggcatttattgatataaacttttctcctagtactgcttttgttgtatcccataggttttgcatgatgtgtttccattttctgtttaaaaaaaatttttgatgtccatcttaatttcttcattgacccaatgattattcaatagcatgtttaatgtccatgtatttgtacagtttccaaatttcttcttcttattgatttcaagttttattccattgtggtctgagaagatacttgatatgattttaatttttaaaattttattgagccttgttctgtgtcctaacatatggtctatcctggagaatgttccatgtgttgatgagatgattgtatattctgctgctgctggatgaaatattctgaaaatatctgttaggtccatttggtctaaagtgcagcttaaatcaatgtttctttgttgattttatgtctagatgaactgtccaatgctgagagtaggatattgaagttctcaactatcattgtattggactctatctctccatgtagatttaataatatttgctctatgtctctggatgtgcttgtgttggttgcatgcatatttggaattgttatactttgttgctgaattgatccctttattaccatataatgaccttctttgtcctttttacagtttttgacttaaagtctgttttatctgatgtaagtttagctactcctgattatttttgatttctgtttgtgtggtatatctttttccatcccttcactttcagtctgtgtgtgtctttacaagtgaagtgagtttcttgtagacgttgttgggtcattttttatccattaagcctgtctctatcttttaggtaggtaatttaacccatattcgaagttattattgataggtgaggacttattcctgtcattttgttcattgttttctggttattttgtatatccttttgatatggtttggctgtgtccccactcagatctcatcttgaattcccatgtgttgtgggagggatccagtgggaagtagttgaatcatggaggcaggtatttcccatgctattcttttaatagtgaataagtctcatgagatctgatggttttaaaaggaggagtttccctgctcaagctctctctttgcctgctgccatccctgtaagatgtgacttgcctctccttgacttccgcaatgattttgaagcctccccagcaatgtagaactgtaagtccattaaacctctttcttttgtaaatttcccagtcttgaatgtgtctttatcagctgtgtgaaaatggactaatacagtaaattagtaccagaagtggggtgttgctaaaagatacctgaatatgtggaagtgactttggaactgggaaacaggcagaggctggaacagtttggagggctcagaaggagacaggaaaatgtgggaaaatttggaagagatttcctagagacttgcccaaaatgctgatggttatatggacaataaagtctaggcttaggttgtctcagatggaaatgaggaacttgttaggaactggcacaatggtgactcctgttatgttttagcaaagagactggtggctttttgcccctgctgtagagatttgtggaattttgaacttgagagatttagggtatctgatagggtatttgaacttgagatttagggtatctgatagaagaaatttctaagcagcaaagcattcaagagatgacttgggtgctgttaaaggccttcagttttataagggaagcagagcatgaaagtttggaaaatctgcagcctgacaatgcaatagaaaagaaaatcccattttctcaagaaaaattcgatctggctgcagaagtttctttaagtaactagagtcaaatgtgaatccccaagacaatggggaaaatgtctccagggcatgtcacaggtcttcatggcagcccctcccatcaaaggtccagaggcctaggaagaaaagatggttttgtggcctggacccagggacccatgttgtgagcagcctagggtgcctgagtcctagccactccagctgcagctaaaaggagccaaggtacaacgtgggctatggcttcagagggtgcaagccccaagccttagcagcttccacatagtgttgagcctgtgggtgcacagaagtcaaaaattgaggtttgggaactgctgcctagatttcagaaggtgtatggaaatgcctagatatccaggcaggagtttgctgcaggggcagggcactcatggagaacctctactagggcagtgcagaagggaaatgtggggtcggagcccccacatagagtccctactgcagcgccacctagtggagctgtgagaagagggccaccatcctccagacctcggaatggtggattcactgacagcttgcactgtgtgcctggaaaagctgcagacactcaatgccaacccgtgaaaggagccaggagggggtttaaacccacaggagtggagctgtggccttttttctcccaaggccatgggagcccacctcttacatcagcatgacctgcatgtgagacatggaatcaaaggagatcattttggagctttgagatttgactgccccactggattttgggcttgcatgggtcctgtagcccctttgttttgacaattttctgccatttggaatgactgtgtttacccaatgcctatacccccattgtatctaggaagtaactaacttgtttttgattttacatgctcataggcagaagggatttgccttgtctcacatgagactttggactgtggacttttgagttaatgctgaacttagttaagactttgggggactgttgggaaggcatgattggttttgaaatgtgaggatatgagatttgggaagggccaggggcagaatgatacagtttggttgtgtccccacccaagtctcatcttgaattcccacatgttgtgggagggacctggtgggaagtaattgagtcatgggggcaggtctttcccatgctgttctcatgatagtgaatacgtctcacaaggtgtgatggttttgaaaagggtagtttctctgcagaagctctatctttgattgctgccatccatgtgagacatgacttgcttcttcttgccttccaacgtgattcttaggcttcctcagctatgtggaagtgtaagtccattaaacctctttcttttgtaaattgcccagtctcagtcaggtatgtctttatcagcagtgtgaaaacagactaatacacctttgttccttttttctctcattatttatggttgcagtttggtgggtttctttagtggtgatgtttgaatcctttcttctttgtgtgtctgaactactagtgagttttatactttcatgtattttcatgatggtagatattgttcttttgcttcccaatgtaggactcccttaaacatttcttgtaggaccacaacaaacaagacacaaacaaacagtcttttgcttatctgggaaatacttttttctcttttattattactattttttttttagcaatggagtctcactctgccacccaggctggagtacagtggcatgatcatagctcactgcagccttgaactcctgggatcaaatggtcctcctgcctcagccttttgagtctctggaattgcagatgtgagccactgtgccaggcttcttcatttgtgaaggatagctttgctggatatagtatttttggcttacatttttttatttttattttacttgtagtatacatccccttttctcctagcctgtaaggtttctgctgagaaatcccctgttagcctgatggagattctcttataagtgacttgatgcctttctcttgctgtttttagcattttctctttgtcttttgacaattttacaataatgtgccttggagaagacctttttgagttgtatttatttggtaatctttgagcttcctgcatttggaagcattcaggaagttttcagttattattttattaaataggttttctatgcctttacccatctcatctccatccagaactcccagaatttcagtttttggtgacatatgtgtcccatatgtcatgtagccttgcttcattcttttttctttctttttgtctgactggattattttaaaagactagtcttcaggttcagaaattctttgttttgcttgatctagtctattgttaaagctgtcaattatcttttgtatttatttcaatgatttattctcttccaggatttgtgtttggttctttgttatgctgtctatctctgttgaatttgtcgttcagatactgaattgttttcctgtttggttttttttttttttttttttttttgtattcattatctgtgttctcttgtatctccctgagtttctttaataacattattctgaatttttttcaggcatttcatagattttcttttcattggatctgttgctggagaattattgtgcttctttggagatgttatgtttcctttttcatatttcttgcatccttatgtgactatctgtgcctctgacataacagtcatttcttccaattttatggattggcttttatatgggaaagaccttttcttatagctntatctacagtgttcattggatatcacactttggctttgattctgggtgggtacagtggtatagtctgcatatgattccttcagctgtaattggcatgagtggtgcctgtgagtcattcagtggcttagactgcagtgtttttttttgtggttgttgagatggagtctagctctgtcaccaggctggagtgcagtggcacaatctcagctcaccgcaacctctgcctcccgggttcaagcaattctcctgcctcagcctcctgagtagctgggactataggcacgtacaaccatgcgcagctaatttttgtatttttagtagagatggggtttcactatgttggccaggctgctctcgaactcctgacctcgtgatctacccgcctcggcctctcaaagtgctgggattacaggcgtgagccaccacacttggccagactgtagttgttattggaggctgtggtgaggctttgctgaggatggggatgccaggaagtcttgtccttcagcatcagtggtagcggtggtggaccaggtgtgtcaatactagggactgtgggcagtgtttgtgggcactgatgatagcctgtctgcgtgggccaatccctgggcctccaggtggctcctttggttgctggcagtggcagcactgggccaagtgggcaggtgcaccactgggctcctgggtggtgtgcgtggcaggctgatctctagttctccaggtgacatatgcaggttctggtggtgggtaggcaggcatttcctcaggcctctcagtagtaagtgtgagcactagctctggaggcagatgagtcaatctccaggcccccagatggtacattcaggcaccagcatattcctatgcatttctagataaaagtatttttcagaaaacctgagtgtatgtcctattaatacaactaaccctcatcagctctgcatgagaagaagggggaattccctcagtagaacagtcagaatggaatcacagacttgtttttagccagtcactggtaaggggggttaggctaaaatgataagctcagaatctaaaccttagactagggaatggcaaactttttccataaagatgcaaacggtaatattttaggcttttggtctagataacctctgtcgtagtgacacagtggtgccatcgtagcctaaaagcttatgtagacaatggataaatcaatggacctggttttattccagtaaaacttaatttatacagtcagagggccagatttggcccttggtctatagttggccaaccctgtttagagcagtcaaaatttattccctggggctgggccaactttttcttaaaaaaaaaagtcgacgcggccgcgaattagtagtagtagtaggcggccgc

SEQ ID NO: 252931 - DNA, 1340 bp, Homo sapiens
gtctcagtcaatgtaggcagagtacaagaccctacagcctgctctctcacctgccatcgtacagaccagcttttaggggagccaagttgggatactcaatcccaacttttttccttctcttccatctcacatacaggaaaccttacgagagaggattaggggcctgaaaaagctgacaagacggcaaatatgggaagtggagccagtgctgaggacaaagaactggccaagaggtccaaggagctagaaaagaagctgcaggaggatgctgataaggaagccaagactgtcaagctgctactgctgggtgctggggagtcaggaaagagcaccatcgtcaaacagatgaagatcattcaccaggatggctattcaccagaagaatgcctggagttcaaggctatcatctatggaaatgtgctgcagtccatcctggctatcatccgggccatgaccacactgggcatcgattatgctgaaccaagctgtgcggatgacgggcgacagctcaacaacctggctgactccattgaggagggaaccatgcctcctgagctcgtggaggtcattaggaggttgtggaaggatggtggggtgcaagcctgcttcgagagagctgcagaataccagcttaatgactccgcatcttactacctgaaccaattagaacgaattacagaccctgagtacctccctagtgagcaagatgtgctccgatccagagtcaaaaccacgggcatcattgaaaccaagttttccgtcaaagacttgaatttcaggatgtttgatgtgggagggcagagatccgagagaaagaagtggatccactgcttcgagggagtcacctgcatcattttctgtgcagccctcagtgcctatgatatggtgctggtggaagatgacgaagtgaatcgtatgcatgagtctttgcatctgttcaacagcatatgtaaccacaaattctttgcggctacttccattgtcctctttctcaacaagaaggacctctttgaggaaaaaatcaagaaagtccatctcagcatttgttttccagagtatgatggtaacaactcctatgatgatgcggggaattacataaagagccagttccttgacctcaatatgcgaaaagatgtcaaagaaatctacagtcacatgacctgtgctacagatacacagaatgtcaaatttgtgtttgatgcagttacagatattatcatcaaagaaaacctcaaggactgcggcctcttctaatcctcaccattcctcaggtataagttctataaacaggcttggaatctgggtaattaaaaacagaaaattatagtcaatataccatg

SEQ ID NO: 252932 - DNA, 1141 bp, Homo sapiens
gtctcagtcaatgtaggcagagtacaagaccctacagcctgctctctcacctgccatcgtacagaccagcttttaggggagccaagttgggatactcaatcccaacttttttccttctcttccatctcacatacaggaaaccttacgagagaggattaggggcctgaaaaagctgacaagacggcaaatatgggaagtggagccagtgctgaggacaaagaactggccaagaggtccaaggagctagaaaagaagctgcaggaggatgctgataaggaagccaagactgtcaagctgctactgctgggtgctggggagtcaggaaagagcaccatcgtcaaacagatgaagatcattcaccaggatggctattcaccagaagaatgcctggagttcaaggctatcatctatggaaatgtgctgcagtccatcctggctatcatccgggccatgaccacactgggcatcgattatgctgaaccaagctgtgcggatgacgggcgacagctcaacaacctggctgactccattgaggagggaaccatgcctcctgagctcgtggaggtcattaggaggttgtggaaggatggtggggtgcaagcctgcttctaatcctcaccattcctcaggtataagttctataaacaggcttggaatctgggtaattaaaaacagaaaattatagtcaatataccatgacatgaagaatgaatccattctttggagatggagtatacatgactgcaactgtatttcatacgttcttttcaaagtgggatagctattgcagcttaaagagcacaggttccagtactggttttccaacttaatacaaaactgtgaatactttatttctgagtcttgagtctttcaactataaaatgaagatgacttccctacctactttacagggttattctgaggagcacgaacataactgaagggaaggcacataaaaactgcttgtgcaggccaggcacagtggctcacgcttgtaatcccagcactttgggaggccaaggtgggcagatcacgagatcaggaatttgagaccagcctggccaacacagtgaaaccctgtctctaccaaaaatacaaaaattagctgggcatggtggcaggcgcctgtaatcccagctgc

SEQ ID NO: 252933 - DNA, 1807 bp, Homo sapiens
gtctcagtcaatgtaggcagagtacaagaccctacagcctgctctctcacctgccatcgtacagaccagcttttaggggagccaagttgggatactcaatcccaacttttttccttctcttccatctcacatacaggaaaccttacgagagaggattaggggcctgaaaaagctgacaagacggcaaatatgggaagtggagccagtgctgaggacaaagaactggccaagaggtccaaggagctagaaaagaagctgcaggaggatgctgataaggaagccaagactgtcaagctgctactgctgggtgctggggagtcaggaaagagcaccatcgtcaaacagatgaagatcattcaccaggatggctattcaccagaagaatgcctggagttcaaggctatcatctatggaaatgtgctgcagtccatcctggctatcatccgggccatgaccacactgggcatcgattatgctgaaccaagctgtgcggatgacgggcgacagctcaacaacctggctgactccattgaggagggaaccatgcctcctgagctcgtggaggtcattaggaggttgtggaaggatggtggggtgcaagcctgcttcgagagagctgcagaataccagcttaatgactccgcatcttactacctgaaccaattagaacgaattacagaccctgagtacctccctagtgagcaagatgtgctccgatccagagtcaaaaccacgggcatcattgaaaccaagttttccgtcaaagacttgaatttcaggatgtttgatgtgggagggcagagatccgagagaaagaagtggatccactgcttcgagggagtcacctgcatcattttctgtgcagccctcagtgcctatgatatggtgctggtggaagatgacgaagtgaatcgtatgcatgagtctttgcatctgttcaacagcatatgtaaccacaaattctttgcggctacttccattgtcctctttctcaacaagaaggacctctttgaggaaaaaatcaagaaagtccatctcagcatttgttttccagagtatgatggtaacaactcctatgatgatgcggggaattacataaagagccagttccttgacctcaatatgcgaaaagatgtcaaagaaatctacagtcacatgacctgtgctacagatacacagaatgtcaaatttgtgtttgatgcagttacagatattatcatcaaagaaaacctcaaggactgcggcctcttctaatcctcaccattcctcaggtataagttctataaacaggcttggaatctgggtaattaaaaacagaaaattatagtcaatataccatgacatgaagaatgaatccattctttggagatggagtatacatgactgcaactgtatttcatacgttcttttcaaagtgggatagctattgcagcttaaagagcacaggccagtagttagaagaccccccaggttccagtactggttttccaacttaatacaaaactgtgaatactttatttctgagtcttgagtctttcaactataaaatgaagatgacttccctacctactttacagggttattctgaggagcacgaacataactgaagggaaggcacataaaaactgcttgtgcaggccaggcacagtggctcacgcttgtaatcccagcactttgggaggccaaggtgggcagatcacgagatcaggaatttgagaccagcctggccaacacagtgaaaccctgtctctaccaaaaatacaaaaattagctgggcatggtggcaggcgcctgtaatcccagctgc

SEQ ID NO: 252934 - DNA, 1783 bp, Homo sapiens
gtctcagtcaatgtaggcagagtacaagaccctacagcctgctctctcacctgccatcgtacagaccagcttttaggggagccaagttgggatactcaatcccaacttttttccttctcttccatctcacatacaggaaaccttacgagagaggattaggggcctgaaaaagctgacaagacggcaaatatgggaagtggagccagtgctgaggacaaagaactggccaagaggtccaaggagctagaaaagaagctgcaggaggatgctgataaggaagccaagactgtcaagctgctactgctgggtgctggggagtcaggaaagagcaccatcgtcaaacagatgaagatcattcaccaggatggctattcaccagaagaatgcctggagttcaaggctatcatctatggaaatgtgctgcagtccatcctggctatcatccgggccatgaccacactgggcatcgattatgctgaaccaagctgtgcggatgacgggcgacagctcaacaacctggctgactccattgaggagggaaccatgcctcctgagctcgtggaggtcattaggaggttgtggaaggatggtggggtgcaagcctgcttcgagagagctgcagaataccagcttaatgactccgcatcttactacctgaaccaattagaacgaattacagaccctgagtacctccctagtgagcaagatgtgctccgatccagagtcaaaaccacgggcatcattgaaaccaagttttccgtcaaagacttgaatttcaggatgtttgatgtgggagggcagagatccgagagaaagaagtggatccactgcttcgagggagtcacctgcatcattttctgtgcagccctcagtgcctatgatatggtgctggtggaagatgacgaagtgaatcgtatgcatgagtctttgcatctgttcaacagcatatgtaaccacaaattctttgcggctacttccattgtcctctttctcaacaagaaggacctctttgaggaaaaaatcaagaaagtccatctcagcatttgttttccagagtatgatggtaacaactcctatgatgatgcggggaattacataaagagccagttccttgacctcaatatgcgaaaagatgtcaaagaaatctacagtcacatgacctgtgctacagatacacagaatgtcaaatttgtgtttgatgcagttacagatattatcatcaaagaaaacctcaaggactgcggcctcttctaatcctcaccattcctcaggtataagttctataaacaggcttggaatctgggtaattaaaaacagaaaattatagtcaatataccatgacatgaagaatgaatccattctttggagatggagtatacatgactgcaactgtatttcatacgttcttttcaaagtgggatagctattgcagcttaaagagcacaggttccagtactggttttccaacttaatacaaaactgtgaatactttatttctgagtcttgagtctttcaactataaaatgaagatgacttccctacctactttacagggttattctgaggagcacgaacataactgaagggaaggcacataaaaactgcttgtgcaggccaggcacagtggctcacgcttgtaatcccagcactttgggaggccaaggtgggcagatcacgagatcaggaatttgagaccagcctggccaacacagtgaaaccctgtctctaccaaaaatacaaaaattagctgggcatggtggcaggcgcctgtaatcccagctgc

SEQ ID NO: 252935 - DNA, 2785 bp, Homo sapiens
cgccaccaatgtggcccaggccaccagcccccgtgacactgcagccatcccctttgctccccgtcgtggcctcccgaccgagcagccagagtgaccccgaaagcctaaatcagcctgcggcgccctcacccgtcctccagctgccatcgcctcctgggtgaagaggacgcaggtcgcagcccccgcagctctgcccctctgccctccggccaggccgccccgctgtcccccttgctgtccacctctctgtccacccctgctgtccccccccgctgtcccccccgctgtcacacccccgctgtcccccccccgctgtcccccctgttgtccccccgctgtccctcccgctgtccctccggcgaggaggcttctgcacgttctgcgtgggcctctccccggggccgccccaggtctcccctgacgcccacacccaccaccaggctgttgtgcgggaccttccttctctgcctctccagctggtgacgcgcactgacgtcctgcaaggcccgctccaggtgcgccacctttgactggcatgctgaaaggacaaagggacggaggcattttaccggagaggacatccatggggcccagcaggtcaaattcctttctctaagtatgggagacatttttaaaaataatggagtcctccagggccggctgcgtgctgtggcctgtgctcctcaccgctttggacccaggctgcgctgtctccaccacgaccaaggactcacagagctcgcctgggggacctggccccacagtcaccccgtccgtcatcagcctcaaatgccatcagcccgtgaatgctgctccatcgtctgcatggcagccaaggaggtctctgctcctaaagcacctgggagcccttggatggtgccaggtgatgtggcgatgagtgggcatcgcgtgggggccttggacgagcgtggacaccccaatccccagactggccattgccgtggaggcagcgtgagtgtgacatggagctcggtgtcgtgctgcagaggacgcctcgcggctgtacgcgtcatgatagccagggacccctccacatgtcacttagccaaaggatgcagcccggcctggggctttctaccccaggcccgaggacctgcagggacaaggacccctcagcgcagatgcagctctcatgaggcctgaaaccaagctggacttgcagaactgcgcacgctccctttctgaaagaaacacccgttaccgggtccagactgaatgtgggcgtaagaaagcgggaagggtcccccacagcaagagagagagcctcccagtcacttggtcatctgagccttgagtgtgtccggccccagccaccagcctgtccccactatccctcttgtcagcacggctgaaaggagctgcctgggcacctgaggtggctgaggctcatctttgaggagcatggaactcgaggggagaagtcgcgcccccagggaagccaggaaactctgacacagaacgcccaacgtggacacaggtgccagttcagcagtgaccgtcaagaccggggaagtgccctgtggtgaccaggagaacaaggagctcctccagcaagcagggctgcagtgggagctgggagggagcagtgcacctgccagcgtggccgagtcacacagtgcctgccctcacctgtggaatttggtgtcagctaaaaggaagaagaaatggaaacttaaattctagccggtcattttcttaaaactgcaaacatttctctcgagtgtggactggcccggcttcggtgaaaggcgccctcctacctagcagggtctcggcactctgctgtgttctttgcaccgcggtcactatttcagaaacacggtcctgatactcatcctgataatctcttaagagcacccgagaagaagaatgaaacgcctgtatatcctggttaagtttctataaaataagaacatacacgattcataaaattatatgattaatgatcacagtataattacataagaatttgttatatatgtttctatagaataataacatacccacacaattaatataagggatatgttgttaactggaagggtgtaaagcagttcttcggcccgggcctgtcgatgcccgccaggactgttttcatgctgcctgtgcctcggctcacttacagaagttctgactcaatacatctgggatttctactttcaaagcagtacatgtgattttatgcccttaaagtatttaagaaacagaaagtcaagtgtttcaccaatttccgtaggaagggccgctcactgcacggtggggcgatgctgggcgcgagccgtgtttccgtctattgttgacttcctcacgatgctggctcaggctcagagcctctcatcaccgcctgtgaaatggggaccaccctcctaatctactatccagacctaccttctggaagctcaattatcacgagcacatggtggaaaacgtgggccggtgacaacttaacatgtaaatgtacataataaaattccaggcacaatacatatgaacgcttttagagaactttgggagcaaagcaactgatgtcctgcgtggaaagtcctcttctccccatgaaattatctcaaggatcttccatgggaagatgtgacagaaccaggacactactgcttaatatttaatatcagatactcttaaatcacaagagcataactaaagtattcttcgtttctttagtcaaatctccttttctataaaatggagacggctttcatatgtttgggaaacattttaataacgaattaataaacattttaatatc

SEQ ID NO: 252936 - DNA, 441 bp, Homo sapiens
cagggcataggaggcccttcatgaccagcctcaccagcacctctagctacatctcctactgctctcacctccacatttacccttcggcatgccaacctgcttatggttacggacacagcttgctgttttggcttctgtgcctccccttgtttgcttcctgctgctgaatcatgctggaacatcttgtccattagctgtcaagtcacctgtccaaattcagctctgttggccctttctctcctggacatcgcctccttgataaaccaacagttttagcaatgtgtttatttacgtgtgtttctccctttggccagtgttctctagaaggacaagagctcttaatgatgtttgcctagcacagtagctggcggtgtgtgggtgtctaatacatgttaaacgtttaataaatgcttaatttattgatgcattgattaataagtg

SEQ ID NO: 252937 - DNA, 349 bp, Homo sapiens
  misc_feature (84)..(84): n is a, c, g, or t
  misc_feature (105)..(105): n is a, c, g, or t
  misc_feature (179)..(179): n is a, c, g, or t
acttatagctctgcaatactgcacttatttagatggtaaggcacctgacagtctccatgctaagtaactctcctcatgcatttnaacatcgccatcattctcctnttactcctccaagccctcttccatcggggaatagagctggtgcagcgctttcagttcattgtactcctgggggngaataatgctcttcaactgatctggtgtctcagtcaaacttagatccctctgaaagtcagatcctttcagcgtagcatccctgagtgccgtgttggcaggaagcgagactcgtaccttaggctgaatggatttcttctaaccaatcccagatatcagagtagtgcaaagt

SEQ ID NO: 252938 - DNA, 575 bp, Homo sapiens
ccaccattgagaacgccaggattgtcctgcagatcaacaatgctcaactggctgcagatgacttctgaaccaagtttggtttgagtgtttgggtgctggatgaggtgaccctggccaggactgatctggaggcacagatcaaaggcctgaaggaagagctggcctacctgaagaagaagcatgaggaggaaatcaatgccctgaggggccaagtgggagaccaggtccatgtgagggtggattcagctcggacctgccaagatcctgagtgacaggcaaagccaatatgagatcatggccaagcagaactggaaggatgctgaagcctggttcaccagctggactgaggaactgaaccaggaggtcactggccacatagagcagctccagataagcaggtccgaggtcactgacctgcagtgcaccctccagggtcttgagattgagctgcactcgcagctcagcgtgaaagctcccttagaaggcacactggcagaaacagaggcatgctttggagcccagctggtgcagatccaggcactgatcagcagtattgaagcccagctgggcgatgt

SEQ ID NO: 252939 - DNA, 506 bp, Homo sapiens
ttttttaagttcagtgtttacatggttgctgtaaacctttgactattttctagcatactgaaaaatttgattctgatcgttttctcttgattttttgatgttactgtggaagaactggcccttggtctacctactccatttcctgctgatatcactcccaaaagggggaaattagtttgaatatgttgagtttgaggtactatgagaaggcccagtgaatatatctcacaggtaattaggtataagagcttgaatctttctttctaagagaggagatttgagctacacatatgaactgagatgtcacctgcttatcatggaaaatgcaagggtgtttaagatcatcagggagagttccagggcataccaccatagatgagttcacagtagaggcagaaaaccaatgggcacaaagtacaaggaaaaccaggagcctgtggtacagtgaaaggtgttcttatcataagttattttagtagaatggtgacatttgaatgaaaagaaaa

SEQ ID NO: 252940 - DNA, 622 bp, Homo sapiens
caagccaaatttcaactgctgtgttttcaataagtgttcagcgactgttctaagcagtcaaaaattgatctgagagttgatagagtaacttgcactttcatagatgatggaagagtgtagtagatggaaccatctgtacatagaagtattctagtgacctggcattaatgtgcctggtctgctgttgcgagctgtgccttccctgacacttgggttatcaatagtctgcctattgttgactcaaaacaggggaggtcagaggcccagagccagcaggaagaagaggaaaagaaatccagaatttccggttagaatgaaaatcataaaaagtaaggccgggcgcagtgactcacgcctgtaatcccagcactttgggaggccgaggcaggcagattatgaggtcaggagttcgagaccagcctgaccagcatggtgaaacccctgtctctactaaaaatacaaaaaattagccgggcgtggtggcgtgtgcctgtagtcccagctactcgggaggctgaggcaggagaattgcttgaacccagcaggcggaggttgcagtaagccgagatcgcaccactgcactccagcctgggtgacagagtgagactctgtctcaaaaaaa

SEQ ID NO: 252941 - DNA, 314 bp, Homo sapiens
tattcctgacttagcaagcagacctagaagtgggatggagaagggcttttgaatctccctccaaaggtccagagaaatctccttggaaatttgattgattattgattattgtaacaagagtttctcctcccccaggaagctccccagagtggtcttcttctaatagaggcggaactgtgtgatgggtggtcggaggttccggctgctgtgccagaccgcttgggttcaaatcttatctttaacagttacctaatattcgctgtgcttcagttgcctcatccataaagtagaaattacaatgatatctatcacat

SEQ ID NO: 252942 - DNA, 434 bp, Homo sapiens
gactgtgaaattaaaaactctgaaactcctgttaggcactgtcaagaactcatttgtattctaaaatttaaatctgacctttattgagtgctttctctgttgagacatcatggtaggtgcttttgaaacccaccttatttagaaaagtaatacaaatgtttctacttttgagtagataagtctaagttttaaataaatttaccagtcaatcttgtttctcagttatatggtaatttttttcataccacaaacctttcatttattattaagttcagttaccattctagctgtcaggtgaatcacaaatctagatattagagaaaatatttaccctaagaaagcttgattcactcagtatcaatttggatgttctgaatcttggtcatgtggaaatttaattctaggacatcttgatttgaatcaggtaaaccagc

SEQ ID NO: 252943 - DNA, 123 bp, Homo sapiens
tctttacttttcttttatctgaagtgtctttactttgctttcattcttgagggatatttcaccggatataagattcttagttgacaggtttttttcctttcaacaccttggatgtgttttttt

SEQ ID NO: 252944 - DNA, 885 bp, Homo sapiens
gcgcctgtgtctgttcttgcagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagaaccagaagtcctgacacctgatttcccatcactagcaattttcctgattcacccacccaggagacaagatttgaatgagcagtaaaaatggccaaagatgagatgaccaaaaaaacagtgataggtctcaaacacagccagagatcaatcaggtgctgctttgattctactagtggttcttaaataaaagtattatattttctacgtcagtggagcatacatacattgtcattggtcttctatgctaatatgtgaagtgaattctacctttgaccttagaatgtatatagatatgatcaagtctttttagtcaactgtcatttgataaaaacaattaagatttagttaattgttgaattaaatggacttaagatattagataagtgggtaattcagagagtaatttttacattttatttagaaatgtaccagatattcctggagagccctacatttaaatattattctctttcattgtaccagcaattatattaatatatgtcaaaccatttgaccagatttctagtacaaaaatacaatcatgctattttgaaatgaaaagggggctggatttggagccagggtccaggttgtagctctgccgcttgtgacttggtcaagtcagatacctctctgagcctcagtttccacacttctaaatgaaaaataaatcccagtgggtgatgctgcctg

SEQ ID NO: 252945 - DNA, 939 bp, Homo sapiens
gcgcctgtgtctgttcttgcagaatgaagtacctctggacgtcacacatgtgtgtgttcgcatcattcggcctatgtagccctgaaatatgggagttacttctgaagtcagtccatctttataacccaaagaggatatgtataatgcgatattcagtaccgatattaatactgctgtatctatgctataagaaccagaagtcctgacacctgatttcccatcactagcaattttcctgattcacccacccaggagacaagatttgaatgagcagtaaaaatggccaaagatgagatgaccaaaaaaacagtgataggtctcaaacacagccagagatcaatcaggtgctgctttgattctactagtggttcttaaataaaagtattatattttctacgtcagtggagcatacatacattgtcattggtcttctatgctaatatgtgaagtgaattctacctttgaccttagaatgtatatagatatgatcaagtctttttagtcaactgtcatttgataaaaacaattaagatttagttaattgttgaattaaatggacttaagatattagataagtgggtaattcagagagtaatttttacattttatttagaaaaccttaagtactcaagttgaccaggaggcaccaagtggtataaatacagccagatgtaccagatattcctggagagccctacatttaaatattattctctttcattgtaccagcaattatattaatatatgtcaaaccatttgaccagatttctagtacaaaaatacaatcatgctattttgaaatgaaaagggggctggatttggagccagggtccaggttgtagctctgccgcttgtgacttggtcaagtcagatacctctctgagcctcagtttccacacttctaaatgaaaaataaatcccagtgggtgatgctgcctg

SEQ ID NO: 252946 - DNA, 412 bp, Homo sapiens
  misc_feature (412)..(412): n is a, c, g, or t
gattgtttctcttaggaaaaaaaaaaatcataatctataacagaagtggtcctagcttggaagatacctggagggacatgtgtttgtgagtaaagacatgttatatccacatcccagagtcactaatcatttctttaacctgtggagtgcaccttaagtataccctgaaaagtctagtactccatggaaattcatagtatcatcttctttccccctcttttttaaaaaaaaaaaaaagaaactcgagttttttttttttttttttgtagagacggagttttgccatgttgcccaagctggtctcgaacccctgggctcaagcagtcctcccacccctgcctcccatagtgttgtgattatagtgagcccactgcacccagcccaaactatagaatattttgcaccgtttttn

SEQ ID NO: 252947 - DNA, 454 bp, Homo sapiens
tatatttgtagacctgtccatgccccacttacctcctccacgtacagtgaatcactagggtagacatgagtgtctccttttcattgtaggattgtctcctttttgtttctgtttttattcaacatttgataaagtctatgcactaagtatggagtgttctggcatttttttaatgcacaaagcccaggatgcatcacttaacaatggggatgcattctgagaaatgcattattaggtgagtgcatcactgtgcagatctcatagggtgtactcacaaacctacatggcagagctgactacacactgaggctatatggtacagtctgttgcccgcaggctacaaacccatacagcatatagagtagtactgaatactgaaggtaactgtaacacaatggtaagtatttgtgtacctagcttttctttaggatgggatttaaaaaaaaaaagccaa

SEQ ID NO: 252948 - DNA, 255 bp, Homo sapiens
ttataatatgtgtaaaagtgaaagatgggacaacagtatcccaaaatattaggaggtagaattgtaaggttcttacgttcgtgaagtagaaaatatgaactgttggctgggcatggtgactcatgcctgtgatcccagtgctttgggaagctgagactggaggatcacttgagcccaggattttgagtttacactgagttctgtttgtgccactgcacactagcatggttgacagagtaaaacctggtctctaac

SEQ ID NO: 252949 - DNA, 392 bp, Homo sapiens
cattgaaggcagcagggggatcatggtttctacatgttgtcctgcaaaggggcacaggagaatgggcagtaggtggcagggaagtggaggatcaagagatggtgtttaagatggtgagatggggccaggtgtggtggctcacgcctgtaatcccagcactttgggaggccatggcgggaggatcatgaggtcaggagatcaagaccatcctggctaacatggtgaaaccccatctctactaaaaattcaaaaaattagcagggagtggtggcgggcacctgtagtcccagctacttgggaggctgaggcaggagaatggcgtgaacccaggaggcggaggttgtagtgagccaagatcgtgccactgcactccagcctgggcgacagagtga

SEQ ID NO: 252950 - DNA, 2304 bp, Homo sapiens
agagtgggcgggatagagagcgtgggcgggggggctagcctcgtgcgggctccttaagtagcggctgcgtggcttccctggcacgctagtcttacgacgtcacggtcaggtggtgcagagctggacggcaacgacgtcggacgcgccccttcttggaacaatgtcccaccacggaggagctcccaaggcctctacgtgggtcgttgctagtcggcgaagctcgacagtgtcccgagcgccagagaggaggccggcggaggagttgaatcgaacaggtcctgagggatatagtgtcggcagaggtggtcgctggagaggcacctctaggcccccggaggccgtggccgctggtcacgaggaactgccgctgtgttttgctttgaagagccactttgttggcgcggtaatcggtcgtggtgggtcaaaaataaagaatatacaaagtacaacaaacaccacaatccaaataatacaagaacaaccagaatcattagtcaaaatttttggcagcaaggcaatgcaaacgaaagcaaaagcagtgatagacaattttgttaaaaagctagaagaaaattacaattcagaatgcggaattgatactgcattccaaccttctgttggaaaagatggaagcacagataacaatgttgttgcaggagatcggccattgatagattgggatcaaattagagaggaaggtttgaaatggcaaaaaacaaagtgggcagatttaccaccaattaagaaaaacttttataaagagtccactgccacaagtgccatgtcaaaagtagaagcagatagttggaggaaagaaaattttaatataacgtgggatgacttgaaggatggggagaaacgacctatccccaatcctacctgcacatttgatgacgcctttcaatgttatcctgaggttatggaaaacattaaaaaggcaggttttcaaaagccaacacctattcagtcacaggcatggcccattgtgttgcaaggaatagatcttataggagtagcccagactggaacaggaaagacattgtgttatttaatgcctggatttattcatctggtccttcaacccagccttaaaggtcaaaggaatagacccggcatgttagttctaactcccactcgggaattagcacttcaagtagaaggagaatgttgcaaatattcatataaagggcttcggagtgtttgtgtatatggtggtggaaatagagatgaacaaatagaagagcttaaaaaaggtgtagatatcataattgcaactcccggaagattgaatgatctgcaaatgagtaacttcgtcaatctgaagaatataacctacttggttttagatgaagcagacaagatgttggacatgggatttgaaccccagataatgaagattttgttagatgtgcgcccagataggcagacagttatgaccagtgctacatggcctcattcagttcatcgcctcgcacaatcttatttgaaagaaccaatgattgtctatgttggtacattggatctagttgctgtaagttcagtgaagcaaaatataattgtaaccaccgaggaagagaaatggagtcacatgcaaacttttctacagagtatgtcatccacagacaaagtcattgtcttcgtttctcgaaaagctgttgcggatcacttatcaagtgacctaatacttggaaatatatcagtagagtctctgcatggagatagagaacagagagatcgggagaaagcattagagaactttaaaacaggcaaagtgagaatactaattgcaactgatctagcctctagaggacttgatgtccatgacgttacacatgtctataattttgactttccacggaatattgaagaatacgtacaccgaatagggcgcacgggaagagcagggaggactggtgtttccattacaactttgactagaaatgattggagggttgcctctgaattgattaatattctggaaagagcaaatcagagtattccagaggagcttgtatcaatggctgagaggtttgaggcacatcaacggaaaagggaaatggaaagaaaaatggaaagacctcaaggaaggcccaagaagtttcattaatgtcttctgtactagtggggtagagaattcaagattttttagaaatatagtaagacagaagtattggacatgttggcagtatgaagagaccggactgatttgactgattcttaaaataatagtgtttgaaaatatagaatccagtgttttatactttctttaataaaaatagaagtatttaaacttggaagttgttt

SEQ ID NO: 252951 - DNA, 480 bp, Homo sapiens
gcaatgaaagccccgccaaggaagaaatatgtagagtggaggtggggaaagttgtagaagatggggtaaatgttccagcagggggaacatattcaggctcagaggtaagaaagaatatgtagaaaatgctaccatataaaggcacattaaaggcacttggaagcagctgaagcagcaaattttatagcctgtagatggatgtagggtttaatcgagatacctgtttctgtttaaaggatgtcatgtaaccagctgtgcgattatctgaaatgatttggatgcattttagtgttgtagaaaagaactcagaatcctaataacaacacgttgaataatttcagagtattccagaggagcttgtatcaatggctgagaggtttgaggcacatcaacggaaaagggaaatggaaagaaaaatggaaagacctcaaggaaggcccaagaagtttcattaatgtcttctgtactagtggggtagag

SEQ ID NO: 252952 - DNA, 336 bp, Homo sapiens
gtactttttgtgttaatgtttatcattccgtttcagtcacaggcatggcccattgtgttgcaaggaatagatcttataggagtagcccagactggaacaggaaagacattgtgttatttaatgcctggatttattcatctggtccttcaacccaggtaagaattcctatggctggtttcttcttatagaggtttaatagatttagatatcaaaaatgtaattaaagtttctttacctattgcttgatccaaaggtaatgcctagcttcagagaagatgcaaggaattaaacacttagattgtgctggtgaaagtataaactggcaaaacattttta

SEQ ID NO: 252953 - DNA, 2088 bp, Homo sapiens
  misc_feature (30)..(30): n is a, c, g, or t
  misc_feature (336)..(336): n is a, c, g, or t
  misc_feature (1363)..(1363): n is a, c, g, or t
tctctttgatacatacctaggaatggaatngcggggccatgtgtggtaactgtatatttaactttctgaagaaccgccaaactgttttccaaactctaccattttacattcccaccagcaatatccaggtgttgccatttctccacttcctcaccaacacttgttttccatttttgtttttgttcttattatggatatcctagggagtgtgcagtggtatggcattgtggttttgattgacatctccctaatgattagtgatgcagaacatctttttattttattctttattttgatttttaggtcattcatacgtctttagagaaatgttcagancatttgcccattttttaattgtgttactgtttttttgttgttgagttgtaagagttctttatatgttctggatattatacccttatcatgtaaatggtttgcaaatattttctcccattctcttgtcttttcacttttgtgattgtgtctgttgacacacagaagtttttcattttgaagttcactttatctatttttttctttggttgctaatgcttaagtgtcatatcaaataaatcattccctaatccaaaatcacaaagatttacacctatgttttcttgtaagaagtttatagtttagctcttaacgtacttagatctttgatccagtttgaagtaatttttatatatgtgaggtacatgtaaggtaggagtccaaattcattctttgatatgagatattatcccagcactatatatagaaaagattattctttccccattgaattgtcttgaattgtcttggcaactttgttagaaatcaattgaccatagatgtatgggtttatttctagattcttggttctattccactcacctaaatttctgtccttatgccagacttggttagttttgaatccattttttagttaaatattgacttattccctgcatttaaacttcataaatataaaaagcaatctgtgtagtgcagtacacaatgtaaaatgactgtttcattgctttgcaaattccatcttagaagttttatggttctgtaatgaataattgcttgtagaaatttattgaattaatcgtgtatcattgggaatttgccaaaggagactcagaaaatcttttgggaataaaatcatttaaattttctgaatgctgactcaaatactcaaaattgctgttggtatttaatgataacttttatttttcatcttttaagaaattctgagagaaaatcaggaatgaactatgaagtccttgtattcctagtccctaataggacattttaataatatacagtactaattgtttgttgttacagttaagaattttacttttgggtctaattnttttttctaactaagttttaaagagaagggaaacttaagcaagtacattcattctaaacttgtgtatataatctttaatcttagaagtgcatctgtattttgatttttaggtcagcgtacacaagtagagttagttgtccgtagtccctcaccttatctgcggttttgctttcgtatggttctgaggtcagaaaatattaaatggaaaattccagaaataagcacttcataagtttaaattgcacaccattctgagtattgtgatgaaattcatgccatccacttctgtcctatctggtctcacctgggacatgaatcattcctttgttcagtctatccacactatatacaccacctgccgttagtcactgtgtagccatctcggttatcagctcgactgctgtggtatcacagtgcttatgttcaagtaaccttattttacttaataatggccccaaaacacaagagttgtgatgctggcaattcaagaagctttaaagtgctccctttaagtgaaaaggtgaaagttcttgacttaagaaaggaaaaaaaaaaaaaaaaggtatgctgagattgctaagatctacagtaagaacaaatctcccagctgggcactctggtttaggcctgtaatcccagcactttgagaggccaaggcaggaggatcacttgaagataggggtttgagaccagcccggtctacatggtaagactctgtctccacc

SEQ ID NO: 252954 - DNA, 269 bp, Homo sapiens
tgcattgtagaggggtggagcatgtcagtctggatccctggccctctgctctcactatggcttatcccaagagcgggacggccatggaacatgggacggccacggaacatgggttcctgcccatcagagtgctgcaccgggagctgctctcaccttttcctgcctggagaccacagcatgagggtcaagttttttccttttcaggaaccaaagtgtctctttgtgtaccccatcctggtgagcaatagagctaagtggacatccatgcc

SEQ ID NO: 252955 - DNA, 277 bp, Homo sapiens
ccccaatgctgatttgcctgtggggtaatgttctgtgcctatctcatcggtgcacttagcacagtgtattataattttgtatgttctttctccctcgcagcagtccgagctccttgagagcaaggaccatgtaccttttcatctttacatatccattgcctacatatttgttgaacgaaagttcctagcacagcccctgtcccataacaggcctttaaatatcaagcactatttttttttcctccctttcccgcaacatgcagacatacacactttc

SEQ ID NO: 252956 - DNA, 359 bp, Homo sapiens
gagatggaatttcactcttgttgcccatgttggagtgcaatggcaccatcttggctcaccacaacctccgcctcccagctgaggcaggagaatggcgtgaacccaggaggtggagcttgcagtgagccaagatagcgccactgcactccagcctgggtgaaagagcgagactccgtctcaaaaaaaaaaaagaaatggcagagctgggttgggagcggtggctcatacttgtaatcacaacactttgagaggatggcttgagcccaggagtttgagaccagccgggaggtcaaggctgcagtgagccatgatcacgccactgcattccagcctgggtgacagagtgagaccctgtctca

SEQ ID NO: 252957 - DNA, 253 bp, Homo sapiens
tgcactctgctttctgtgctgtggcaatctcctgcctctgttagtaaaccaggtgcgatgggatccgtttttttggttgcagtggagaaggacctcagacttcaggctttccatgtcagaaaggggcttaggtggagcaggacattagctcactgtgtgagttttctcctgggactaccatcacaaagtatttaatcgcaggaactgggtggggttaaacaacagaaatgtattctctcagagcctgaggcta

SEQ ID NO: 252958 - DNA, 657 bp, Homo sapiens
gctaattgaaaagactaaagaattaagctcttctcatggaagaaaggaaagtaggacttaatgtcctgaccttgatttgagaactatattgttgtagaacatactgaaaggtacatgtttaatagcttgggaaaaatcttaaaaaaaaaaaaaaaacacagtttttgaacctggccatgtcactgagtctagtacatgacaaacctaggaagttggtagcagaacacagggtcaaaataaaatacaagaaatcactgtagcctgataatctgcaagacacaccaagcagacaagtggtaagacagtgggaagtgtgcacacatttaaagcaacaattctgaaatgtgtccatgtggtgaagtgtgcacctacctggaagccatgagcaccctgcagaacacctgaaacattgataagtgtaaatctgtaatagaaactgagaacatcagagctaaatgacaacttaggaacacaaaggaggagacagcagacactgggggagggtagcaagagagagaggagcagaaagataactgttgggtactgggcttaattgggtcctgggtgatgtaataatatgtatgacaaaccctcgtggcaggtgtttaactgtgtaacggaccttcacatgtacccccaaacctaaaataaaaattt

SEQ ID NO: 252959 - DNA, 491 bp, Homo sapiens
  misc_feature (351)..(351): n is a, c, g, or t
  misc_feature (361)..(361): n is a, c, g, or t
gctaattgaaaagactaaagaattaagctcttctcatggaagaaaggaaagtaggacttaatgtcctgaccttgatttgagaactatattgttgtagaacatactgaaaggtacatgtttaatagcttgggaaaaatcttaaaaaaaaaaaaaaaacacagtttttgaacctggccatgtcactgagtctagtacatgacaaacctaggaagttggtagcagaacacagggtcaaaataaaatacaagaaatcactgtagcctgataatctgcaagacacaccaagcagacaagtggtaagacagtgggaagtgtgcacacatttcagaactgttatctatagctaattgnaaagactaangaattaagctcttctcatggaagaaaggaaagtaggacttaatgtcctgaccttgatttgagaactatattgttgtagaacatactgaaaggtacatgtttaatagcttgggaaaaatcttaaaaaaaaa

SEQ ID NO: 252960 - DNA, 350 bp, Homo sapiens
gaaagaatgcttctgtaagagggcggcacaagggtggatgctcagagtgccatcaggccattttggacttctcaggcttctaaggaaacagagtcttcgtggaagttccttgggatgcagaggacagtctgtggggtatccccactggggtgctcatttgtgactgggtatgggatggccggatctgtgcgctggggacctccttagaagtgtgtgtgcgtgcacacatatatgtgagtatacacacacatgcacacacactggacaaaggaaggggaccagttagcaggcctctgctgtgggaggcttcctgactcaccctaatttccccctctttgaaaactgtcttc

SEQ ID NO: 252961 - DNA, 3443 bp, Homo sapiens
agcagagcgtgagcgggaggcggagccgggagagcggctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgcccatatagccggagccctttttctcatttgagaatctcttccctactaagtgttaagcttagagtgaagggcacctcctactggaccaaaggagaggggattggagaattgttttaagttttatacattaggtcagtattccatcttcccacccccagc

SEQ ID NO: 252962 - DNA, 3569 bp, Homo sapiens
ggttcaagcgattcttctgcctcagcctcccgagtagctgggactacaggtgcgcgccaccacgcctggcgaatttctgtatttttagtagagacggagtttcaccatgttggccaggctggtctcgaactcctgacctcgtgatccgccggcctcggcctcccaaagtgctgggattacaggcgtgagccacggtgcccggccaccttcgtcccttctacacagccggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgcccatatagccggagccctttttctcatttgagaatctcttccctactaagtgttaagcttagagtgaagggcacctcctactggaccaaaggagaggggattggagaattgttttaagttttatacattaggtcagtattccatcttcccacccccagc

SEQ ID NO: 252963 - DNA, 2271 bp, Homo sapiens
tggctttccgatcctcttcgggctctttcctccctctgttcactgtgagtttttttgtctctttctgtggctgcgtatggtgtttcatcctgagcctcttgttttcttctccttctacttctcctacgtacctcttgctttgcctcctcctcctggcctagtgttggcggtggtcttcgctgctcttttcttccccctctttgtttctccttcactgtcgactggttgtctcgtacttctagttatctctaccacctctcttcagcccagctcttcttgtcgccacctgctgttgtcggtgcggctctgtggcatggcccaccctcgtcattatgatttccttatttctgatccctcgttgtgtttttttttgtttttataatttttttttttttttttttttttttttggttttttctttgtcatattgtcaatagactgacgattttaattagcactaagaaacattagctttaggatagaacgttgaagggatatgaaatactaagtggggtaattttagatgtttcagccctatttgtgaataatggtaagactactagcagtgccctaggtaggcttgacaaattattaaggaactatccttttgttggttgcaggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgcccatatagccggagccctttttctcatttgagaatctcttccctactaagtgttaagcttagagtgaagggcacctcctactggaccaaaggagaggggattggagaattgttttaagttttatacattaggtcagtattccatcttcccacccccagc

SEQ ID NO: 252964 - DNA, 2367 bp, Homo sapiens
tggctttccgatcctcttcgggctctttcctccctctgttcactgtgagtttttttgtctctttctgtggctgcgtatggtgtttcatcctgagcctcttgttttcttctccttctacttctcctacgtacctcttgctttgcctcctcctcctggcctagtgttggcggtggtcttcgctgctcttttcttccccctctttgtttctccttcactgtcgactggttgtctcgtacttctagttatctctaccacctctcttcagcccagctcttcttgtcgccacctgctgttgtcggtgcggctctgtggcatggcccaccctcgtcattatgatttccttatttctgatccctcgttgtgtttttttttgtttttataatttttttttttttttttttttttttttggttttttctttgtcatattgtcaatagactgacgattttaattagcactaagaaacattagctttaggatagaacgttgaagggatatgaaatactaagtggggtaattttagatgtttcagccctatttgtgaataatggtaagactactagcagtgccctaggtaggcttgacaaattattaaggaactatccttttgttggttgcaggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacaggtactctctgtcctctagaaatacaggctcatacttcctgatcttttatgtgctctaaactgcgacgttttggctaattatttctcatgtttatagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgcccatatagccggagccctttttctcatttgagaatctcttccctactaagtgttaagcttagagtgaagggcacctcctactggaccaaaggagaggggattggagaattgttttaagttttatacattaggtcagtattccatcttcccacccccagc

SEQ ID NO: 252965 - DNA, 989 bp, Homo sapiens
cttcatatatattcttatttaatcctcccaacaatccatgatagatattcaggctgacatgatagataatcccaacaatccatgatagatattcatgatggcacacgcctgtaatcccagcactttgggaggctgaggtaggcagatctcttgaggtcaggagatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgcccatatagccggagccctttttctcatttgagaatctcttccctactaagtgttaagcttagagtgaagggcacctcctactggaccaaaggagaggggattggagaattgttttaagttttatacattaggtcagtattccatcttcccacccccagc

SEQ ID NO: 252966 - DNA, 1073 bp, Homo sapiens
agcagagcgtgagcgggaggcggagccgggagagcggctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggaatcccggtgggaatccgggatcctctagatcacctcggc

SEQ ID NO: 252967 - DNA, 396 bp, Homo sapiens
gatgacctcaaggaggcaatgaatactatgatgtgtagccgatgccaaggaaagcataggtatgaaatagaaggagagggatgggacaatcacagctcagggattatgtaaccaaggatctttctagtgagtactggtaattatgagttacatctgtatctcataattagtaaaaagacccttaagtttctacctttgtcatattgtcaatagactgacgattttaattagcactaagaaacattagctttaggatagaacgttgaagggatatgaaatactaagtggggtaattttagatgtttcagccctatttgtgaataatggtaagactactagcagtgccctaggtaggcttgacaaattattaaggaactatccttttgttggttgcag

SEQ ID NO: 252968 - DNA, 380 bp, Homo sapiens
tctttgctacatacttcatatatattcttatttaatcctcccaacaatccatgatagatattcaggctgacatgatagataatcccaacaatccatgatagatattcatgatggcacacgcctgtaatcccagcactttgggaggctgaggtaggcagatctcttgaggtcaggagttcgagaccagactggccaactagatgaaaccccgtctccactaaaaatacaaaattagctgagtgtggtggtgcatgcctgtaatcccacctactagagaggctgaggcaggagaattgctagaacctgggaggtggaggttacagtgagctgagatcgtgccactgcactctagcctgggtgacagagcgagacttcatctc

SEQ ID NO: 252969 - DNA, 3260 bp, Homo sapiens
agcagagcgtgagcgggaggcggagccgggagagcggctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggca

SEQ ID NO: 252970 - DNA, 2369 bp, Homo sapiens
agcagagcgtgagcgggaggcggagccgggagagcggctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgtcaacttggacaggcaggcttttggtggctgattgaactgctggtattggtgggagagtacgtagaaacttgtggccatctcatctatgcctgcaggcaactgaaaagcagtgatttggacctttttcgagtttggatgggagtgtggacagggcggttagggggctgggcccaggtcatgtttcagtttctaagccaggggttttactgtggagtaggactgtttactcgttttcttaagctgctgggtgctttgctgctcctggctctggccctctttttgggctttctacagttgggatggcggtttctggtgggactaggtgaccggttaggctggagggataaggctacctggctcttctcttggctggattctccagccttgcagcgttgcttgactctgctgagagatagcaggccatggcagcggctggtaagaatagttcagtggggctggctggagttgccttgggtcaagcagaatattaataggcaggggaatgcacctgtagctagtgggcgctactgccagcctgaagaggaagtggctcgactcttgaccatggctggggttcctgaggatgagctaaaccctttccatgtactgggggttgaggccacagcatcagatgttgaactgaagaaggcctatagacagctggcagtgatggttcatcctgacaaaaatcatcatccccgggctgaggaggccttcaaggttttgcgagcagcttgggacattgtcagcaatgctgaaaagcgaaaggagtatgagatgaaacgaatggcagagaatgagctgagccggtcagtaaatgagtttctgtccaagctgcaagatgacctcaaggaggcaatgaatactatgatgtgtagccgatgccaaggaaagcataggaggtttgaaatggaccgggaacctaagagtgccagatactgtgctgagtgtaataggctgcatcctgctgaggaaggagacttttgggcagagtcaagcatgttgggcctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtaagctagagttgattcctcctccccctacacctaggatttctgctcgtgccagctggagtgcactt

SEQ ID NO: 252971 - DNA, 1587 bp, Homo sapiens
tcctaggcgacgagacccagtggctagaagttcaccatgtctattctcaagatcacctactttgcactgatggatggaaaggtgtatgacatcacagagtgggctggatgccagcgtgtaggtatctccccagatacccacagagtcccctatcacatctcatttggttctcggattccaggcaccagagggcggcagagagccaccccagatgcccctcctgctgatcttcaggatttcttgagtcggatctttcaagtacccccagggcagatgcccaatgggaacttctttgcagctcctcagcctgcccctggagccgctgcagcctctaagcccaacagcacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgcccatatagccggagccctttttctcatttgagaatctcttccctactaagtgttaagcttagagtgaagggcacctcctactggaccaaaggagaggggattggagaattgttttaagttttatacattaggtcagtattccatcttcccacccccagc

SEQ ID NO: 252972 - DNA, 3670 bp, Homo sapiens
ggaagactacacattttaggtatgtgattagaaaacatacttgtcagaattgtctggctggattaatttgctaatttgaccttcttcatcatttgatgtgatgccagatactaatagcacaatcaatttatcactaagcactcgtgttactttagcattttttatgtccttagtagcttttgctataatgctaggaaatgctttggtcattttagcttttgtggtggacaaaaaccttagacatcgaagtagttatttttttcttaacttggccatctctgacttctttgtgggtgtgatctccattcctttgtacatccctcacacgctgttcgaatgggattttggaaaggaaatctgtgtattttggctcactactgactatctgttatgtacagcatctgtatataacattgtcctcatcagctatgatcgatacctgtcagtctcaaatgctgtgtcttatagaactcaacatactggggtcttgaagattgttactctgatggtggccgtttgggtgctggccttcttagtgaatgggccaatgattctagtttcagagtcttggaaggatgaaggtagtgaatgtgaacctggatttttttcggaatggtacatccttgccatcacatcattcttggaattcgtgatcccagtcatcttagtcgcttatttcaacatgaatatttattggagcctgtggaagcgtgatcatctcagtaggtgccaaagccatcctggactgactgctgtctcttccaacatctgtggacactcattcagaggtagactatcttcaaggagatctctttctgcatcgacagaagttcctgcatcctttcattcagagagacagaggagaaagagtagtctcatgttttcctcaagaaccaagatgaatagcaatacaattgcttccaaaatgggttccttctcccaatcagattctgtagctcttcaccaaagggaacatgttgaactgcttagagccaggagattagccaagtcactggccattctcttaggggtttttgctgtttgctgggctccatattctctgttcacaattgtcctttcattttattcctcagcaacaggtcctaaatcagtttggtatagaattgcattttggcttcagtggttcaattcctttgtcaatcctcttttgtatccattgtgtcacaagcgctttcaaaaggctttcttgaaaatattttgtataaaaaagcaacctctaccatcacaacacagtcggtcagtatcttcttaaagacaattttctcacctctgtaaattttagtctcaatctcacctaaatgaatcaggtctgccctttatcttgcccttttcattctaccaacagatctgcactttgaagtcaatggtaaattactccagtgaataatagcagtataatatgacttgataatatttttgtaaacttgtagtcataatagtactatattcttcttagtcctcacctcttccttgtcttttagatcttaatttcatgctgattacaaaaatccagttttgttttctttctatgttccatgcataatacagtcttaagtgaatttctcttttttaattttatcgtaatagaaacttatccagtttgaaaatcattccctaaagcatgcaataggaaaaagaacctcctggctgggactgcccaactctgttctgatcagtgggtgggtgaggtagggtttgagttggcaagagcagggaacgggcatgtgcccaggtgagctcctgtgtgtgtccagattttatattcctaatcccagtaaggaagaaagcgtagtgtgggagaggagagagctgatgactgcagttctcaaaggtcctcagtgaagttattttggaggccctggtggtcacaggatcagaaggcaagggataggcagtggtcaccaatggttgaaagtatggcttgtcccatttcttcctgttctctttttctagcttccacatcagcttccttttttgagaacatatagaagaagaaggctaagagatggtgaagagactgcatgattaaactagatagacctggtatacagtcactgaactagtagatgtcaataattattatttttaaaaatttttatttgttggccgggcatggtggctcacgcctgaaatcccagcactttgggaggccaaggtgggcggatcatgaggtcaggagatcgagaccatcctggccaacatggtgaaaccccatctgtactaaaatacaaacaagtagctggttgtggcgccgcatgcctgtagtcccagctactcgggaggctgaggcaggggaattgcttgaacccgggaggcggagttttgccagcctggcaacagagcaagactctgtctaaaaagaaaaaaaaatttttttgtttgagacagcatcttgctctgtctcccaggctggagcgtagtaatgcaatcatagctcactgcagcctggaactccttggctcaagcaatcctgctgccttggcctcccaagtatgtgggactacaggtactcgccaccacacctggataattaaaaaattatttctgtagagatgaagtctcactgtgttgcccagcctgggtgtcaataattattttttaaaaaaaatttttaaaaaggttttttgagacagattcttgctctgtcacccaggctggagtgcagtagcatgatcagggatcactgcaacctctgcctcctgggttcaagcgattcttgtgcctaagccacctgagcagctgggattgcaggtgcatgccaccatgcctggctaattttggtatttttagtagagatgaggttttgccattttggtcaggctggaattttttttttttttaattttgataagacagggtattgccgtgttggccagactggtctcaaactcctgggctgaaacaatcctcccgccttggcctcccaaagtgctgggattataggcacaagacaccacaataattattgcctgtatgtcaattattattttaaaatattgttgtatttacttaatgtctttaatgcatttgcccaatattttacattgttactgctcagaggtattcctttattatgtggttagcataggttatactttgctgacgattcacattttattagtttggttatgttttgtccttttaaaacattttcttttgagatgggggtcttgctctgttgcccacgcaggagtgcagtggcatgctctcagctcactgcagccctgactgcctaggctccagcaatcttcttacgtcagcctccagagtagctgggaccgcaggcacttgccaccacgccccactaaaaattttttaaattgttgcctttcttgaagtgttctctgcctgtctttgtcacaaaatttcatttttctcatagttaatttcatctctccggtaagattttattggtgtttcttttataactttgcagttcttacaccgtttggtgattttcatgtttcttagaaactttaaacctttaacttcaaacattaaaatacaagtcttttaagtacatgagtgcttagaaatgtacataatgtttatatacacttatgccttacattaaagtccaatatgagaaatacatgtttaacattcaataataattttaaaaatttgagaaataaactctcataaatgc

SEQ ID NO: 252973 - DNA, 223 bp, Homo sapiens
  misc_feature (196)..(196): n is a, c, g, or t
gccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctaagtcggctgctaggcgccggccgaggcgaggcgccgcgcggaaccgcggncccgggggcggacccggcgggggggac

SEQ ID NO: 252974 - DNA, 289 bp, Homo sapiens
gccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctaagtcggctgctaggcgccgactcaggtggtgtggactcaggtggtgtggactcaggtggtgtgactcaggtggtgtgactcaggtggtgtgactcagctggtgtgactcaggtggtgtgactcaggtgtgtgactcagcggtg

SEQ ID NO: 252975 - DNA, 802 bp, Homo sapiens
gttcaacgcctaatgactaaccggcaggatcccactccttcattcttgtgttcctagcacttcgaagagtgtggcccaacagatagcactgataatctgttaaattggattgagattttccccatccctcccacaaatggagtgtgggcgttgtctttccggttacctgccagaaaggttttcacatcgaggtctaagcgagctacctaacagaaactggggaaaaaaaaaaagttacttcttgctagactcatttatttatgcattcattcaccatagttttactgagtgcctattaagtgttaaagactgccctaggtattggggctgcaagggtgattcagttagatgatcttcaccgatgccaaattggctatgctctaaccctgagacatgataaaaaaataaacaaaatagtttcagttagtaacaagtattattgatagattaaaacagtaatgtgatagtgagagattggagagaagagggaggaggactctctaaagaggtgccatttgagcccagacctgactgataagaatgatccaacctcttaaagatccaggcagaggaaacaacatctgcaaagaacctgaagtagaatgaattatgattgaaatgggaaaaagccagtgtcggtggattatagtggtcaagaaggtgggtggtaggaatgagatggcacagggaggaagtagaaccacaggatggagggattgttattgatggtaggggtgttggtagtgaaggataaagagtcaagggtgacttacggatggtgatgccaatcagcgagatggca

SEQ ID NO: 252976 - DNA, 923 bp, Homo sapiens
aagccactgcacctggccgggacttagatttatattccctgaagtaatacagggccttagatggaatgaacgatttatattggtgctaattgggcagaaaagaaaaagcattgctgtaatatgaatgttgatgactttatgttctgaaaaatagtctgggtcaaagtgaaacatttaattgtgttcattattcctgtttctttgaggaatagactatcctgcgttaaattctacattgttaatataaactcaagagctatgtgagcagttgtaaatgatcccatttaaactgattgttgcataatttatactgattacagaaaccacaatgttatttgatgctcaccctctaaaatttaaaataatatctctcactttaaaatgtatgtgaaaaaacaaaaacaaaatgtagtatgcgatcatcatttagtagaatcactcagtgatttggatttggtccaaatataattctgtcccttgctttttctgttatgtaaacgtgcagacctgtgataacagagccattttctcgtcacgatttgcttttcttccacaacagtatcagttttcttgtatctgagatcagtgatgtcccaataaatcagatgggttaattgaggaggcaaaggaaattcaaacttaggagagtaggagtaggggctttgcctctgccccccactgtatgtccaaggcataaggaacaaggccctgtagcagagtctcacagtgtgtacttatgttaatattcaataaggaaaatgccacaggaagtaatcactataatgatgaagattttaagttattaaacacaccttccagtaaaaacctgtgatattattattatttttgagacaggatctctctctgtcacccaggctggagagccgtggtacaatctcggctcactgcaacgtccgtctcca

SEQ ID NO: 252977 - DNA, 302 bp, Homo sapiens
gagacagtgtcttctcactgtcacccacgctggagtgcagtggtgcaatctcagttcactgcagccttgaccccttggcctctagccatcctcccacctcagcctcctgaatagctggaatacaaatgtgtgcctccacacctggctaagaaaatatctttatgcgacttttcctcagtcatcatttgactctacagagcactatgttaaatactttctcaggaattttgtaggcatttctctgttgtcttctggtttttaatttgctgttgaggaggtagatacccttctgtcgtcttctc

SEQ ID NO: 252978 - DNA, 334 bp, Homo sapiens
ccttgactggtcgtccaacacagcatggagattccagtacacactcccagtaagtttgtttgcctgatttccaagatgttgattttatagtttctctaatcttttctaacgttcatgtcttttccctactgcccacccaaatctagcctcatacttcattactaaaacatgctgccctggaacaatttgcaccactgaagattccatttctgcctctacctggtctccctggttcctactccaatgaccattcaaggggggctctactgtctccaaacgaacacctatgaactcttatctttccaaagtcttagttcctggagttctcttattt

SEQ ID NO: 252979 - DNA, 411 bp, Homo sapiens
catacttgagagtatgaatgtatgtgcactgtcactttgctctgggtggtcctatgttgctggatctccctttcccttcttggtgcttacacatctcagaccctttagctgaatgcttgctaaagtaaaatgcttgaacagtattttggttctcagttctcactgttccctctggttgttgaggcgtcgaataaaaatgcacatagcagtggggtttagctggaaaaggtgaccttcttccaacttcacctctacttctggctcctcaaacagcgggtggacagtaaggcagggaagttgttttctcatttctcactgaccagactgtgaatattttcatatggattttctcttattaatgttactctggtgcttctttgttttaagataaaaattctgaatgtacacatg

SEQ ID NO: 252980 - DNA, 727 bp, Homo sapiens
caaatggagaaattgcaaaggtcatcacaaagtcaggcttgctgcagaagatagcactgtgggtgaacaggagatacccaaagctccagcttctggactgacttactccatttgctaccttctactttaagcctagatgaccagatggagaatggctgcccaggccgctagggaaaatcaggacatgtctccaggggcaaatgcctaggctccaaagctcttgctaccatctagagggatgaagcagataagaagactgaggctcagagaagcaaagcagcccatccaagtttccccaatgaacatgtttaaatggaagagagaggaatgagagaggaaggcaagaatacaaatatttaagaaagctttattttcctgaagcaaagaatgacacttgaaaccgagggaatctcaatgtccaccttgcatttccatgaccagcaagagaggggaacccctacaggaatgttcatcctctgcctctgacctgggaagtctcagtcatccccgaggaccaattccaaatgtcaattcattcaccaccattgcccttgtcattgcatccactcctcctctctctctgacttgtgttaatggtaggtaactgtgtatgaatctaggctgggggtttgtctttgaggtcaaggactatttctgattcactgtgtgtctccctaaatccttcttccacccagcaaagatgctcaaaatatatatacaaatgata

SEQ ID NO: 252981 - DNA, 520 bp, Homo sapiens
atgctgggcatctcaggtgcctgctgatctgagcagttgccagccttggcgactcacacaggcgagagcgcctgccattgactctaggctccacgaagcccactccctctcccagccctgcgtccacctgcacccacagcagcgctcaccaactgtgggcctggctctgtcctaagaacgctgtgggtcactcgggtgataccaagggcagtggttaagcccatgctcactggggcccagatttaagccccaagccccaggtggctttgggggtatcagtttcctcatctctcaaatggatataacttaatcatcacaatcaccattttgccagagaggaaacgggcccagagcagcacccctgtgccccgagtaggggagcctggacttgaacccaggcagccggactccagaggcccactctacacactgcccacccctgccacctttccaggccaccagtgcccctgaaccctgctgccacgtgctgccccagatttgcgatccacccagcggccgc

SEQ ID NO: 252982 - DNA, 381 bp, Homo sapiens
ctggttctgttggacttttgatgagcatttcttcatctgtaaatgaaagataacaacacataaagtttcatttccgctctcccttttgtaggctagtttcagaagccaagttcaattttttagaatgtttttaagtgaaaaaaatatatgtattttctacatacaaggaaattggcagagggaaggatttaacatgtagaaaacacatttttaccttgtgaccaggttgtgactgtagggagaattgcccagccaacacatgcaacagagttctcattcatgggctaaagtaaaaatctatttaagaaattgtcatttgggtgtttaatcagctaaccttagctgcagtatgttaaaataaaataatgcttggaccagagg

SEQ ID NO: 252983 - DNA, 327 bp, Homo sapiens
cattgtcatcaccattatcatcattattattaaacttatgttcccaggccaaaaggtagagttgtcgaatctataattaatgacttcagaaaagtataagcacttaagcattcttggattccttcattaaagaacttgaggctctttattaagttttagcccttcttactttgcctgtttagtaatgtttgtaaaaatatagtatatggcccaggcatggtggcttatgcctgtaatcccagcacttttggaggccaagacaggcagatcagttgagtccaggagtttgagaccaggctgggcaacacgggaaaaccccatctctgc

SEQ ID NO: 252984 - DNA, 484 bp, Homo sapiens
cctgccctaaggaaagcatagtgttaagttaccaaattaagatatttgtagacttagaaatcatgcattttaatctaacataaatgtttctatcacatttgcttacatagagaatattagtcgtagcaataccccttcttggttatagttttgaaagcattcttgtagaagttatttggtcctcacagtgtctccatgttagacctgccaagggaggtaggtacattgcagctgggaagtgttaagcacccggctcacagacgtgctccagaaccatctagcacccatctcaggctggtcagttgcagtcccttaagcttctcctctaggttctgggcttgccgtgttagacatcactctgtcagtattttaagggagataggcttcccactaaagtttacgttagatgaacttataaatgagatgactctgattcacaaaagcttgttgggctttgcatgcttttcataatttatggagctta

SEQ ID NO: 252985 - DNA, 665 bp, Homo sapiens
gctgcatcaatgcagatttttctctacaaatacaaatctcctgcacaaaagacagctttgcagagctacctctttttgctggctctctgacagccatgtcaaaatatgtcaaaaaaatatattttggggtaaaatattctgatttcctttaacacctttcctgacagcctcccccacccctgcatgagtggattagtgctctgactttgggctgccatagcccctgcaatggtctgtgtgagcctctctcagccccctttgcttccctgtgttcccatacagtatcagtgctccaaaggcgggaccgtgatacctaatgtatggaaggcacttcagtgaatgtttgttgaatgaaagaaaaggcaagccagacacggtggcttacacctgtaatcccagcactttgggagcctgaggcaggcggatcacttgaggtcaggagttcaagaccagccagcatgacgaaaccccatctcttctaaaaatacaaaaatctcttctaaaaaaatacaaaaatcagctgagtgtggtggtgcatgcctgtaatcctagctacttggtaggctgaggtgggagaatcacttgaacccaggaagcggaggttgcagtgagcagagatagggccactgcactccagcctgggtgacagagcaagaccccatctc

SEQ ID NO: 252986 - DNA, 447 bp, Homo sapiens
aaaacacagaccggggggatgtctttagagtcaggagaaaacatcatgtgccaagggtgctctccaaactgatgactagttcccagacttaacagaggtcaagcggagaaaaaggaaaactttctttagagaagaaaaagaaaaatcttatcacttctcatatttctttaggcagtgtatgagcttatttgctgatatcactaatcctgagatgaaaaacaggatggacttaagtaatttttaacctatttctgaggccaaaaagactgtagtattattttaatcaaatttatgcattttcagtgggacttcaaattttaataataaggcaatacttttatcttcttaaagtatatttcctgtacttataagtgtgcaaatgacataattttaaaattagttggaatattgaaaaaaattaaaatttcacttgtaaaataaaaaaat

SEQ ID NO: 252987 - DNA, 451 bp, Homo sapiens
tgggggcacaggatgcagaagctctctccagagggcacaggtggtgaaccttgcatagtgccatctctcctggtgcagctcatgcgtgtgctctgagagtgtacctacctccacctagatttcaaagaatagagtcacttggagcctcactcagagggccatcccaagggcagggccacttcaagagtccccactagggcagtgcctagtggagtcatggggatgtgggcacttttgtgactctggaccagcagggtagccttcatgtgattctagcctggaagagcaacatgtccctaactacaacccattagagcttcagaaatggctgtgggggcaggactacaagcaatgttggaggttctccttgctttagtctgtctgggagactggatatcaagtcaaagaagattattcttgaaaattaaggttttggactcactcaggacct

SEQ ID NO: 252988 - DNA, 362 bp, Homo sapiens
tctcccagtagtgcatgcttactctgagaagctggattagttcccacatggatgaattagttctcatagaatggattgttataaagcccggatgcacctcagatcttgctctcttcacttgtatctgcttctcccttgaactttctctaccattttaaaacgcagccttcactaaaagccaaacggatgccagttttgtgtttcttacacttcccagtctgcagaaccatgagctaaataaatctcttttctttataaattacccagactcaaatattctgttacagcaacatgaagcagactaagacactctctatctagtaaagaatttgaattcataaatataaaccttttcatctcaa

SEQ ID NO: 252989 - DNA, 492 bp, Homo sapiens
gtctattacatgtcaaattatctttgtacagtatctaagttagtcctcactgagcctggaaagagagctatttatcttatttcactcaggaggaaagtgaagttcccaagagttcactaggtagcttgcagtcatgtggcaaataactactgagtatggaatatgaacctaggctttcttcgctccagggaaatcttgctggttctggaaaagcaaagtacaccgccagccctcataaccctgactctcagcagaagctctgaaactagaaacacatttttagggagcacagttttttgctgcccaaggacctaaagtcaacagatacctgaaactttctgtcgctgactacagggagtaggtcccatcccccacagtataaaggtcagaagccagaaaccagcttctgggtataaacattacagttcagtgctctcctcctccacctctgaggggcaaaaataaatttgagggtgatggaaaatctaaaca

SEQ ID NO: 252990 - DNA, 272 bp, Homo sapiens
acccttgatatactatttagagcttctattctgggaattttattatgcatgcatagctagttttaaaatttttctccttattgatttgttaatcaatcctcatcccttcccttcttttaaaacattatttcctcattaatatttacctacattcatactgctgtttgacttgtgcagaaaagatggaggaggacaggagatgctgtgtttatctcatattcagcagaagtagaaaaaggtaaatgtcttcaacatcggtcagacggtactta

SEQ ID NO: 252991 - DNA, 316 bp, Homo sapiens
cacatctgaccacagctgcctaaatctctacttgaggtcacatggcaacctgtcacgtttcacagtaaaagttggtcttgaaaagaaagccgccactagagaagatgagggtggtgaagatatgtaagactgactgttcttactcagaaaatggacattttgaaagagagcagcaggttggatttggtggtgattctgatctgtgaggcagtagtccactccaggttcttttcagaaacaaaagtgattactaaaactactcgagcaatgctcttgcctgtgccagaattgcttatcaacaaaaagacaaaacttg

SEQ ID NO: 252992 - DNA, 2945 bp, Homo sapiens
  misc_feature (2030)..(2030): n is a, c, g, or t
ggttgagtacatgaggctgggtgaaaacatcattgaatattccagggattttaagttatacatcacaacccgtttgaggaatccacattacctcccagaagttgccgtgaaggtctgtctcctcaacttcatgatcacccccttgggtctccaagatcaactccttggcatcgtggctgcgaaggagaagccagagctggaagagaaaaagaaccagttgattgtggaaagtgccaagaacaagaagcatctcaaggaaattgaagataagatcttggaggttctctccatgtccaagggtaacatcctggaggatgaaaccgccatcaaagttctgtcctcctccaaagtgctatctgaagagatctcagagaaacagaaagttgcttccatgacagaaacgcagattgacgagactcggatgggctacaagccagtggctgtgcattctgccaccatcttcttttgtatctcggacctggccaacatcgagccgatgtaccagtactccctgacttggttcataaatctctacatgcattccttgacccacagcacgaagagcgaggaactgaatctgcgcatcaagtacatcattgaccatttcaccctgagcatctacaacaacgtgtgccgttctctgtttgagaaggacaagctactcttctctctcctcctgaccatcggcatcatgaaacagaagaaggaaattacggaggaggtgtggtacttccttctcactggaggcatcgcactggataacccctaccccaatccagctccccaatggctgtctgagaaggcatgggcagagattgtccgtgcatctgccttacccaaactgcatggcctgatggagcatttggaacagaacctgggtgaatggaagctgatctatgactcggcctggccccatgaggagcaactccctgggtcttggaagttctctcaaggattggagaagatggtgatccttcgatgtttgcggcctgacaaaatggtgccagcggtccgggagttcattgctgaacatatgggaaagctgtatatcgaagcccctacgttcgatctccagggatcctacaatgattccagctgctgtgcgcctttgatttttgtgttgtctccaagtgcagacccaatggcaggcctgctgaagtttgctgatgatcttggtatgggaggtaccagaacacagaccatctcccttggccaaggccaaggccctattgctgccaaaatgatcaacaatgccatcaaagacgggacctgggtggtcttacagaactgccacctggccgcaagctggatgcctaccctggagaagatttgtgaggaggtgattgttcctgagagcaccaatgccagattcagactctggctaaccagctatccatcagagaagtttccagtcagcattctccagaatggaatcaaaatgaccaatgagccccccaaagggctccgggccaacctgttgcgctcctacctcaatgaccccatctcagatcctgtgttcttccaaagctgtgcaaaggcggtgatgtggcaaaagatgttatttggcctttgtttcttccacgccgttgttcaagagagaagaaacttcggccccctagggtggaatattccctatgaattcaacgaatctgacctgaggattagtatgtggcagatccagatgtttctcaatgactacaaggaggtgccctttgatgctctgacctacctgacaggggaatgtaattacggaggcagagtgactgatgacaaagaccggcgtctcctgctgtcacttctgtccatgttctactgtaaggaaattgaggaggactattactccctcgctcctggagacacttactacatccctcctcatggctcctaccagtcctatatcgactatctcaggaatctccccatcacagcccacccagaagtgttcggcctccatgagaacgcagacatcaccaaagacaaccaggaaaccaaccagctgtttgagggggtcctgctgaccctccctagangtcaggaggaagtggcaagtcccctcaggaagtggttgaggagttggcacaagacattctctccaagcttcccagagactttgacctggaagaggtcatgaagttgtaccccgtggtctatgaagaatccatgaataccgtcctaaggcaggagctcatcagattcaacaggctgaccaaagtggttcggaggagcctcatcaatcttggccgagccatcaaaggacaggtcctgatgtcctcggagctagaggaagtctttaacagcatgcttgtgggtaaagtgccagccatgtgggcagccaagtcttacccatcactgaagcctctggggggctacgtggctgacctgctggcccgcctgaccttcttccaggaatggattgacaaggggccccctgtggtattttggatctctggattctacttcacacagtcttttttgactggcgtctctcaaaattatgcccggaaatataccatccccattgaccacattggatttgagtttgaggtaaccccacaagaaacagtgatggagaataaccccgaagatggggcctacatcaaagggctcttcttagaaggtgcccgttgggacaggaaaacgatgcagattggggaatctctccccaaaatcctctatgacccactgcccatcatttggctgaaacctggggagagcgcaatgtttctgcatcaggacatctatgtgtgtccagtctacaaaacaagtgcccgcagaggaaccctctccaccacaggccactctaccaactatgtcctctccattgagcttccaacagacatgccccagaagcactggataaaccgaggggtggcctcactgtgccagctggataactgatggcatttgtctcaagacagaaaataaaaagcatttcattcttaatg

SEQ ID NO: 252993 - DNA, 424 bp, Homo sapiens
tggagctcatagctttttattcttccaggtaaccccacaagaaacagtgatggagaataaccccgaagatggggcctacatcaaagggctcttcttagaaggtgcccgttgggacaggaaaacgatgcagattggggaatctctccccaaaatcctctatgacccactgcccatcatttggctgaaacctggggagagcgcaatgtttctgcatcaggacatctatgtgtgtccagtctacaaaacaagtgcccgcagaggaaccctctccaccacaggccactctaccaactatgtcctctccattgagcttccaacagacatgccccagaagcactggataaaccgaggggtggcctcactgtgccagctggataactgatggcatttgtctcaagacagaaaataaaaagcatttcattct

SEQ ID NO: 252994 - DNA, 312 bp, Homo sapiens
gtggctcagcctgagatgagtggactgatgctagtgttaggagtggactgggacaaggtgaggctgattggcccaagttccgggtccctcctttcttcaagcacccatgtgtctatgacagtcatacaaagaaatagaggggaaagagtatggagagaagtcagtagaggaaaaaaagaaggaagggaagaggggagcagactgttaaccaaccatacaataagggcactgcttgtacccagttcttgggaagccacagtcatcagcaactctaagactaaccaaggctacttgtctcattttgcctccctg

SEQ ID NO: 252995 - DNA, 385 bp, Homo sapiens
agaaagtagagagcttagatttgtttgcttaacacatttataacacctgaataaccgaatatgtatttatggtttagtaccgtggccttgaagttagattcatgattttcattttaactttatatttttaatcaaattaattgtgatcccagtagcttaatttcgccattgagtagataaaattgctcctaggaaatatgtgagcatcaatataaaataccgatggtgtttttcaataacagtgtctgaagctctctaatttgtaaaaaatactaacattttcctggaaataattttactgacaagacatctgttaggctttttaggttatgaaagaagtaaccctaaatttttaataaatgtaaaataaagaatcaacatgtgt

SEQ ID NO: 252996 - DNA, 1415 bp, Homo sapiens
acgggcttgcagaggagagagggagtggggctgggtcttcccaccctgggtcctttcctccttccccactccgtttagctgtaaagctcaattaagtgtgattagctgagaagagtttctgcagaattagagcacgccccacccctgtcttcgtggtccccttcccttaacccggaaactggatgggccaggacaaagagagttaagagctttgtcagtggtctgtctggagcgacagatggaaggaaagggaccggttgagcaacatgacaggtggctgaggagccaggtgcagagtggtagagttggctggcggagtggccagcacatgagaagacaggcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggca

SEQ ID NO: 252997 - DNA, 558 bp, Homo sapiens
acgggcttgcagaggagagagggagtggggctgggtcttcccaccctgggtcctttcctccttccccactccgtttagctgtaaagctcaattaagtgtgattagctgagaagagtttctgcagaattagagcacgccccacccctgtcttcgtggtccccttcccttaacccggaaactggatgggccaggacaaagagagttaagagctttgtcagtggtctgtctggagcgacagatggaaggaaagggaccggttgagcaacatgacaggtggctgaggagccaggtgcagagtggtagagttggctggcggagtggccagcacatgagaagacaggcaggtaggtggacggagagatagcagcgacgaggacaggccaaacagtgacagccacgtagaggatctggcagacaaagagacaaggtgagaaggagactttggaagtgacccaccatggggctcagcatctttttgctcctgtgtgttcttggtgagttctcccggagcagggagagggcaggactgcgactggatcccttcacccccatgaggag

SEQ ID NO: 252998 - DNA, 358 bp, Homo sapiens
taaaggcaaaataatgtttaatttcattacatcaaagttaaagatttctgttcatcaaaagacacaatggacaaggtaaatcaacatgtaacagcttgagaggtgacatttgcagtctgtactattgacttaagattgacatattgacccaaatatgcaaggaagtaagccgtggcaggtggggctgtttgagggcaccagcctgcgctgcgggggtgtccttattgaccacaggtgggtcctcacagcggctcactgcagcggcaggtaagtcccttcctggggtgggcgaagggaggactatgggaaggcaagcgctgggggtaggatcacaagggagggtggtgcccactgggaa

SEQ ID NO: 252999 - DNA, 264 bp, Homo sapiens
gcggccgcctactactactactaaattcgcggccgcgtcgacggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggca

SEQ ID NO: 253000 - DNA, 899 bp, Homo sapiens
taaaggcaaaataatgtttaatttcattacatcaaagttaaagatttctgttcatcaaaagacacaatggacaaggtaaatcaacatgtaacagcttgagaggtgacatttgcagtctgtactattgacttaagattgacatattgacccaaatatgcaaggaagtaagccgtggcaggtggggctgtttgagggcaccagcctgcgctgcgggggtgtccttattgaccacaggtgggtcctcacagcggctcactgcagcggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggaacccattcccggatctgctccagtgcctcaacctctccatcgtctcccatgccacctgccatggtgtgtatcccgggagaatcacgagcaacatggtgtgtgcaggcggcgtcccggggcaggatgcctgccagggtgattctgggggccccctggtgtgtgggggagtccttcaaggtctggtgtcctgggggtctgtggggccctgtggacaagatggcatccctggagtctacacctatatttgcaactccactcttgttggcctgggaacttcttggaactttaactcctgccagcccttctaagacccacgagcggggtgagagaagtgtgcaatagtctggaataaatataaatgaaggaggggca

SEQ ID NO: 253001 - DNA, 449 bp, Homo sapiens
cttggattgttggcttcctcagctctttaagatactgactccaataagaccttttcaagtcgagggctccctgacttaatatgtaaaattacaacactctgattctgcctttctgtctttgctttatttttctctgtagcaattgttgcctttgaatatactttataatttacttactttgtttattacctaaataatcagtaaaatgttacctccgtgaggggagggatttttgtctgtttggtttactgccatattcccaatgcttagaacgtagatgtggtgctagctacaagtctggcagcatcccacatgctggtgatgtagtaaagaacattacagatgtagttctcacccttacgcaacttatattccggtggtagagacagatagaaaataaatgggcaaataaataaaatattgccagagatattaagtgttacaaaaaa

SEQ ID NO: 253002 - DNA, 469 bp, Homo sapiens
aaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggataggaattaagcagaagcggtcctaggctttgtcttcaggaagataggtgttcaagtcccagctctgccacatgctggctgtgggactttgggcaagttaatgaagccccatgagtctcagtgtcctcatctggcgagcagagagagtagcctgtaccttgcagagtcatggcaaggatgaaacaagaatgtctctcagggccttcacagcgcttagtgcataatgaggggttagttagtgaactcctaccaagctcctttgtacagggcattta

SEQ ID NO: 253003 - DNA, 569 bp, Homo sapiens
ccagtgaggcccaacaagccctctcagtcctgctctaacaaaaaacggccagacccctttttgctttctctctttcccttattggaaacctgcctatgaccctggatacaactctcaggaaggtccctgcccccatcactggcaaagaagctactgccagctgacctcagccactatcacttcttccctttgcagagtgttctaggatttatgacatatgcttgttgatcctgggaaggatgtgtgcctgggcaggcgtggagaattgggtactgtgggcgggagggcaggccctgaggagcagggggtgggatcctccagtcttagaatagtcccagtctggctacaaccttcaacccaagacccggattcttcagcaccgagtgtgagtgttccttcatgaggcccccaccccattcctgggtctccttagtggagggaagtatgagtgccgaggggagattgggtcctaggccttttaatatcaagccatctctgtctgcctcagcttgatccagagggaagcccagcttgaggggtcaaggtgtttgggcagtggggttgtgagg

SEQ ID NO: 253004 - DNA, 733 bp, Homo sapiens
tgctttctcttccaccctctgctgtctctccagcacagcacctgccacagagtgggtactcagtgaagatctggtaatttcctgcgactcctccctcctttggccaccttgtcatttcatagtataaatggtgtgccataagatggtatattgtctggtgagatgttgtcacacagttctgcacctccaccccccattcccacatggtctgccctccctcatctccgtgactgaacagcctcgtccccagcatggtctcagccacactctcagtccagccactcttgggctttacaaccctgttctttgtttgtttgtttgagacagagtcttgctctttcgcctaggctggagtgcagtggcatgatctcggctcactgcagcctccgcctcccggattcaagcaattctcctgcctcagcctcccgagtagctgggggcgcgcgccgccacgcctggctaatttttgtatttttagtagagacagggtttcactatgttggccaggatggtcttgatctcctgacctcgtgattcgcccgcctcggtctcccaaagtgctgggattacaggcgtgaaccaccgcgcccggccacaaccccgttcttcacacgccatccacagctcttccctatctggccggaactagctcttccattttatctctaaccagctggccactgtctgcatatcccggccacggccagtctctgaaagttccccacacagatgc

SEQ ID NO: 253005 - DNA, 439 bp, Homo sapiens
tgctttctcttccaccctctgctgtctctccagcacagcacctgccacagagtgggtactcagtgaagatctggtaatttcctgcgactcctccctcctttggccaccttgtcatttcatagtataaatggtgtgccataagatggtatattgtctggtgagatgttgtcacacagttctgcacctccaccccccattcccacatggtctgccctccctcatctccgtgactgaacagcctcgtccccagcatggtctcagccacactctcagtccagccactcttgggctttacaaccctgttctttgtttgtttgtttgagacagagtcttgctctttcgcctaggctggagtgcagtggcatgatctcggctcactgcagcctccgcctcccggattgcttgagaccaggagttcaagaccatcctggccaacaca

SEQ ID NO: 253006 - DNA, 691 bp, Homo sapiens
tactatgtacaaatttactacttcttaaagtatactttaagaatgcttattcagcaaatgatattgggacaattgagtaaccaccaaagaaacaaaacaaaccaaacacaagcctttcatggtatcaccaaggagttgcagatggattaaaaatctaaatgtaaaaattaaatagtagcatttgaaagacagtataattgagattaagaatgcctcaattcaaactctgactctatcagattctagctgtgtgacattggccaagtcgtctaattatttcatgccttaaattcctctataaaacgagaacgataaaagtacttaacttgtagagttattgtgaaaattaagttttagggttattgtaaagatgtacagcagttaaaagagtctctggcacatagaaagcactatataaaagttgtatattattatttctagacttgaaaaaggatggattggccgggcgcggtggctcatgcccgtaatcccaacactttgggaggctgaggcgggtggatcacgaggtcaggagatcgagaccatcctggagaacacggtgaaaccctttctctactaaaaatacaaaaaaaaaaattagctgggcatggtggcgggcacctgtattcccagctactcgggaggctgaggcaggagaatggcctgaacctgggaggcggagcttgtagta

SEQ ID NO: 253007 - DNA, 439 bp, Homo sapiens
catcacagcagcacgcatgacctcagctttgactcgtttaactctgagacgtccttcttgaaggcccttgccacagtttccctggccacgccaccccatcccacctctggtcatctccccagccctttatgccccgtcgccctccacccctacatcagctcctccaaaactgagctcccagttcattttgcatatcctaactcaaaatgctcagctaatccaaggggactttctttaccaggattcaaccctagtagagagctgttatggtttcaatagtcatatttatttcttgtaaaacagttgccaggtgctctccagcaataacgttttgtcagtcatgtttcatgttttaacttaggtgtattcatgtgtgacacttccatgttgacaggcccggaaaggcctcatttttaactaaaagatgttttataaaccc

SEQ ID NO: 253008 - DNA, 418 bp, Homo sapiens
tctctatatatagcctagatgaacccatgtactatgttgcacaagacacatacaaaggcatgaattgcagcattcttgttaatggtgaagaattagaaacaacttaaatatatatcaaaagaagaataaggaaaaaattaagctagtttcatacagctgagtattctacagcagtgaatgtaaatgaactggataatcatttgttaagaagaataaatctctagacataatcgcaaggaacaggaaaacaaacgaaaaagaatgtataaatatgacttaggtaaaacattttaaaagcacctataacattatatctgtcatgaattatattttaacataggaatgacaatatattaacttttgtcaaattgaggtagtaggcatatgaagttcttaaattgttttcagaaactgtttt

SEQ ID NO: 253009 - DNA, 203 bp, Homo sapiens
gattagtattatctggcgagggaggaaaagtgccagagcaagtgccgaaactggaaggttacatttagttcaggatatgaagatcatataaggcctgcacggtggctcacacctgtaatcccagcactttgggaagccaaggtgggggaggatcgcttgagctcaggagttggagaccagcctgggcaacatagtgggacccc

SEQ ID NO: 253010 - DNA, 408 bp, Homo sapiens
taacactcaccgcgagggtccgcagcttcattcttgatgtcagtgagaccaagaacccaccaattccggacacaatgccagtgccctccactcggcaacagagcaagagtctgtctcaagtcaaaacaaaaccataaaaaattaaaataaaataaaaaaataaaaacaaggacccatgttatcaactatatgcaagatctaggttgacttcaggaatcatgtgaacaccagaagaggctcgatctctttatctctgagttgctgtatccaaccttcaaaagattccaaactactaggaatactgatgaaactcagcaggattgaggattggtagtgaccttgaccattttgatgagttttcaaactacttactgaacactatgattaaaaaatggttatttgattttg

SEQ ID NO: 253011 - DNA, 1253 bp, Homo sapiens
cccgcctggagcaccagcctcgcgcgtccggaggaaccttggcttggcgccccatcctggtagcctcaaacttcatagcactttgtggtttttcttaaaactctgagcctgtgcccgggcggatcacctgaggtcgggagttcaagaccagactgaccaacatggtgaaaccccgtctctactaaaaatacaaaattagcccggcgtggtggcgcatgcctgtgatcccagctacctgggaggctgaggcaagagaatcgcttgaacctgggaggtgtaggttgcagtgagccgagatcatgccattgtactccagcctgggcgacagagtgagactccgtctcaaaaacaaacaagcaaacaaacaactttgggcctgtgccgaagggtctgggcagatcttccaaagatgtacaaaatgtagaaattgccctcaagcaaatgcaaagatgctcaacacccttagtcatcaaggaaatgcaaatggaatccacagagagatactgcacactgacaaagatggtcgtattactaaaggtgaataaccagcgcggggggcacgtggagtcactggaacatttgtgcaatgctggtgggaatgtcaacccgtgcggccctctggaataagcctggcagctcctccaagagttaccgtgtgacccagcaattccactcctagctccacccacaggaattgaaagcaaagacgcaaacagatgcctgtgcaccaaagttcacggcagcatccttcgccatagcggcagcatccttcgccatagcggcaaggtggaaaccctgtccatccactgaggcgtgcatagactaaacatggccagtccaggcactggaatccaggccgtagaacggcgcccacggtcaaaaggaatgagaccctgatgcactgggcgacacagacgggcgacacagacttggagacatcatgctaagtgaaaagccaggcacacggagcggacggcgtgatcctgctcacgtgatgtgtcccgaatgggcacgtccagagggaagaagggagatggcgctgccggtgcccgggacgggggttgggagcgacggttgctggtttggggtttctttctggggtgaggaagtgttttgatattggccgttggtgatgtttgcatacctctgaatatgctaagacccacagaattgcacactttaaatggatgaattgtatggtatgggaattacacaattatgtctcattaaagcagttattttaaaaaaaaagt

SEQ ID NO: 253012 - DNA, 362 bp, Homo sapiens
tgcctaagaagaactggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaaggaacagtttgcctggagacatttctactggtaccttaccaatgagggtatccagtatctccgtgattaccttcatctgcccccggagattgtgcctgccaccctacgccgtagccgtccagagactggcagcctcggcctaaaggtctggagggtgagcgacctgcgagactcacaagaggggaagctgac

SEQ ID NO: 253013 - DNA, 1233 bp, Homo sapiens
ccgtagtcaacgtgcgcctcccctcccggctcccagccgggcgcgccccgggctcgagtctctgcctgcccagtggcagccccgcccttcctctcccagtgggccctcggcgcccagctccgcgtcctgtgaggtccagtggccgcccaggcgcgaccagatctgggtgcgcggagagcgcgcatggcggctgtgggaccgcggaccggccccggaaccggcgccgaggctctagcgctggcggcagagctgcagggcgaggcgacgtgctccatctgcctagagctctttcgtgagccggtgtccgtcgagtgcggccacagcttctgccgcgcctgcatagggcgctgctgggagcgcccgggcgcggggtctgttggggccgccacccgcgcgccccccttcccactgccctgtccgcagtgccgcgagcccgcgcgccccagtcagctgcggcccaaccggcagctggcggcagtggccacgctcctgcggcgcttcagcctgcccgcggctgccccgggagagcacgggtctcaggcggccgcggcccgggcagcggctgcccgctgcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctggtgagccaggcacccgcaggccccccgtgggacattacagaggcctgagaactcagcaccagggctcggtgtgtgtggtgttggagtgtgtgctatggaaccgcagaatcgatttcagaaagataatagagtccatattatatagggtgtccacataattgttgtacaaaccagagctttttaaagtgaaaagcagtgctaaaataattattgcaaaacaactggcttaaactggagctgtcccagcgaatcaggacgctcagtcactctgatattacgtaacataccagttagggcctgcggaagcatcttgtaatggaacacattactatttctgcagagaaacatggatattcaataagtgggaatattaatacaataaagagcctcatggcatgttttgtcaacaaaacagtagtgaaaaaaaattca

SEQ ID NO: 253014 - DNA, 2332 bp, Homo sapiens
ccgtagtcaacgtgcgcctcccctcccggctcccagccgggcgcgccccgggctcgagtctctgcctgcccagtggcagccccgcccttcctctcccagtgggccctcggcgcccagctccgcgtcctgtgaggtccagtggccgcccaggcgcgaccagatctgggtgcgcggagagcgcgcatggcggctgtgggaccgcggaccggccccggaaccggcgccgaggctctagcgctggcggcagagctgcagggcgaggcgacgtgctccatctgcctagagctctttcgtgagccggtgtccgtcgagtgcggccacagcttctgccgcgcctgcatagggcgctgctgggagcgcccgggcgcggggtctgttggggccgccacccgcgcgccccccttcccactgccctgtccgcagtgccgcgagcccgcgcgccccagtcagctgcggcccaaccggcagctggcggcagtggccacgctcctgcggcgcttcagcctgcccgcggctgccccgggagagcacgggtctcaggcggccgcggcccgggcagcggctgcccgctgcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacaggtgtcccgtctttgagtgacaagcccgggacaacagccagtgggcatcacggctctcca

SEQ ID NO: 253015 - DNA, 2380 bp, Homo sapiens
  misc_feature (508)..(508): n is a, c, g, or t
  misc_feature (560)..(560): n is a, c, g, or t
ctgcagcctgcctggaagctgaaggaaaggtgggggcattgtaggacaccttgaacccaggtctcccaacttcacaggactcccttcctccgcccaggagttttaaggaagaggaacttcctggtgggacatattgagtgccaaacgtgtgttcacataaaaaatcaagagatcagggcatgagtctgcatctgaaaactcgagtaaaaaatccggtgtatgctgttaatggaaagaacagaatatgacacttgcatgccgcatattctcacttcgttccttgggggtgtgctgctacctctggtcactggcatcggacttttcttccttctttctactttcctacatctcccaagttttgtattttgagcatgtgttagcattataactgctaaacaggaaagatggcctttaaaaagaaagtgaagtgtaaaagtttgagggtgatgaaataaatgtgcttgaggaagaaaaagcaatctcagtttaatcctatggttgccccagnaggcactaatttatcccttctgcttttcaagtgaggaagctgcagcttggcntagttctggggggagtatgaagctgccttggtttaggtgatggagcacaggtccacagacatgtgtgggtgcatctgtggcaggggagaaaagagcatgtgtccagactacagcttgttcagagctgggacactgacaatagagcacgcactgcgtgcgtaggtgggtgtgtctccgatcctccagcagtgacagggacgaagccttgccctgtgggatgactcaggccactggccaaatgttatgtctccatgttcaagtccctctccaacttctcctcctgggacagaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacaggtgtcccgtctttgagtgacaagcccgggacaacagccagtgggcatcacggctctcca

SEQ ID NO: 253016 - DNA, 2014 bp, Homo sapiens
tgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctcgccaagatgtccagggagggggctcccgggttaagccgcgcacctagagccgtctgactgtgccaacgctgtcgattctgggggccctttctttgctattttctcgctgagcctcagcgagggagctcttggagtccaggctgagggtcttgaagaaggaactggaggactgtgaggtgttccggtccacggaaaagaaggagagcaaggagctgctggtgagccaggcacccgcaggccccccgtgggacattacagaggcctgagaactcagcaccagggctcgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacaggtgtcccgtctttgagtgacaagcccgggacaacagccagtgggcatcacggctctcca

SEQ ID NO: 253017 - DNA, 2223 bp, Homo sapiens
  misc_feature (411)..(411): n is a, c, g, or t
  misc_feature (523)..(523): n is a, c, g, or t
tgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctcgccaagatgtccagggagggggctcccgggttaagccgcgcacctagagccgtctgactgtgccaacgctgtcgattctgggggccctttctttgctattttctcgctgagcctcagcgagggtgtgtgcaggggtgagggcggggcggggaggctcgggcggcagtccccagtctctccttgctggcccatcctgctccaactctcccagccncggggcttcctggtgggggggcggagagtagaggagacgactaggggtagggctgccggagcttgtgtttcagtctggctggtccagcagatgcttttggggaagcaagatnccgagaccttcagagtcacctcgcagtgtaacctgtagcctgtagagatgacttctacccggcctccccctcagagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacaggtgtcccgtctttgagtgacaagcccgggacaacagccagtgggcatcacggctctcca

SEQ ID NO: 253018 - DNA, 1946 bp, Homo sapiens
tgcgcgacgtcccccacggacttggcgatgttcttcctgtctgttcggagcctctagcctggtctgcgtctccgcagctctctgcccgcgggaagtctccggcacagccacgcagccgctgcccccactcttatctctttccccgaagcgggctctgctcaaagtccccacctcgtggaactgagtgagaggacctcgccaagatgtccagggagggggctcccgggttaagccgcgcacctagagccgtctgactgtgccaacgctgtcgattctgggggccctttctttgctattttctcgctgagcctcagcgagggagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacaggtgtcccgtctttgagtgacaagcccgggacaacagccagtgggcatcacggctctcca

SEQ ID NO: 253019 - DNA, 493 bp, Homo sapiens
agaacatctcacccatcacatggaacatcccgtcacccgtcacacggaacattccgtctcccgctgacacggaatatctgatcacccatcacatggaacatcccatcacccactcacacggaacatccgatcacccgtcacatggaacatcctgtcaccagtcacacagaatatcccgtcacccatcacacggaacatcccatcacccgtcacacggaacatcccgtcacccatcacacggaacatcccgtcacccgcagctgcccctgcccctttgtggccagctccccgcctggttcgtctcttctggaattccacgtccatgaatcacagcgcgtgttctccctgctgtggaattcttttacccaacataatgtctgcgtgactcatccccctgcagcctcggtcggagctggcctgccatcgatcctgttgtcctccccattttttagataaggaaactgagagttagggagggcacagatggaagagg

SEQ ID NO: 253020 - DNA, 492 bp, Homo sapiens
agtacagatagtcgtttaaggacgcgagattatgattctcatagagcgcatgttgaagcccggcgagtcgcgtgggtcaatagtacttgccgcagtactcgttaaaactaggcggctatggtataatacgcctcgcactcattctcaaccccctgacaaatcacacagaatatcccgtcacccatcacacggaacatcccatcacccgtcacacggaacatcccgtcacccatcacacggaacatcccgtcacccgcagctgcccctgcccctttgtggccagctccccgcctggttcgtctcttctggaattccacgtccatgaatcacagcgcgtgttctccctgctgtggaattcttttacccaacataatgtctgcgtgactcatccccctgcagcctcggtcggagctggcctgccatcgatcctgttgtcctccccattttttagataaggaaactgagagttagggagggcacagatggaagagg

SEQ ID NO: 253021 - DNA, 983 bp, Homo sapiens
aatcaattaaaataattgaaagattgtgttgaacccagctcttttcttttttagagacaggatctcactctcacccaggctggaagtgtggtggtgtgatctcagctcactgcatccttgacctcccgggctcaagcccacctcagccactgcccatgtccccctgggcaccatgacacccagcgtgtgtgtatgtgtgcgtgtgtgtagagaaatacaaatccgtgtgtgtgtgtgtgtgtgtgtgtagagaaatacaaatccctcccaaagtgctgggattataggcgtgtgccaacgctggtggcccagcatttttcctgtagattttttgtccccctagaaatgagttaacattctttaacagtagagaaaatgtagacggaaccatcagacattcacaccacaagtaaaaaggaagtgattggtatcatcttctcagtgttggaggtggcattgtagtctagtggaatcagtacttacattaaaagtattaccttaagtactcaggacttaaatgctgtttttcttagtagtatctgtctttcttaaaaaaaaacataatcaacatagtgaatgtaatggtggtctctcattttgtgttttctagttctgagaggtaaatggcattacatcaagtgtattacttggggtgaatgttcataatcagaattcagtgttattttttctggagtcatttgaaaactgaaatttagcagtcttacaaaagttgcactttgggaacatgctctcacatcgagccattttctgctttcccatactctgttcatagtagtaacagctcttgctggataactaagtctatatggaacttttattcattgaatgttcaaaatatatgctaggcatgatgctaagtgcttcatgtatttaattcctgaaacaagccaataattgggtaataatctccattttgtacatgtaaatattaaggctaggcaagggttaagtagattacttaa

SEQ ID NO: 253022 - DNA, 6473 bp, Homo sapiens
gatcaataaggtctcgaccccgagccccactggatgatagaggtgggcatcacctctgtcctatgccatagccttgtcccagcaggaggtgcctacctaggctctgagagtgcctgccaggaaggggtgcccccttaaaaataaccccaactccttctaccccgaagtccttggggagtgctgggtctgctgatgggagaagctgcagaatttgagcccggaaggtggtcctgacagcgaggggggaggggttggtgtaacccagaaggaatgcaaaccctgtactttgttcccctacccttggaacaagagactttcctaagtggatcaaaatgtcccccctcaactttgggaggagggctctagagggaaaggttacatgggggaggtcctcgttccagcgccgccgagagggcactggggtttgttgaaaggcactggagccctcacctggacattgcagggggcgggggttggaggctggggacctaaggtaagcacccctttccctgggaatgcgcagaacagagagacgcggcagggtgaaggagaggactgatgagaagggcttgttgggaaaccctggctccgtcaggaccccaccctgcgagctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttcacgaacgtactggcggtcactgctcggggaggggcacggccagaacgccctcgccggttctgcccctttgggtggcagagcaagggtgcccgacgctagagagtcgggtctggcaggaggaaggaggccgctgcccctcgcactggctgggccggaagtccttgccctggctccccacttcccagaatcagaccctccaaaggagaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagccgggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgccccctcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatgggagtttttcattttcgtgttttaagtgcagagaatattcgagctggagcgacctcggagatcactcacttcggtggttttgaaacttgtgtgtttttctttttcttttaagtaggaaaacccttttagaggaaacattatcaccctcctaaaatcccaataccttgagcaagatgatagatcttaaagtaaagctgccctggtggatgctggggatgaggcccacatcgagcgctccttccacacaagtctttcacaacctcaagactgctcccttcctccgcagctagtattgtagctggggttttgtttttccaatagccccgattatatggatcagctgcgatgtgtcaagcaggatgctggctgctgcttcgcagtcctcattcatgctgcaagatagatttaagaccttcttttcacagattaggaaactgaggttctgaggtttaagacttgttaatgacagaagtacaggctccttccgctccctcctagttctgccccaggctcctctttccgctgaatcttcctttcctctctctggccgcaaagaatcccttgggcagggcatgtgagtagagaaggacccaggtcatctgagtgatgcctcagatctgcctgctactctgatatttcagaacgtcagtcacagacacacttgaacttcactacactctggcaagatgggcagaggacggagtaggggaaggaggtggaggagcttaggggacttgcttagttaggtgcctggtttatagtggtgtgtgacttcaaaggcagagaccgacaaaatagaggctgtttagttctattaactgggtttcctgggatctgtagaggtatttaacctaggcagttgacagcctggcttaccaccttgcccgcctccgctatagccccaggccaccaggaattcatttattcatgcatccaacaaatgcttattgtacactatgtgccagacacggtgctgagcattgggaaaacggccctgagcttggtagaggagtcccctgcctctatggtgtttaaggctcagtgggaaattgatgcttcatttagagggaggaaggggctattatctctctctggccctaactgagctaggtgttacgccatgtgctttatctttcttgtcttacagaatccttacaagcaccctgagaagtaaaatgaagtccattttgtagatgaggaaactgaggctcagagaggctaggtgactttgccaaggctgcagagtcattgaatggcaagcaggaattcagatacagggccctctgactccctggcctgtgcttcctccctccatgctctgctgtctcctggtgatcatttcctgagccccagccacatggatgtgtccagtctcctgtctggatgcctgactccttcccaaacccacactgaaatagaatcatccagggtgttcatctgcacagatgggagagggagtgtccctgaaagctattgccatcaccaagagaatgaataggcatctgctgtgggcagggcacatgtgaaaagagcaaggcctatgagtgtgatcctcatcccagggcagcgagagactgggcatgtttccgaaaagatgaacgacaatctattttgtccatcctccctctccacctcctttcctcccccatccactcctgttcccttcctctcttttttctttttgccttcttttttctttttaaataaaaggaggttcaggatcttttgtaagtggaggaactgggagtttcaaaaccaggtctgaagcaatccagagacagctgctttttcatcactggaaagggagtacagcagcccttactacttgtaggaggctgcaaagctgttcatttcaaatgataaatgtcagtggtggtaaaacacatgagatcacttcctaggaggtgtccttctttaggatgaaattccagggaagattggggtggtgagatcctggaacccacctttatgctacagtgagctccaggagtggagggggctcatgttcactaagacccccggctaagattccatggatggagcaataaaggtagtgtgtatggggctggagatgcaggccctgttcagtcacctctgcagcccaaaagagcaggagagacaggtcgtgggcagggtgtggcttgggggtggggtttttctgagacccagactttagtcccctcccaggaaaggaatctggtgtttggtttttccaccagcctttgttacatcttctggccacatactaaatttgctttgggaaatcacaccaaccccgcacccccacccccaccccacccaacacataaattgcatgacatcttggtgggtgaaactactgggtaaggcatccccaagatgggccctggaatctgaatattgagcagagtgtcacaaagactgagagacactagaatgtcccccttgcccctgggacccccaggaaaccgtcctttgttggtttcctgagactgataatgatgggacctatctcccagtgtactgagagggtggaatcaggcattacaagcagagctcttagctcagtcccgtgggctctgatgcttgttactagtgttaaccatggtaacgatgagtacccgctgaagcagccccagtccttgcgttactcgactttttcgtagtgttctcattggttacattttttggcttgagagtctagtgtcaatttctgctgcttgcaaggaaaggatcccatgtgataacctctctaggtgtgatgaccagtgccagccttggagttgccagtcagtgcactcttggtaatgcacagaggatggttcatggccctctggctgggggtgaccaatcccaccgcctgccctctgtctttccctggagtcttgaggcccattgagtgcagtgtgagactcaagttgttccccgctagtaaaatgtacagatggaggccaatcttatagtgaacttccaatcccctgacccactagaccctgctccacccaggcagggaccccatctggttctgttcactgttgagtcctccacaaaacacatagcaggtgctcagtcaggttgtttgtttgggtgattaggctacctctggccttgcgacatgtgcaacctggttttgaaaaagactgagcatgtggctttctatttctatggaaaattgtgtgaaaaggcttatagcatgtggaattgaggctggacttgcaggtggacttcctggcagcaaagatgttctgatcctggaactacattctttctttctgcagtttctccgataaagtagcagaggccctgactagatatcttaactctctacctgctggcagtacttgaaaatgcacaaaacacttccacgcccattattccatttagacctcacatcacacagggagacagctagtcttgtacctgttgaacagatgagggaaaatgaggcccaggaagatgaaaggatggcagtaggcagtggctggactggaacccagattctgtggttgcgagctcagccttcctcccatcctcaacccattgctggacttcatttagccacaggggtctggcatgagacaggtcagtttcccatgtgcttacaggccagtaagctttgatctcaagtgtgcactgtgagctgtgtgctgctgtagccactttgctgctgtgacttcctctatcctccactgctgtccaggtgggtgttatatccccagtccacaggtgaggacactgacatgcccagggtcacacagcttgagacaagagctcactgtctcccctgtctccacagtcttgtcctgctcagagatttctggccttagcttctccatcctccacctcctcccccacttccgccctttcttggctcagagagcagacatctgccctcagctagcacagtccctggctccccataaggctttctccaagtttctgctcacccacatcctccctccacagccccccaccacacacacacagactcaggtgtgccctaagcatgttggcagcagtacttttggcaacactttgaaagcagccctccttggggctggagatcgttggggatagtctccctcctgaacagagctattgagggtgagcatctctgcaccctcggccctggcaccaggcctggctctgagcacatagatcctgaagatgtgtttgttgaatgaatgaatgatgtctcccctgagcctgaggtttggttcaaacaccagacccaggcttgtttcctggccctgctcagttgcctctggaagtcctttctggtgtgagaatgtgtccattgtccttctccattccatggaccacagtggcatcacagctggcatctggaggaagggccaacactgcaaggtgatgggaagaccaaggggacttcgtgtcccctctatgttctccttggagaggggactgtcctagatgggtgatggggatttgggaaggtaaagaaagaaggaaggagggaggaaaggaaggaaaaaggttgagaagggagggaggaagacaggaaggaaggaaggaaggaaggaagaaagaaagaaagaaag

SEQ ID NO: 253023 - DNA, 420 bp, Homo sapiens
gcttttcattttgaaagtgaccgtgttgatagcatgcgtgctttcagtatgactaggacagagatgttaagagtttgcgatgcgtgtcttttatctgatagtagagacgctaataattctattaacagactttagatctagcgacttcatggcctcagtgatcatctggaatttacgcatagtgagaaacaatcgcatttatttctcctttaagcccaagtatcttttggttaatgaaatactaacaaaccagtggtatcagggaacggaaagctcctggcagtactgcatttgaaacgtctggaggtggtgatgcttcagccaggaagcaggttcatcttcccagaagatcttacggatcccacagtgcattgtgcatagtgccgtggggctgcagggtaactgaggtggtgcacagag

SEQ ID NO: 253024 - DNA, 703 bp, Homo sapiens
gagactccatctcaaaaaaaaaaaaagttattaaatcaatgaataatatgtccaaattatggatcaatttgcaaaggttaaggaaacattcattcctttattccaaagcatttcttgagcttcttatttgtatgagtcactgtggtaggacccaaatatacagagacaaacaaccagaagctttgctcaacagtgactaacagtggagtgggaatgttttacaaataaattagtgacaacacaaggtgaaaatattaaacacaagtattaagttgttgttatggagacaaagagtaggaggacaggagagaaaaatcccccaagaaggtcaggaatttccaagaagaggtggaatttgttattaatcttaaaggatgaatgaattttccatagcaaagagagatagagaaggaaaatggtgatgtcagagaaatgtcaaatggtgatgtcaaagaaagaatactcttgaaggaagagaaggcaacagtttgacatttgacttgggtaagttcagtcttagattggtaggtttttgttaatgagtatagaaatacaactgtcaatttcaggtaatagaatgtacaattatgagtcatcagaaaatacatgttatgtgaacccttgatatacatgtttatgtaaaagatataaagaaactcatggtagaaccccaataaaaacaatatttcgggcatggaggaag

SEQ ID NO: 253025 - DNA, 675 bp, Homo sapiens
tgggattacaggtgtgagccaccgtgcctggctggatactttttattcctactgattcgctttcctttctcttctctgatagtaaattttttatatcctgtctttgtgctcactgattttcctgcttgattcattctactgttgagagcctctaacgcatttttttttcaatttagcaaatgtatttcttagtttcaagatttctgtttgattttttacaatgtttcaatctgttttttgaatctctctgatagatttctgaattgcttttctgtgttatctttgagttgctgagcttctttaaaactactcttttgaattcattatgtgagaatgcacacctttctatcttgttagggtcagtcactgacattttcctttgtctttttgaagaggacataatttactgcttcctgtagtgtgtgtagtgtgcgtgtgtgtgtgtgtgtttgtgagtgtactttaatggcttcacaataaaatattaattacttattccagtcttcactgcctgacttgttttggtctttctcaggtatgtttgcttagaggttctctacaggtgtttgtgaatcctttaaatcctaaattgctgttttctttttggaactagatgacaccttaagcccaggtatgcctcttgcaagtttggcttactgcctgttccagatggtt

SEQ ID NO: 253026 - DNA, 375 bp, Homo sapiens
cgaacaaaaccatctggactctgctgcatggccccgtctgtggctgctgtagctgcccgtgggaaggccctgcctccagcttctgcccttggctgcgaaccatggagtcccggctcccaggcctatccccgggatgatgcactagacatttttgtggcagggtgcagaacaatggattccccctgatgcttgctttaagcatgaatttttgttttgcaaatgcaatcctgggaaggaagggagtccaccaattagtgggaacagctcttactgactaatggatggttaactttacaagtggaatgatttttacaaatgagctacaatatgactgtaagtagaaagtaaaaaagcaaatctttttcatcctgcaaa

SEQ ID NO: 253027 - DNA, 600 bp, Homo sapiens
aagatatatagaatcttagtttggcaataatttaaaacattgataaaggcttatttaaaaagtgtgggtgaataggttctttcaaacattacgatcttgttgctgactagagtgtaaattggtaagtctttgtctcaagaacattttggtaatatagacatcaaaagccttaaaattgggtaacccttgaccttgaagttccacgtctaagattttatcttaaggaaaaattagcgtaccaatgacgtgcaggaagttgttcagtagatgatgtttataatagaggttaattggaaacagttccaatgaccatctgtaaaggatcgatataataaatcctggcatattcaaatagtagactcatacatagctattaagaattatggagatccagactgggcagcatggtgaaaccccatctctacaaaaaacaaaaacaaaaaactaaaattagctgggcatggtggtgtgcgcctgaagtcccagctactgtggaggctgaggtgggatgatcacttgagcctgggagttggaggttgcagtgagccacgatggtgccagtatgctccagcctgggtgacaaagtgataccctgtctca

SEQ ID NO: 253028 - DNA, 393 bp, Homo sapiens
gattcatttgctctggttcctgcactcactcgcttgcacgctccctcctgccaagagtagccagtgcgggctgagtggaatgagctactccagtttccgcccacgaaggagttcaagagaactaacccgtcccaataggaaagggaaaaaaagcagagtggaagaaccatgtttaacctattaatctttttgcttctgtaatacttagagtttcctgatttttttgaaaaataacttgaggtgatggctagctttgcttaatgaacaactcaagcataattgttaaaaatgagtaaattaggtgtatgtaaatggtatacaaattgataaatgaacttttcagttttgaaaaccttttaccgtaacttaaagtcctgttatgattaagtaata

SEQ ID NO: 253029 - DNA, 587 bp, Homo sapiens
gactctcctagatgttaggtctctgagatcatagtaatgcagtcagcaatgaaacctacctggttaattagagaaacacagctccatcaatgtaagagagaagtctgggctgccgagtgtctgacgggacaaatccttccaacggccgcagcaggtgcttcttctagccctgtgttgcaatgacctgcagctcctggggataactcaggcacgctgctgacgccatcaggaggctcaacaccctcacccgcttacgctacgaccagcaaaagcaaaccccgcagctgcctgccagccgggaagaaggactgtgtttccatgttgtgagtctcctcattgcagccagatgatgaatttgctgctggctttgtgcgaaaccgagaaatacccagcgtccagctgagggcccgggtggcaacaaaatcaagctgatgaattaaagaaatatggcctggtcaggatgcctggaggcctcagagttctgatctttcttctgagttactacatcttctgaactgctcccaggatggtgtttgtgataagttggtttgcccagtaaaactgtcgcccagtggaggcaagcccta

SEQ ID NO: 253030 - DNA, 610 bp, Homo sapiens
ggctggagtgcagtggtgtgatctaggctcactgtaacctctgcctcccgggttcaagtgattctcccaagtagctgcagttacaggtgcccgccaccatgcccagctaatttttgtatttttagtagagacggggtttagccatgttggctaggctggtctccaacttctgacttcaagtgatctgcccaccttggcctcccaaagtgctgagattacaggtataagccactgcgcccagcctatagtagtgattctttaaaggaggtgggtagatgacactgtgatacctgtctttaatgcacccattctgtgcatgtagagactgaggtggttgtaaaattacagtactgaactttggaattaggtcaattcttctcattatgataacggttttggatgtatagccccttctgactcctggaatcctttatttccacagcacttcccatgtatccaaacagaggaaaaaataattagtagtatagtgcttgcttcagcagcacatatactaaaattggaacgatgcagagaagattttcatggtccctgcacaaggatgacacataaatttatgatgtgttccatatttattattatttttaataat

SEQ ID NO: 253031 - DNA, 375 bp, Homo sapiens
gtgatttctttatttatttatgacaacaggaaaatcttatttttaaatacttataaaaatccagagttgccctcaaagcatttggtctgggaggtgtgtatcagaggagttgccttactttatcacccactcctacccaccccaggctcttctcacaactatgagattctatgaaacacataaagcctctgtattatttccttttattgtcatattcctgcagtttactatagaagactattggactggaagtcaagagagctacgctctagtgctggcttggctgttaacttgctttaatgttgagtaagccgcactctgtctttgggtctcagtttcttcatcagtgaaataaagaaatttgtctgtatgaat

SEQ ID NO: 253032 - DNA, 444 bp, Homo sapiens
gcttgcagagcttcttgtttttccatgctgtgatgggacattagctaagcacacagaacataatttcctatggtgtgtcaggcctttctcttaggtctgatgaggtctaaggataattatgtgcaacaacctactgtggcagagaaactgaattatcagttacatctgagagtcttctcacaaaagaatgtcagtctctcactgctttatattagctaatctctagacggactttcctggttgaagcttacttttttcatcagtctcttatcaagaatgctctggttaagaactaattcatattacggacatcattaatatattgtaagtatccataaatataaattttaatattaaatgttaatagggatattacatgatattggcatactatataatgtgcttatatatatttatttcaaatgttaactgaatcagatcttt

SEQ ID NO: 253033 - DNA, 296 bp, Homo sapiens
ggaggtggaggttgcagtgagcttagattgcaccactccactgcattccagcctgggcaaaacatagcaagactccatctcaaaaaaacaaaaatgaaaacaacaacaacaaaaaaacaaacaaacaaaagatttaaccctctaggttcaggaaaaatccctgagaaagagagagcaaagcttctatactctgcctaggatttctttctctttccgggtgaaaaataggtgttgggatgatactgagttgataaaagtatttaggaaaagtggccagtgtctaaattcaagccatt

SEQ ID NO: 253034 - DNA, 402 bp, Homo sapiens
gcacattttgtagctggagagaaagaaaaagaagatgaaagaaaaatcttttgaagactgaagaaaggggaaatcccactaatatagtgaaaccccttaattgttttccaagagacagaaaaaaaacactatttaaaggtcacattggcttgtttgaattcgtttggctttcagaagataaatattgtgtatgggaatataagaatgtctgctagaaaccacttttgcacaatgaacaaaggaatcatccctaatatgtgattaactgacgttccctgctcaccacaaatgttggctttcatagacttcaagtgaaggggcactttattaattggctgaagaattccttagaacgcctaagagattaagaccacaggatgcttcaaggttctttctttcttg

SEQ ID NO: 253035 - DNA, 471 bp, Homo sapiens
tccacacttaatgtcttataatctctgccaagaatttaaaaatttttgttggtcggacaggaagaggaaattccatggtttggtgaacccagaaattgttcagtacatctcggttataaaactgtgttaaatacacttaaactctataattctataagacccattttaggtttatacactgagcatccagttcctcaccgtcctctcataggttaaccctgtgtaatacaagttctgctcccataattctatgaacaaaacagcccttgatatataggtttgattttttaaatacattttctttactttattctaaatgtaacataaggtcaacatagaaaactgaaaagcataaggaaagtgaaatatctgtaatcttatcaaccattgttaattttgctgtattcctagtttctttttatacatatcaatatggtacttttgttttaataaaaggactgccaaaaggca

SEQ ID NO: 253036 - DNA, 355 bp, Homo sapiens
aggcaatataaagctgggtcctaagactaggtttcatttatagcttatgaactattgccagacattttctcttacttgaattttaaaaaatgatacaaggaagctaggcatggtggctcccatgtataatcccagcactctgggaggctgaggcaaggggattgcttgagccgaggagttcgacaccagcctgagcaacatagcgaaaccccgtctctattaaaaaacaagatacaaagatttgagcgtacccatctatgctccagaaacactcatttacactttgtgatctatcttgctagcactgtattatcagattatgaggaaaaatataaattaatatcaggctaaaaaa

SEQ ID NO: 253037 - DNA, 509 bp, Homo sapiens
tatatacatatattcccactgaatggatatgcatgaagattatgcatagtttaatatcagttcaggtcaacttttattgccaaataagttacaaaaaaagatttgttttttagaactttttggattacaaaatggtgatagggattgtggacttgtcttacttttagttatatacctattgagagtctgttaaatttttttactgtaaataatatttcccatattcccaaaggttggaaaccacaatcacataagcaggggtcacaaaccgaagtgccaggttgggtaaaataaataagtgaaatgggaggcgggtataggacagtagggaatgtggggactgcagtgaactggtgaatacatgttcattcaaaggggagagctgctcttcagttctagccacttgttgccatggtgaacgtgggagtagtgaagctacatcttccatttttgatgatactccagaatgctgattttcatgtgaagtttcttgatatttaaatgttggc

SEQ ID NO: 253038 - DNA, 114 bp, Homo sapiens
ctaactttgactttcactcttcgccaagggcttgcagaacaccttaaaggaaaaaagatggaggcgcttagagttcagatgttcatgccatgctcctttgaaagcttgtatctg

SEQ ID NO: 253039 - DNA, 479 bp, Homo sapiens
gaagagtaaaaatagtgtagtgtacttcaatcagcccgtcttgtactgtgcttgctgacaaaccatctttgatagtaatggccttcagggataaagaaaacacctggcaccacacttccagcatcgcatgtctacttggatatttttctttattacttatatcttatttttttaacactttttttttaaattataagaatcatgtatttatactttctcagtaaaaaatgtagattatagagaaacttgaagtccccctggatgcttcttctaccttcttcaatcctattgtctccctcaaggaaaccactggcctcatattggtgtgtttccttcagttttttaatacataaatgcctaaaaaggtatttatgtattaaattttaggtatttatacataaatacctaaaaagatgaatacaaaaggtattatgtattaaattgttattaatttatatataaatagctaaaaagaaata

SEQ ID NO: 253040 - DNA, 291 bp, Homo sapiens
tattttcctaatattggtcattgatgattatttgtatataagccactttcattaggttgagtcatgtcttttttgagttaactgaatttttctgaatttctcctgtcatttatatattgcttcaaaggaggagaacgagatggagacatttggtgcaacggtaacaaatgaaattagctcttatatagctgatcataggataaaaatgagttttgaggttatagctgatcagaaactgtagcaatatgaggggacttcagaaggttcatggaaaaatggaattaacagata

SEQ ID NO: 253041 - DNA, 320 bp, Homo sapiens
cagcctgtgcggggcaggcgttagactgcagaaggggagagcttaggataaccgcactcaggtggcgcaaggaagtcagccacgaagaaaaagaaagggaaggaaaaacatcgtcccagactgataaactctctgctccccggtgtaacgtcgctcagtatagcgagagcatggatggacgaatgaagccctcttgatgcagactatccaaaaatttaatttacaaagggctccaaaaatttaaattgcaaaggttccagcagtgtaaaagcctcagtcagaagagtggtcaataaagtagcacatcacctctggttaca

SEQ ID NO: 253042 - DNA, 179 bp, Homo sapiens
gaaagagttcaaggggaaaagaaggctaatacagtatgtacttaaaaaaagtctatagtgatactagtgaatacttatgtgttgtaacgagaacatttgtgattactttgagcttggggaaatattatttctaagattactttgagcttggggaaataaatgtaaggttggctaagaca

SEQ ID NO: 253043 - DNA, 1115 bp, Homo sapiens
gacttttattttaattaattttgtgggtacatagtaggtgtatatatttatggagtacatgagatgttttgacacaggcaagcaatgtgaaataagcacatcatggagaatgaggtaactatcctctcaatcatttatcctttgagttacaaacaatccatttacattctttatttaaaaatatacaatgaagttattactgactatagtcaccctattgtgctatcaaacagcagatcttattcattctttctatttttttttgtacccattaaccattctcatcccctctccaatccccgactacccttcccagcctctggtaaccatccttctactctttatgtccatgaacttaattgatttgatttttagatcccacaaataagtgagaacatgtgatgtttgtctttctgtgcctggctttgaatatactagtaatagctatgtttctgtcactttttggatctaggtaaaatgaaaaagggcaaaaaacttactgccttgggaaagaatactagattaaaagatgacactaggaatactgctaaatccttgcatttgcttaaatgttgccatcaaggagaaaattcaaacctcaaacttctgacaagtgaagcctggtaggtggggtgatggtggatgatctggatgctttcatcaagagtctgggaattaaatgcctataggcaggcagatcaagtatgtaggtacagcaggcaggatgtcagacgattgacgcagggactcactctgtggcagtggagagcatgccaagtccaaagacttattcaggatgaattttaacaatcactgcaagtccagcaaaacagccctgtgtgggcagatgctgcccacaagccaccgttttttgaagtatgctttcaatgggttaaaggaacccgaaaagaactccctactgtgatcaccagaaaatgtaggtaacccttaagaaccaatgggaaataaaaagaaatgccagaaaattggagatagataaaagcttttcctgatatttaaaatttctagattctagaaattatgtaaatttgacacaaattctgggcagcattataaaatggctcagtagtaggtaattaaacagacggtatttt

SEQ ID NO: 253044 - DNA, 350 bp, Homo sapiens
tgtgcaggtttgatgcataggaaaacatgtgtcctgggggtttgttctacagattatattatcacccaggtattaagcctagtacccattagttatttttccttatcctcctcgtcctcccaccttccaccagggcctgttggggagtgaggggtgaggggagggaacttagaggacaggtcaataggtgcagcaaaccaccatggcacacgtatacctatgtaacaaacctgcaggatctgcacatgtatcccatttttttagaagaaacaaagaaaaagaacactaattagcatatagaattaaaaagtaaaaataaagacaaaaccagaaaaggcagaaggaaacgg

SEQ ID NO: 253045 - DNA, 355 bp, Homo sapiens
cccaaaccagacgcttttccagagaaagacaaatttgccactgatgtttcaactgtctatcctctggagtaatggttcttaaagtgtggccccctttgagagtgaagaagatatcttcataataacacaacctttttctctctcattctctcagaagtgtatatggagttttccagaggctccatgacgtgtgatgatttctctgacagctaatggaatgtgtgaaacagatctgaggatacagctgtcttcaattaagccagacattagttgcagaaatgtaaaacaatgcaactcttctcactaaataattttgtaaaagtattttttcataaaaatatgttatttagcagat

SEQ ID NO: 253046 - DNA, 413 bp, Homo sapiens
atttatagttgtagtgatttatagtatgaaaactgatttgactttcacatatatatgtgtgtgtgtgtgtattcagtcttatggaaaataaagcatatctttgactttttttttttttttttttttttgagatggagtctcgctctgtcgcccaggttggagtgcagtggggtgatcttggctcactgcagcctttgcctcctgggttcaagcgattctcctgcctcagcctcctgatatctttgactttttaatagtgtgtttaaggatagcagtgccagcccaaatttgctttttcattaatatagcaatatttggggtatataacatataaattttcacatttgaacttaaatatggcactgtaacaatattgtcttaatataagaagtacaaagtgactgaaaaaaaaa

SEQ ID NO: 253047 - DNA, 370 bp, Homo sapiens
gccgagcatacacagagtataggaaaaatacgtaaaacagatctttattttgaatttgaaccatgcattctattatgggtcctactccaggtgttgtcccattgtattccaggtgcctttcccagtttcccagggtgcaggcctggtaattgattctctgagtgaccatgtggtcactcccttgtagccagttgacctctctgactctgaccttccacccatcctccgtttccttcgatcctccagaccttggaatctcttctcctcctggcaaggactcctgtcttggatgaactttagtcaggctcctctgagcccacagctaggcctcatccttagtcctggccttggcctgctgagcccagtttta

SEQ ID NO: 253048 - DNA, 801 bp, Homo sapiens
ttttaagaaattaggctaagacttctaaaggttaagttggagttaagtctattgaaagtctccaagtctggaaacagcatgatgttttagaagaacatactttcctttatcagtttgaaaattttgcttatttaaaactaatttcctattagtctcttgttcctcattcccatttacactcttcattgctgtcctggattattacaaaagcctgtttgtttgttttttttctttttgtatctttctagttcattctgtccattgctacttttttataaagaacatttcactaccatatactttctgttccagccacaggaacctgtttgcaggtccctgaacctaccttcattttctagtgctgtgcatttcctcatttctttcgtttggaaagtggtgagaaggtcctctaacttgcttcttgccctcatttctctaagcagagctacaactttgtcctgtctgttcctctggcacttcccatcaccgtgatagcatacttcactgtggctggtttccattcccatttcctctactatagtgagccacttgaggcgagaacccttgtatttccaacattggtgtactcagcatcttgcgtcgaggactcagtaagtattatatttgaattcccactgcaccgctctaattagaattttaaaaatcactttctatctggattgttacacactttttttccccttaattcatttttctccatgtactacccatatgcatcctatataaatttaccaacactcataaaaatcttactcagaaatcttcagaggtttgctaagg

SEQ ID NO: 253049 - DNA, 416 bp, Homo sapiens
gctttcatccttcctccaaccatgtatgcaggtgcgcgggggcggggtgcattctctatgtgggaatcatggaattttgctgtttgtagagaccagtctcccacctctcaacagaatcccctcctctttctgaagacctcttgggaatggggagcttgctgcttcccagggcagctgatcttaggcctggccagagtcgattgttaggaagctcttagaccaaccataaatcctcctcgcagcaccctcccacccgcaaatcacatttcatcactgattgttgtgttcctcttgccttttgaatcagggcagagcattgtcaacttcctttgctactcacagcacccttgaatgttatgagagagtgctcttaggatggaagggacttggagtaaaaatcaaggaactgaatccta

SEQ ID NO: 253050 - DNA, 3939 bp, Homo sapiens
ggtcagggtagttccccaaccctccctttcgtgaattccccctcgtcctcgctcaccttaaaaccatcgtgcatcaccatggcgagttgctccttcactcgcgaccaagcgacaagaagactaagaggtgcagcagcggcggcagcggcagctctagcagcagtggtgaccaccccgcttctttcctcgggaaccccgaccgcactcattgggaccgggtcgtcttgtccgggagccatgtggctctccacggccactggctcccggtcagactccgagtccgaagaggaggacctgcccgtcggggaggaagtctgcaaacgcggctacctgcggaaacagaagcatgggcacaggcgctacttcgtgctcaaactcgagactgctgacgccccagctcggctggaatactacgaaaatgccaggaagttccggcacagtgtccgcgccgcggcggctgcagcagcggcggccgcctctggcgccgcgatccccccgctcattccaccgcggcgcgtgatcaccctataccagtgcttttccgtgagccagcgagcagatgcaaggtaccgacacctcattgctcttttcacccaagacgaatacttcgcgatggtggccgagaacgagtcggagcaggaaagctggtacttgctgctcagccgcctcatcctcgagagcaagcgccgccgctgcggcacgctcggcgcgcagccggacggagagccggccgcgctggcggcggcagcggcggcggagccacccttctataaagatgtgtggcaggtaatagtcaaacccagggggctggggcacagaaaagagctgagcggcgtgttccggctgtgtctaaccgacgaggaggtcgtgtttgtgaggctgaacaccgaagtggccagcgtggtcgtccagctcctgagcatccgtcgctgtggacactcggagcagtatttcttcttggaagtaggcaggtccactgtcatcggtccgggagagctctggatgcaggtcgatgactgtgtggttgcccaaaacatgcatgagctgtttttggagaagatgagagccttgtgtgcagacgaatacagagcccgctgccgcagctacagcatcagcatcggcgcccacctgttaaccctgctgtccgctaggaggcacctgggcttggtgccgctcgagccgggaggctggctcagaaggtcccgctttgagcagttttgccacctcagggccatcggcgacggggaagacgagatgcttttcaccaggcgcttcgtaacacccagcgagcctgtggcccactccaggcgaggaagactgcacctgcccagagggcgcaggtcaaggagagcggtttcagtgccggccagcttttttcgccgcttagcacccagcccagcacgtccccggcaccctgcagaagccccgaacaatggagctcgcctgtcttctgaagtgtctggttctggctctggcaactttggggaggaaggcaatccccagggcaaagaagatcaggaaggaagcggaggtgactacatgcctatgaacaattggggctcaggaaatggccggggctcaggaggtggccagggctcaaatggccaaggctccagtagccatagctcgggaggaaaccagtgttcaggcgagggacagggatcccgaggtggtcagggctcaaatggccagggctcaggaggaaaccagtgctctagagatggccagggcaccgcaggtgggcacggttcaggtggtggccagagacctggaggtgggcatggctcaggtggtggccagggacctggagatggccatggctcaggtggtggcaagaactctggggggggcaaaggctcaggaagtgggaaaggatccgatggtgatggtgaacgtggaaaatctctgaagaaaagatcctattttggcaaattaactcaaagcaagcaacagcaaatgccaccacctccaccacctcctcctccacccccaccagctggaggaactggtggaaaagggaagtctgggggaagattcagactttatttttgtgttgacagaggagccacgaaagaatgcaaagaagccaaagaagtgaaagatgcagagatcccagaaggtgcagctcgaggtccccacagagccagagcttttgatgaagatgaggatgacccatacgtgccaatgaggccaggggtggccacccctcttgtaagctccagtgattatatgccaatggctcctcaaaatgtctctgcttcaaaaaagcgccactctcgatccccttttgaagattcaagagggtacatgatgatgtttcccagagtgagcccaccacctgctccgagtcctccaaaagcacctgatactaataaagaggatgactcaaaggacaatgacagtgagagtgactacatgtttatggctcctggagccggtgcaattccaaaaaaccccagaaatcctcagggtggctcttcctccaaaagttggagctcctacttctctctaccaaacccttttcggagctcacctttgggacagaatgacaacagtgagtatgtgccaatgttacctggaaagttcctggggaggggcctagacaaagaagtctcctataactgggaccccaaagatgcagcttcaaagccttcaggtgagggatcattctcaaagcctggagatgggggatcaccttcaaagccttcagatcatgagcccccaaagaataaagctaagagacctaaccgactttcttttattacaaaaggatataaaatcaagccaaaaccacaaaagcccacacatgagcagagagaagctgacagctctagtgactacgtcaacatggacttcactaaaagagagagcaatacaccagctccctctactcaaggactaccagattcgtggggcataattgctgaacccagacagtcagccttttctaattatgtgaatgttgagtttggagtgccatttccaaatccagcaaacgacctctcagatcttttaagagctataccacgtgccaaccccttatctctggacagtgctaggtggccacttcctccccttcccctcagtgctacaggtagcaatgctattgaggaagagggtgactacattgaagtaattttcaactcagcaatgacaccagccatggctcttgctgacagtgccattcgctatgatgctgaaacaggtcgaatctatgtggtcgacccattttctgagtgctgtatggatatttctctctcccccagccgatgttctgaaccaccacctgtagctaggctgctgcaggaagaagagcaggagagaagacgcccacaaagccgttctcaaagtttctttgcagcagccagagccgctgtctctgcttttccaacagacagcctcgagagagacctttccccatcctcagccccggctgtcgcttcggctgcagagccgactttagccctcagccaagttgtagctgcggcctccgcgctcgccgcagccccgggcatcggcgcagcagccgcagctgctggatttgactccgcctctgcccgctggtttcaacctgttgctaatgctgctgatgccgaagcagtaaggggagcccaagacgttgccggtggctcgaaccctggagcccacaacccatctgcaaaccttgccagaggtgataaccaggctggcggggctgccgctgcagctgccgctccggaaccaccacctcgcagtcgccgggtgccaagacccccggagagagaagattctgacaacgacgacgacactcacgtgagaatggattttgccagacgtgataatcagttcgactctcccaaaagaggtcggtaattttagaattaatttccctaaagtgaatggtcattgtctaatgattcgatgcgctacagtctacagtgttagggtatatttcattaa

SEQ ID NO: 253051 - DNA, 550 bp, Homo sapiens
tcattacagaaagttctattggacagagctgctctaagggataacctctcatttgtgtgagcctgcctcttgttcaactcttgtttgcaagtacactgattttgcacagtgagtgtgttctgtgtgactcctcactaaatgcaagctctgtgagggcagtgattttgctcttctgttctcagcgatgtgtacagggcctgatgggagaagatgcgccaccagcaatatataagggttccaatttctcagtatcctcaccaatatttaatattgtcaatgtttttttattataactattctgttgggtgaagaatggtatctaattgtagctttaatttgcatttccctaacaactaatgatgttgaacatttcttatttgctcattagcattctttgttgttatagctattcaaatttgttgtccattctttagttgtcttgttattgaattgtaagatacttctatgtattctgaatacaagttccttattaaatacctgatgtgcaagtattttctccgtctgtgatctgccttttcattttccagta

SEQ ID NO: 253052 - DNA, 535 bp, Homo sapiens
tatttccattttggggctattatgaataatgttgctgtaaacattcacatttaagtttctaagtggacatatattttcatttctcttgggcagatatctaggaattgaattgctgggtcttattctaagtttatatttaattcgctagttttaagaaactgccaaattgttttccaaagtgcctgtaacattttacatacccaccagcaatatataagggttccaatttctcagtatcctcaccaatatttaatattgtcaatgtttttttattataactattctgttgggtgaagaatggtatctaattgtagctttaatttgcatttccctaacaactaatgatgttgaacatttcttatttgctcattagcattctttgttgttatagctattcaaatttgttgtccattctttagttgtcttgttattgaattgtaagatacttctatgtattctgaatacaagttccttattaaatacctgatgtgcaagtattttctccgtctgtgatctgccttttcattttccagta

SEQ ID NO: 253053 - DNA, 111 bp, Homo sapiens
gagactccatctaaaaagaaagaaagaaacgtaatacccattagtggtcactcctcatttatcccaaccccaacccttggcaaccatgaatcccccttctgtagatttggc

SEQ ID NO: 253054 - DNA, 1240 bp, Homo sapiens
  misc_feature (1026)..(1026): n is a, c, g, or t
  misc_feature (1080)..(1080): n is a, c, g, or t
ggcgaatgagaacacgagtgtgtgtggagagagagaacggaatcaagcgaatgagagcgcgtgtgtgtggagagagagaacggaatcaagcgaatgagaacacgagtgtgtgtggagagagagaacggaatcaggcgaatgagaacacgagtgtgtgtggagagagagaacggaatcaagcgaatgagagcgcgtgtgtgtggagagagaacggaatcaagcgaatgagaacacgagtgtgtgtggagagagagaacggaatcaggcgaatgagaacacgagtgtgtgtggagagagagaacggaatcaagcgaatgaagcgcgtgagttgtgtgtggagggagagaatggaatcaagcgaatgagaacgcgagtgtgtgtggagggagagaatggaatcaagcgaatgagaacgcgagtgtgtgtggagggagagaacggaatcaagcgaatgagagcgcgtgagtgtgtgtggagagagagagaacggaatcaagcgaatgagagcgtgagtgtgtgtggagagagaacggaatcaagcgaatgacagcgcgtgagtgtgtgtggagagagagaacagaatcaagcgaatgagagcgcgtgagtgtgtgtggagagagagaatggaatcaagcgaatgacagcgcgtgagtgtgtgtggagggagagaatggaatcaagcgaatgagaacacgagtgtgtgtggagggagagaacggaatcaagcgaatgagagcgcgtgagtgtgtgtggagagagagaacggaatcaagcgaatgagagcgtgagtgtgtgtggagggagagaacggaatcaagcgaatgagagcgtgagtgtgtgtggagagagaacggaatcaagcgaatgacagcgtgtgagtgtgtgtggagagagagaatggaatcaggctcgtgccgttttcctgggaaagttcacatcaaaaagagtgaatgtggtatatttctaaatgatatggaaaatagagacagatttgtcctttacagaaattactgagtgtgaatacanaggtaatatattggatacaaagacacatatgtattgtgtgttcaattattatgntgtcttgagatttaatattctttccaagagctttttatgaaaccgaaagcttagacctcattttcacctggatcattttcaagctcatgaggtgtcacaggctcttgaccccctgatcttgaagccagaggggcttgatgtatggtaacctaattcttgc

SEQ ID NO: 253055 - DNA, 955 bp, Homo sapiens
  misc_feature (923)..(923): n is a, c, g, or t
ggcgaatgagaacacgagtgtgtgtggagagagagaacggaatcaagcgaatgagagcgcgtgtgtgtggagagagagaacggaatcaagcgaatgagaacacgagtgtgtgtggagagagagaacggaatcaggcgaatgagaacacgagtgtgtgtggagagagagaacggaatcaagcgaatgagagcgcgtgtgtgtggagagagaacggaatcaagcgaatgagaacacgagtgtgtgtggagagagagaacggaatcaggcgaatgagaacacgagtgtgtgtggagagagagaacggaatcaagcgaatgaagcgcgtgagttgtgtgtggagggagagaatggaatcaagcgaatgagaacgcgagtgtgtgtggagggagagaatggaatcaagcgaatgagaacgcgagtgtgtgtggagggagagaacggaatcaagcgaatgagagcgcgtgagtgtgtgtggagagagagagaacggaatcaagcgaatgagagcgtgagtgtgtgtggagagagaacggaatcaagcgaatgacagcgcgtgagtgtgtgtggagagagagaacagaatcaagcgaatggaaaacaaaaaaaaggcaggggttgcaatcctagtctctgataaaacagactttgaaccaacaaagatcaaaagagacaaagaaggccattacataatggtaaagggatcaattcaacaagaagaactaattatcccaaatatatatgtacccaatacaggagcacccagattcataaagcaagtccttagtgacctacaaagagacttagactcccacacaataataatgggagactttaacaccccactgtcaacattagtcatatcaacgagacagaaagttaacaaggatatccaggaattgaactcagctctgcaccaagcggancctaatagacacctattccgtactccccaccc

SEQ ID NO: 253056 - DNA, 866 bp, Homo sapiens
  misc_feature (652)..(652): n is a, c, g, or t
  misc_feature (706)..(706): n is a, c, g, or t
ggcgaatgagaacacgagtgtgtgtggagagagagaacggaatcaagcgaatgagagcgcgtgtgtgtggagagagagaacggaatcaagcgaatgagaacacgagtgtgtgtggagagagagaacggaatcaggcgaatgagaacacgagtgtgtgtggagagagagaacggaatcaagcgaatgagagcgcgtgtgtgtggagagagaacggaatcaagcgaatgagaacacgagtgtgtgtggagagagagaacggaatcaggcgaatgagaacacgagtgtgtgtggagagagagaacggaatcaagcgaatgaagcgcgtgagttgtgtggagagaacggaatcaagcgaatgagagcgcgtgagtgtgtgtggagagagagaacggaatcaagcgaatgagagcgtgagtgtgtgtggagggagagaacggaatcaagcgaatgagagcgtgagtgtgtgtggagagagaacggaatcaagcgaatgacagcgtgtgagtgtgtgtggagagagagaatggaatcaggctcgtgccgttttcctgggaaagttcacatcaaaaagagtgaatgtggtatatttctaaatgatatggaaaatagagacagatttgtcctttacagaaattactgagtgtgaatacanaggtaatatattggatacaaagacacatatgtattgtgtgttcaattattatgntgtcttgagatttaatattctttccaagagctttttatgaaaccgaaagcttagacctcattttcacctggatcattttcaagctcatgaggtgtcacaggctcttgaccccctgatcttgaagccagaggggcttgatgtatggtaacctaattcttgc

SEQ ID NO: 253057 - DNA, 421 bp, Homo sapiens
tataaacttatttcaaaatttattaatcattaagattttgccacatttgtttttatcattcctgttctctctctccttctttccttcctttatccccatttagctatctatatatttttcagtaatgttaataggaagaaatgaaaatagatttgtgtctgattcatctatatacttcttcacaaagcctgccaactgccttgtatatatgtaataaatatttatgaatgaatgaatgatgaataatattcaacctagatcttgtctttgatcttttagatttgtgtttgtacataaatataaaatgtacttattatttttctaaacatatgtaatctttcataaaatactaatctaccccccaaaactatgtccgatcaatgggtctaataaacaaacaacaaattttttttttaatgca

SEQ ID NO: 253058 - DNA, 470 bp, Homo sapiens
ggaatcttgctgtgatgagttttaaatgcctcccatactgaatgttctccaacctctgtctccagctccaatctctggatttagagatctctggatagagttcactctatctagctccacattcctaaaaggatgagaaaacctggaggcctctaagcactttatgctgaattggtttgcacccaaaacatcatagtcctgtagaatttcacgagaactatgtgagcatagttctagtttctttgaatggcacatcactccagctgcttaaaccagggcccagaagagtcttaaatgccttctttacccttttactccatgtccatgcagtctacctgctttcagaacccagaggaaaaggatgtcctcatccccaatttacagcaaaagccatgaatttacagatgacagcttcagaattcatgtcaggatatgtgttctaatctgaataaagcattatttccaaaaaa

SEQ ID NO: 253059 - DNA, 336 bp, Homo sapiens
ctgaattctggatcctctgggacatgaatcggagacaaagaaaagaagaaggaatggagccctgagcattaaagaaagtgaggctgaagctatggtttggaaacgacttagggactttttgggaacagaactatatacacttgagctattgcactgttgtcatagaaaaccccgttttcccacacccacagcaagggcctccatacctacaacgctaagtgtaagtacgcctgtatcttggtctgtcaccccaggctggagtgcagtgatgcaatctcaactcactgtaacatgcccccccctggaagatccaaattcctccaatttataattatt

SEQ ID NO: 253060 - DNA, 183 bp, Homo sapiens
gaaactggggaggaagcaagcaagtatctgaatgtcacatagcaggaatggtttcatgttgtaggttttagaattacccaactcagacctagacttgcagtcacgtagtagtgaaccagaactctaggtagcgaaatcgtcatgtgtttacctaaatatctataaatatgatctacaagaaca

SEQ ID NO: 253061 - DNA, 436 bp, Homo sapiens
tttcatgtttcttctgttagactgtgaattttagcacatagcttattcatctttgatggtgcctagtgcattgcctggcatataacaggtactcaatgaatgaatgaatgaatgaattttcctatgcttaggtccaacaaagtacattgtaaatgattatattgtttttaaatctcaaagaagtcttacacctgaaataaatggagcaacagcaattttggagttaagtttttttgttgttgtttttgttcttttttttttttaggctggagagacaaccacagtcccactaggcttgatgtacttcagttctatcaacaactgatttcacttaggataattttatttatttgtttatttatatattattattattatttgagacaaggtcttgctctgttgcccaggctagagtatggtggtgcactcacatctc

SEQ ID NO: 253062 - DNA, 434 bp, Homo sapiens
catggtagttgttgagtaaatacttattgaataagcggatgggtaggtgttgaatgaagaattaggattgttaataccccatttttctctgaaatggcttttacatacctgttcttgaattgatcttgagttgtccttttcaattctgtgacccatgatgcccagacattgataatcaagtaccagacattggattgaactagttacaaataatgactattcttctatttctctttggcacttaactagcttccataggagaaacttcataccaatgtgaatgactctaaaacaggcaagaaatgggaattttaaacttttaataaatctctttttgccgtgatgaattgaacatggtttcagttttgtttttgtttttgtttttgagacggagtctcgctccagcctgggcaacagagggagactctgtctca

SEQ ID NO: 253063 - DNA, 352 bp, Homo sapiens
gcaagtgccaaagtcagcagtagaattcagctgtgtacattttgaacgagctggaagataagtttatgagcactatacggatgcagattgtacagaaaccagatggccatattgtcctcaaagtcctctggagggcggtagctgacatgaagctccagcatgaggagagtgaagcaatgtcagctgatgatgggaaggcagggtaggatggtgttgaagaacagaggtgtctggcaagcctgtgtctgagcccgggatgcactcattatctgcataaccttgtacaaagtatttaccttctccttctctcatctgtaaagtgagtgcaattttagtacccatgtcatagagt

SEQ ID NO: 253064 - DNA, 395 bp, Homo sapiens
tttggcccagaggcagcggggtaaaatggagagagtgaaggattgaactcagtcctggctctgactcctggttctgctgcttcacggtcgtgtgactttggacagattgcttcacaacttgtgaccctcagtttcctcatcagtaaaactgaagatactgatggtgagaattaagcctgaaatgtgcttcctctttccatcttcgcacagagtgaagcaatgtcagctgatgatgggaaggcagggtaggatggtgttgaagaacagaggtgtctggcaagcctgtgtctgagcccgggatgcactcattatctgcataaccttgtacaaagtatttaccttctccttctctcatctgtaaagtgagtgcaattttagtacccatgtcatagagt

SEQ ID NO: 253065 - DNA, 721 bp, Homo sapiens
gcaggggcttcttgtgagattatctgtcttgaagatatttgtgactaattacaagcagtgtaacctgggagagaagctgttcaggctgaggattttaaaacgatgagatgagagaaaattagcagacatcttttattatgtctactgtctttaaaagtcaactctctggaaaactatttttataggcaaaaagtaggtgggtatgtggtatgattatttgttttacttttgagggcagatgctgtacctcacatcatgagcaatccaccctcatgttagagggaagatggagtcgtttctgggtgtttgtgaactcttggtagagccaactgaatgtcagtttctattattctgtggtgaataataactcaagtaattttcataaagaaacagattgaatttcactgtgaacattttcatcaattcctagaatcttggaatttcgctaattagcgagttggaagtattgtattatgtgggagggggatttaatgaattaaaatactattaattttgtctctttttgttttggttcctgagacatttacattttattgactccttagatatgggcttaagcaagtctctttttaagacaggaagtcattgaacaaattatttgtgagctccaagagtaggctgattttattgcttcaaattatgtgtggggggaaatgtactttgatccaaatgttaattggatactgaagaattgtttctg

SEQ ID NO: 253066 - DNA, 514 bp, Homo sapiens
aaagaatccaatctacagctatcaggccaacctttaagagacctggtgcatttaggaaatttgctgcctggcctagaaaccttttctgtagaatccagagcctgatgctgaggagagtaggaatcagccattggtaggccttttttcttccctcggggctcagccccctcagtggaacagtatgccttggaaagagattttgaaaatgggagacactaggcctgtgggttgtttagaagtacagttggtggcgctatagagagggatggctggggctggagagaataacagcattgcctcgtggtctaggaggttgggagtctctctgcagaagtagtctgtgaaaacctactttgacaacatgatagactgtgactctagggggtaagcttcccaaaagatccagcttaaagccagttgtaccttgaaggctggtgacctgcacagctctccaggtctaggggtcatcattgccctgaaatgattcagctacctcagggactcacagaatact

SEQ ID NO: 253067 - DNA, 408 bp, Homo sapiens
tcctaaggaaaataaattgttatcattatgttcaaacttaacagcgtgatgccaaaaaccgatgctgacacctttttaaaaatcacaagtcgattttatgcaaggtttttcttgcttcccttgctttccccggaccctacagatgttttatatgcttagaagagcacataaatgcaagtagagcctgtgggaatttaggcgaagtcaagagctttttctcctaacatagatctttcccggtagtatgtgagtatgcttgattgttttcttctttctcctgtatatttggaaaaatgattgacttgcaaatgttgtgcaggaaatggagaccagcagggtacaaggctgttgacagaggccattcagttgatctccttgcctcactttgcccttccacattttttttct

SEQ ID NO: 253068 - DNA, 405 bp, Homo sapiens
gaaactaccatatagtgataatgtcttctctggagggcatacctctccagacacatttgctaggttaattcttgctttagaattctagatgtgcagttgtaccataaaagactgagagtctttatcactaataattaacactggcttatgattctctttttcctcttgtccttttaaccctgtcctgtcccctgctcccactgcctctgttctcgtttgttttgcatttttgtttttccttgtaactggcatttcagtagtattaacctgaaattttttttttttttgagacggagtctctctggctctgtcgcccaggctggactgcagtggtgcaatcttggctcactgcaagttccgcctcccgggttcatgccattctcctgcctcagcctacctgaatta

SEQ ID NO: 253069 - DNA, 121 bp, Homo sapiens
tcttgcccctttttcttacttttgtcctcttcagtaatgatgtcactctctgaaggacagggctgttttaccattttgggtctgcctcttggttttggaatcttgacttccgtagctgcag

SEQ ID NO: 253070 - DNA, 1426 bp, Homo sapiens
atggcaagaagttcgatgaagctggaaaatagagtacaaagggaaccaaaaggtcaggttacagaaatagggtgtgtactggtcatctacggctccataacaaaccactcaaaaatatagggacctaaagcaacagccattttatttgttcatgatttgatgagtgagttagcgttttgtactgagctcagctgagtacctcccctactagtctcacttggggtactcatatgggtgcagtcatttggatgttagatgggaaacaacttttccccatattcccacagtctaactgggcctcctcacatggcaacaccatgcactaagccagtgagaacctacaagacagaagcaggccacgtgcggtcacacctgtaattccaacactttgggaggccaaggcgggcggatcacttgaggtcaggagttaagaccagcctggccaacatgttgaaaccccgtctctactaaaaatataacaattagctgggcatggtggtatgcatctgtaatcccagctactcaggaggttgaggcaagagaatcgcttgaacccgggaggtggatgctgcagtgagccatgatcatgccactgcactccagcctgggcgacagagtgagactctgtcttaaaaaagacaaaagcagcaaaagcagaaccccttgaagcctgggaattcacacattccttgaaggcttggaattcacgcactgtcacttctggttaaaataagtcacgtggctagcccagattcaaggggtgggaaaatggattctacttgatcggagaagcagcaaagtctcattgccaaagggtgtgtgtacagggaggggaatcgtagctgtcttctcatactgtcagaagcagattgtgaagacttgcacacaaagtaaacagtttggaatttatctcaagggcacaggaaactatcaaagtttggctttttggtttttgttgaaagcactaacataaaaaataagattttctactcagcaccccttattcaggaaccgttcctctcttgtaatccacatggttattgcagaaaccatcacattaggagaatggatagaatggactaccttttggcaagttgtttgaattagggccaatcagaatccttctttttggtgtttttctcctgaaaatgagagttggtctcttgctaagcctgaagctttaagatgtaaatttgggggagtgctaggtggctgtgcttgcagctatgtgaaaaaagcactccgcacaaagaagcagaggcgaaagatgagaatcctgatggccttggagtccgctcgttctgatatccctctctgcctcagcttcaagtttggtttgtctcttggaaccaaaggagtctcgactactataaagagagcttaccacctgcaagtagggagttgcaagtgacaacataaaaatcca

SEQ ID NO: 253071 - DNA, 1064 bp, Homo sapiens
atggcaagaagttcgatgaagctggaaaatagagtacaaagggaaccaaaaggtcaggttacagaaatagggtgtgtactggtcatctacggctccataacaaaccactcaaaaatatagggacctaaagcaacagccattttatttgttcatgatttgatgagtgagttagcgttttgtactgagctcagctgagtacctcccctactagtctcacttggggtactcatatgggtgcagtcatttggatgttagatgggaaacaacttttccccatattcccacagtctaactgggcctcctcacatggcaacaccatgcactaagccagtgagaacctacaagacagaagcaggccacgtgcggtcacacctgtaattccaacactttgggaggccaaggcgggcggatcacttgaggtcaggagttaagaccagcctggccaacatgttgaaaccccgtctctactaaaaatataacaattagctgggcatggtggtatgcatctgtaatcccagctactcaggaggttgaggcaagagaatcgcttgaacccgggaggtggatgctgcagtgagccatgatcatgccactgcactccagcctgggcgacagagtgagactctgtcttaaaaaagacaaaagcagcaaaagcagaaccccttgaagcctgggaattcacacattccttgaaggcttggaattcacgcactgtcacttctggttaaaataagtcacgtggctagcccagattcaaggggtgggaaaatggattctacttgatcggagaagcagcaaagtctcattgccaaagggtgtgtgtacagggaggggaatcgtagctgtcttctcatactgtcagaagcagattgtgaagacttgcacacaaagtaaacagtttggaatttatctcaagggcacaggaaactatcaaagtttggctttttggtttttgttgaaagcactaacatagatccacatgggtattgcacaaaccatgaccattgggagaactggatgggcctacctttgggcaagtgagtggattagtgccaatcgtccct

SEQ ID NO: 253072 - DNA, 1717 bp, Homo sapiens
attgagaaaggagttggagctaaatgtgtcattctaatcctatctaatggactaatttgtcaggcacagatagctctgttgattgtataaagagctcagcctttaatggctctttttaggtctccagattagcttcagattgttatgtgcaacacaatgcattgacacaattaagtacttgttctctggcatcatgctgcttgatataaatcctagtgttggcacttcctttctccctaatcatccactttttttccacatttgataactcctttatatgtatttcttagaatttttttttcactgaacttggcgctttctgagctctcccatataccagcattgcgtttcattaccacatgacagtttgatctctctgctaagctccaaacctttgtttctagctgcttatcggtcacctccttctggaatttcatagtcacagcaaatttagtttgactaacacaacacttatgttccccaaatacttcgtattttggcgaattgtattttcattcaactggtttttcaagcaagaacctgtaatttgtaactttttcttaatcaactctgttccttctatgtccctaatagctattcttccttttgtgtattgcaattctctgctggttgatctctctgcccttaaaaacttaccccttctccattccccactgccaataccttgctacaaaggatttcttttgtcctacccgtcccagctcaacagtgtagtttgcagatgaataacacagactggatttgagaataaacaggtaaatacaggcacaatagacaggcaaaaaaaaaaaattgttgaatgcaaaaaggaatgaataaatggcaagctgccaaggaagtgcaaatatttcctcaggaaaatctttcctgacgcctaaagcaaaatcagatggtgtttctttgtgtacctgtaatcccccttgcaatttctcttaattgtcatgtgtattttaatcatggcagtcttcttcactagtcattgaccatcctgagaagagggaatatttaaaaaaaaaaattattcttccatgtggtgcaaaccaaaataatggaattatggagaggttagagcaggaatgcagtttgtgtacattggaaatgaatcttagcatataatctatgaaaattagccatgttctttgatgggaaataaatttgcatcttgtgttaggatcttctttaacgttaagaatatgtgcaaagtgtgcttaaaaactgtttttttcctttaaaaatgttttatccagttttttgtacacacatacacaaaaacatacacaatggccatatcattcagcctttttcatcttttcacccccttttctgcatattggtatatctgcaacccatattaatatcctagatttttgtttatacacgtataatccagttactagttgtaacacgtggcacattgccagattacttagaataaagctgtcacatttgaccttttcaccagcaatgtggaatgataacaatttcttcacatcttctccagcagtaggtattttaattaattcaatttttgccagctagattgggcatgaaatgatgccttattattattttaacttgtacttcctcctctacgtttaaaaactattgtctgatcattatgataattaaggaacaaactaatgaaaatgtaagcatcattgttttcttaaagatacactttgaaaactacaatttc

SEQ ID NO: 253073 - DNA, 346 bp, Homo sapiens
agaaacctgcacccctcagccatcaacccctaggccccatccaccctccagccccaagcaactactcacctactttctatctccatgaatatgcctattctggatattttatataaatggaatcatataatgtgtggtcctttgttactggcttcttttacttaacatatttccaatgttcatccatgttgtagcatatattgtacttcattcctttctctgggcaaataagagttccttgtatggatatactgcattttgtttatcgttaatcagttgatggatattgtattaatctgttctcatgctgctaataaagacatacccaggctggctaatttataaa

SEQ ID NO: 253074 - DNA, 531 bp, Homo sapiens
ctgcagaacccggtgacagcatggagagatcaaggagtgtcccgcccagcacactgcagggaccagcagacaaatccacgcggcctgcctgagcgtgcagtgaccccgcctgatctctgatacagctgttcgcaactcctgccagagagcttgttatcggcacagggtggacaaaagaaggaaaggaagagaacgatggcttcccctcagttccataatctaagctctactgcggtaatatccagctgagaaaagacacaggacaatcatttgggcactttatttccatggtaacaaatagaagattcttccagatgtttgctaacatcgtggaggtaacatgtctggaccgttgtctgatattcagtttttatagctggggagacatggctttagctttgggtaaactattctatctcttcctcctcttcctctgcctccttctccttcttgtgttctccatgagcataaaaccaaaatatacttgatgctttgttgtaaaataaacagatgataaatagcagtctctgt

SEQ ID NO: 253075 - DNA, 423 bp, Homo sapiens
atgagagtttgtgcatgtctttgtctctccagactgtaaagtccttaatgccaaagattgtgtcctattgatctttgccaaacaaccctttgacaacagataatgtagtaaataacctattgtatagtgaagggaataccgatttcgtatgtctgcagtttggcaaggggtgaacttgtgatggttctttttatgtgtcaacttggctgagccacaatgcccagatatttggtcaaacattattctgggtgtttttatgaaggtgctttttatatgagacattgcacctgggcaaaatgaaagatttttgaatacccaacttgaactagggactttaagagcaccattacattttttcattcatgttttgttaaacattttaatcatttttttatttgcaaaggaagagaaaccactgatcga

SEQ ID NO: 253076 - DNA, 443 bp, Homo sapiens
  misc_feature (113)..(113): n is a, c, g, or t
gctgcctgtcttttgggttcaaatgctataaaacaccaaaggtcccctgctggcaaataaaataataaatttttttattatcattctgcaaaaggcgacgaagggctaaaaanatccccctctatacttcgagatgctcttttaatctgagaattttatatataactattgcaagaattatatacacatgcatacacattgtgtgtctatgtgtgtgtagtatgtatgttgtatgtatatcacagagatgacttatctactttaaatttataaataagtataataattaggatttcatcccagaccaagaacccaattaaaggaagagaatacctggggaatttcggtctttttcctataatagtaactactatttaaaaagggctttttaaatgccaagtaccacatgctattgttttatatggtgtctcatttcaatgaac

SEQ ID NO: 253077 - DNA, 2539 bp, Homo sapiens
  misc_feature (1624)..(1624): n is a, c, g, or t
agtgctaggaacctgcgcccggctgagctgagcgaggcgagaggagaaagcgaggcccggggacgggactgagagctctgaaaggagggaggcggctcccgagtactccgcgccgggcaggccccggcctcgcctgttcgcccatttttaaggctcgagttagaggccacctcctccgagaagccttcggtgacaccacctctcccagacggttcccctttctgattcccacagcattttccaaccattcacggtcagaaccactcaccaggacgtgttgtcaccattttaccgctttgcctcgtctcttaactagacgaaatgggttccttttggctctttggaaagggaggctgtcttctatttatttccgtggtaatcccacctcccacaacaagttccattctacagcaatgtcttttctcttgctgagaaccattcaagtctaagttttctgtcctggttgctcatctcgcccacttgcacagcccacctgtgtggccgactcaggattgacccacctgctctcttcaggccatattcccacgcagaagtgggtcccactcctcaggcctctgtgctggccccgtctgtggggttagcaagcagccctgctctccatttccagctcagaagcaactggatcgttacctcattggtgacaacttgactgtgctgcccagagctgataagaaacatcacccggggaagaccagctgcctcttccttgcttcctaatcagggtggaaatactgctaaatatatcacaactctttgcaagcatcgttgggtaatgatcgggacatctttgtgggttccctatcattttctcacaaagttgagcctttcaaggtcagttctaggccagccagtctgggagtcattctttagaatcagaagagaatttaagaagaggagaagataagattgtctctaaaacctgctaatgagaactacaggaaggtggggatgctagctacttttaatatttctggtttgaaccccttcctccaccccagaatgaactgagagtaggtacagaaatagataatgcaaagacggttagggttgagggtaagcagaaaactacccatctagaccgaaggaaggcttgctaacatatcagtaagcaaacagctttctaatctgcaggtaacaagttttacatccctgaggacactttttgagataggactttgtttgtttgtttgtttgttgttttttgtttttttgagacagagtctcgctctgtctcccaggctggagtgcagtggcatggtctcggctcactgcaaccttcacctcccaggatcaaacgattctcctgcctcagcctcctgaatagctgggattacaggtgcatgccaccatgtccagctatttttgtgtgtgtgtgtgtgtgtgtgtgtgtgtgtgtatttttagtagagatggggtttcatcatgttggtcaggctggtctgaaactcctgacctcgtgatctgccctcctcagcctcccaaagtgctgggattataggcgtgagccaccgggcccagcctggggctttttgagaccctattgaaggctgaggaagaatctggaagctaaagagtaacccattccaccacctgctctgaaganagaagaagcaaaaaaagattaaattgtacaaaaagcacttaaattagacaacagaagaatttcctgatacaaagtgggtgtctaagatgtgttaaacaagatgcctgctccagccaggactcagacactcctggatggagagcatcttcacagtttgggataaaagtgactatacagagtggtggagtgaaggctgcaggcccctccccaaggtggcatctaaccccggaggtatcaggacctcagaggctacccacatgatttccagctgatgagcagaaatagctgtggcaggtgcaggcttcacttgctgccaccaacatgggagctcaccaaacacccagtggccaaaagaaccagggtctctctaagccctgggctcaccgccaggcaagcttgggtgcttgggagggccgtcgttcttcacagtgcagcccctggatttcttctcaatttactcaactctctctcttgaatcccatctgtgcagcttagaagtcacaaattagaaccccccaaggcaaagctgaccatagatacaaatggttttgtctgtatagtgtttaagcacttaaaaaattcattgtgaacatttaataattagaaagtgtcaaaatgaaaatatctatagtttctctctaaaaaccagaagatctgttaacactgatcccacacttctatttggcaatgactggcccctaagacagggggtacgtcctctagctcaccacagtctccacctttacctactgcatccctgctgagacaaagtggtacatgccatttattaaggatgaatgctgttttttttaattatacttaatcctcatttgcattacctgccttcattctggaggtatttgagtttgcatctcctgataaagaataaatctcaaaattgtcatctctaacttc

SEQ ID NO: 253078 - DNA, 313 bp, Homo sapiens
tccctctctccctcccttccttccttccttccttccttccttgtttccttctttcctcctctcatttatttattcaacagccattgagcacctcctgtgtcaagcctgtaggactcaagaggagagagctcatgcatgaacagtgcctagcagggaagaattggcaccggggagaagaacagaggaagttacaggggttagaggagggggatgttttccagctgacaatgatgggggtatcagaaaggctcttggtgagattgcaccattgcactccagcctggcaacaagagtgaaactccatctcaaaaaa

SEQ ID NO: 253079 - DNA, 504 bp, Homo sapiens
tatataggtttaagtctccttcataagattttctttcttctaaacctttggaatatgccatgcttttcaaaaagccccactcattatttttatgatagtggaataaaagtctccaatttgtcaagctcattattcaagccttccaggattgtttgcagttttaaaataaactgctgggggttttatgcatcttgcaatatgagtacttaattaaaattaaaaagggggccatgcatctatctattctattaaggtcgtatataaataaatgattttattgggattttcagtgtatttagagtaatctatacttaatgagagggacttgtacttttcatttctttgtactatttttcagcctttcctgaacagtaaatgttttaaaaaaaactatacccttattccttggtctctaagaactgcgcccggcctcatgcaccgttcttaatgaataatgtgatgtttacaacaaccctgtgctcaaccaaaaaaaaaaacacaaaa

SEQ ID NO: 253080 - DNA, 128 bp, Homo sapiens
tgtcaacataaatgtctcttcttctggatttttctctgcctcagtttttttggcctcttgcctgggtcttgggaaaataaatcaatgataaaacagagtaaaatcagtaaataaacagataataaata

SEQ ID NO: 253081 - DNA, 768 bp, Homo sapiens
tagaacatccagttctgttgcatattaatcagtgttaattaactaatactgttcaaaaactcaagttgtgtttaaattagcagtcaagtaaatctctattcttatggttagctaattctgcaggctattatacatgtgttgtttttttcatggttttagaaatttcatttaattatttaaaaaaccaacagtgtttgcttacaaaaggcatagggctgaaattgtaaattatttttaaatatgaattgtgtgagaatcaaaacaaaggaattacctctgaaacttcatctccaaaggcttcccttgtgtttagatctggaatctcccaaggaattgttttaggtctcactgtgatgagttgatcataaactttagacatttgtgtgcattaaggaaatttcccagaccggggaatttactttaggccttacttatctggtaaatgtgtttgaggactgatctttggaaatcaggaagtttttggataatataggaacagttccagatgcttcccagagatttaaatcagttcaaggcacctggactgctcagagactgcaagaccctacttggcataatgaaatgtagtatagtctaagtagtgcatacgttttacatttgttcatgagctcaaagctgtcaaaatctgcatgtttgctggggttccacaatttaatgagtaagggagtgaacccccaccagcagctagtgggtgtgatgagctgatgggcagatgatctagtgctgtatatgcagagttggtcccac

SEQ ID NO: 253082 - DNA, 957 bp, Homo sapiens
gcatcttgggctgcactttgaccacttgctccggtaagagagaatactcacacatacaacaggttccatgaaatggtggcaaggaacagcagacaccttggattcatggtgagctggtttctcaaggctcaggaaagctgcccagggcaggtggagtctcatctgcgtgtgcctcacttgcaccccagatgcaggaccctggaaagtagccgtctctgggttttctactccagggataacatgacctgctggattaatgtgctgaaggacatcctgtttctagcggggactggaacagagcctaggccttatctcgggatgttgcattcccagcacattctagttattcttaaaactacaagtgagaaagcgggaggactggtttggtccaaggccacctagggaactgtcctgcaccagatgcaaaatatcactcatcagaggtcctcttaatacccatctctaatcctgggctggcaacattgaagtatacatctttgttcaggagtctgtcttcttactaaactgtacactccttacagacagaaactggcttttatttattttgtatcccaagcagggtagaaatgtacatcagatattacacgttggcatatttaactacattaaatccttcttccagaaaatcatactgtgtgctggagaccagaaagctaacaatattaagggtagttattcagactccctgagagtcaagctgcatcttgaaccaacttctccaaacagactcagccacgtgagagctgaaaaacacagtatcacaaggcagggccatgctcctgctgacaaacaagcacagtcatgaacacacttggctgttctgtgcagctggaatcccagtttccagggtctagctacatgggtgtcagcctagatcctgggcttccagcccttctattttgtaagcacctaattacccctattaagtagctttct

SEQ ID NO: 253083 - DNA, 367 bp, Homo sapiens
aaagaaaaaaaaaaaactaaaaggcagaaatgaaatccacaagcagacagcccggcgccgtgtcctgggcctcgtagttaaagattgacccctgacctaatcggttatgttatctatagattacagacattgtatggaaaagcactgtgacaatccctgtcctgttctgttctgttctaactaccggagcatgcagcccccagtcacgtacccactgcttgctcaatcgatcacgaccctctcatgcacacccccttagagttgtgagcccttaaaagggacaggaattgctcactcggggagctcagctcttgagacaggagtcttgctgacgcccccagccgaataaaccccttccttctttaac

SEQ ID NO: 253084 - DNA, 282 bp, Homo sapiens
tttattattgagaaggagtctggctctgtcgcccaggctggaatgcagtggcgcgatctcggctcactgcaagctcccaggttcacgccattctcctgcctcagcctcctgagtagctgggactacaggtgccgccaccccgcccggctaagggaagcccttcttagatgacctcaatccccatacattccttctccctggagacgtcatttccacgttccagcgcagataatcgctcatgcaccatttgttcctgtaaatttagcaatgcacaatcaacgc

SEQ ID NO: 253085 - DNA, 574 bp, Homo sapiens
tgggggcacttatgcacgcttactatcttacaagctttgagtgcaagagatgagagtcaaatctgaccaagatgttgatgttggataagagaattctctgctccccacctctaagttgcccgccaatcgaattcgattggcgggcaacatagggagaccctgcttctgcaaaaatccaaaaactagctgggcatggtggcttatgcccatgcttcccgctacttgtgaggctgagacacgaggatcacttgagccaaggaggtcagcgctgcagagagctgtgatactgctactgcactccagcctgggttacagagtcagactctgtctcagtatgtaaatgaataaggtctgggagtggtagcttatgcctgtaatcccagcactttaggagaccgaggtgtgtggatcacttgaggtcaggaattcgagaccagcctggctcacatgatgaaaccccaactctactaaaaatacaaaaattaactaggtgtggtggcacacgcttgtcgtcccagctattcaggagactgaggcaggagaatcacttgaacttggtaggtgcaatctagcg

SEQ ID NO: 253086 - DNA, 766 bp, Homo sapiens
agcaggttccaccctcttgcgggcgagcgctggctaccattggactgtccggcgcgaggggaagggtgatctataaatagggaatgggtacacgtgacagtttggcagctgctcctacccctccaccccgcccaaccttcagcttctgaggctgcgcagggggagaaaagggttagggggtcgagccctgacttcgcctcctcttccaagaagccttcccagacactcagctgtaaaaccagacggacgtcctccgatgaaattgtttctacttagggccggcttcaccggcttggaatccacttagaagggtcttcgcgcttggttgaatgttctgcaatttctgtcttgaaatttttagtttttgagcaaggggccccttattttcactttgcactaggccaaatatgtagccggtcttgctgctaagagtctaagatcgattgcattccaaattctggaattataagaccctgggtggaagattctatgctttgaccagaagagagtctaagcagcttttgtctcccaggtgctaggaggatgtgtgctcatcattcttccattccaggggcctttgttctacgttctaaggggctttgttctcagccttctatgatgctctattctcaacgttctctggtcctaggagtctgagcctgacattcgtttccaaggcttcctgctgtctctccaggctccgcaagcagggctggggcaccctcaggcggccaatctgtatcactacgccgagcctgcctctacc

SEQ ID NO: 253087 - DNA, 895 bp, Homo sapiens
agcaggttccaccctcttgcgggcgagcgctggctaccattggactgtccggcgcgaggggaagggtgatctataaatagggaatgggtacacgtgacagtttggcagctgctcctacccctccaccccgcccaaccttcagcttctgaggctgcgcagggggagaaaagggttagggggtcgagccctgacttcgcctcctcttccaagaagccttcccagacactcagctgtaaaaccagacggacgtcctccgatgaaattgtttctacttagggccggcttcaccggcttggaatccacttagaagggtcttcgcgcttggttgaatgttctgcaatttctgtcttgaaatttttagtttttgagcaaggggccccttattttcactttgcactaggccaaatatgtagccggtcttgctgctaagagtctaagatcgattgcattccaaattctggaattataagaccctgggtggaagattctatgctttgaccagaagagagtctaagcagcttttgtctcccaggtgctaggaggatgtgtgctcatcattcttccattccaggggcctttgttctacgttctaaggggctttgttctcagccttctatgatgctctattctcaacgttctctggtcctaggagtctgagcctgacattcgtttccaaggcttcctgctgtctctccaggctccgcaagcagggctggggcaccctcaggtatgtctctctactggcagggcagtacttggctgtctcagtcaccactgtgtccccagcatcacccagctcagtgacacaaaggaatgagtgaatatatacttctctatttcatagatagagaagtcatcacatcaacataaaataaaatactgaatgttacgtatc

SEQ ID NO: 253088 - DNA, 443 bp, Homo sapiens
aagcggggcaactagcactatccgatttttggacacatcacaaagccacagaaggaaagagaatatgatgatgacaaaagagcagattaatgaaccaatggattatgacagagagctcagaaacagacccgtatatataggataacttgacataaaccagccaaggttgggttgtcacgtgatgggattaagaaaactggcttgctctatggagaaaaataggttcttatcacacttgaaacaaagatagaatccaaattaaagacctaaaaatgaacagtaaaactatgaagctattatggaagaaaatgtaggagaacatcctggtgatttggggacagggaaggagttcttaagacaagccacacaccataaagcaaaacattggcaagttctgcattaaaagtaaagatttctgttcaacaaagggcaccacagaaaaa

SEQ ID NO: 253089 - DNA, 1232 bp, Homo sapiens
aaagttatttgtgttcctctctgccaccctgccctcgtgccttcagctgtcccttctcccagtgccagaggaggcttggattgagcacccatgctctatggacaacagcaagttgagcagaccttaacatcattcccggggaggcaacgggtcatctgctggctggggttatcaaaggccccatctcctactcctctcccatgccccacagtgaagagccccagagctggctgtggttatgaagccggctgccatgtgggcgacctggagtcagagcacggggcagtcacatatgacaattggttgaaatatcacagccactctccccccacccccactggtgatctatgggctgcgtgccctgtaaaaattatttatcggggcctcagagtgtcctgatttagtgccgctgcctctggggccttggggcctgcctgtccaccagagtctaagcgttaaacgacgctaaaaagttaaacagccaacgctgggggctcactcgaggaggcaccataaagctgtcggagctgcttaaatcaggagcgaggattccctgggacgtcttctctccatacgccgcaagccaagaaggctctccttacccctctgccactcacccatacccagaagcccacagagggcaggggacacgtgggccgggggcctggaacagagcccaaaaggaggccacggatgacctcctctgcagggctttctccagcagaacaggggccgtggctcaagagggtaggggtcatgttgtccagctcaccaactctgggcaggggtctccttgttccggtccagtttttaaagacttccaacaaaaggcactgccaaagtctctcccaggggcccctggggagaagttgtttcccaagtctgtctcacttcaatccacgcttctgtgtgttgaatccactggaactcagtgtcttcccactcaggtttggagaggctgtgctggccacaccagcctgtgacttcttgcctcctttcacccctccacacccacttgcatggctctctgaggaacagagccccacccttccatcaccaccctccgccaacgcacccctgggtgctggcataacacgcaagcttcacagatggcttttctcagctgaagcccagtccctgctgccaccacccggccgccgagcaagagggaaggtgggtctctgcatgctgcctatcacaccttctttcagcagcaataaaactcactctta

SEQ ID NO: 253090 - DNA, 417 bp, Homo sapiens
ttttatgttgttctgtattttgcttactgtaacactttctgaaatgtttgctttcttaagtaaataatgaaaacatttttggtataggccagcacatccagctataatgagtaaataggtaccttagatggattcagaaagaaaatgatgcacaaaatgcatcataaattgcaaaatggttggaatttttgctgagtagaatttgtggaatttatgaattcatggattcatgtggcttatggattcataatttcatctttttccctcgtttaccttagagatgttataagtattaatgagataatatctgtaaaaatccttgagcttctcagaagaaaagggcttataaacatagatactaattggattatgctgagaatgcagctagaaaaataccccaaataatgttatatattg

SEQ ID NO: 253091 - DNA, 1060 bp, Homo sapiens
  misc_feature (1050)..(1050): n is a, c, g, or t
gaccgtttttcagccctttccaaccgagtattcatagaaacagaagaggaacgttctagatgtataacaaaaagctgcccatccccacagtgaaaccactttgaagacatcactttaaaattcatgtgaattcggccgggtgtggaggctcacacctgtaatcccagcactttgggaggctgaggtgtgtggatcacttaaagtcaggagtttgagaccaggcaacatggtgaaaccccatctctactaaaacagaaaaattagccaggtgtggtagtgcacccctgtaattccagctacttggggggctgaggcatgagaatcacttgaacccgagagacggagcttgcagtgagccgcagtcgcgccactgcactccatactgggtgacagagtgagactccgtctcagaaaagaaaaaaaaaaatgtgaattcagttgggtgtagtggctcaggcctcaggcctgtaatcccagcactttgggaggtcaaggtgggaggatcacgaggccaggagttcgagaccagactaaacaacatagcaagacctcatctctaaaaaaataaataaataaaaaacaaaaacttgtgtgaatttgcattctattttacaatataaccaaatgatctcggccttcacaccatcttcttggaaacctctgcaccatgagagcctagtggaggaagcgaatgcgcaggctgaagcgcaaaagaagaaagatgaggcagaggtccaagtaaaccacaagcttatgcacccatggaggctacaggagcagaaacatggaatccagaggctggggatgctggtacagttattgggctgcatgctactgtctagagcttgtttcagtgcatctagaacttcatctccatctggtcgccaagaccacctctgagactcaccttgctcataaccaaaactgcatgttggtcctttgctccggacctgtgatattctggactatttctgtgttcactggtggccgagtgtaacaaccatataataaatcacctcttctgctgtcttacgtttcaagtgtcgggancctcagatca

SEQ ID NO: 253092 - DNA, 505 bp, Homo sapiens
tttgatttcatcactgcagcgtggctgatttttttattcatggttctctgtgggtccagtctggccctgctggtcaggatcctctgtggctccaggggtctgccactgaccaggctgtacctgaccatcctgctcacagtgctggtgttcctcctctgcggcctgccctttggcattcagtggttcctaatattatggatctggaaggattctgatgtcttattttgtcatattcatccagtttcagttgtcctgtcatctcttaacagcagtgccaaccccatcatttacttcttcgtgggctcttttaggaagcagtggcggctgcagcagccgatcctcaagctggctctccagagggctctgcaggacattgctgaggtggatcacagtgaaggatgcttccgtcagggcaccccggagatgtcgagaagcagtctggtgtagagatggacagcctctacttccatcagatatatgtggctttgagaggcaactttgcccc

SEQ ID NO: 253093 - DNA, 521 bp, Homo sapiens
taagaacagttttccctaaattggcatccacagaggaaggccccataacatgcactcctgtagtgtgaccaggccttgccatcccctcgctgggtaaccttgggagtcaagaccccctctggcccatcccctctatcatctcagtcccccagggctctgacacaggcagaagattctcaaacactatcgaattttttttctccaaactagatgtttgtggtggactgaatgtttgtgtcccctgaaatacctatgttgaaacccagtacagttaaatgaggtcataagagcggagccctgatcccataggattgtgtccttatgagaagagacaccggagagcctgagctccctcttctcccaccccaagcatatgtccaggaaagaccatgtgagctcactgtgaaaagttggcccagcccaaggagagagcccttaccagacaccaacactgccggcaacttgatctccgacttccagcctccagaaatgtgcaaaataaatttctgttgcttaagcca

SEQ ID NO: 253094 - DNA, 579 bp, Homo sapiens
caggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatcta

SEQ ID NO: 253095 - DNA, 524 bp, Homo sapiens
ccaggctggagtgcagtggcacaatctcggctcactacaacctcctgggttcaagcgattctctagcctcagcctcctgagtagctgggactacaggcgcccaccactccaagctaatttttgtatttttagtagacatggggtttcaccatgttggccaggctggtcttgaacttctgacctcaagtgatccacctgttgcagcctcccaaagtgctgggattacaggtgtgatccatcgcacccagccccctaggattttctatatggaaggttatgtcttcttcaaacagaaatactttaaactcttcctttctaatctagatgcctttatttccttttcttgcctgatttctctggctagtacctccagtacagtgttgagcaggagtagcaagataagacatttttgtcttgttcttaggtataaagcttttaatctttcatcattacatatgcggttaccttgggcttttcatagatgccccttattaactcaaagaagttcccttctgtttctagtt

SEQ ID NO: 253096 - DNA, 414 bp, Homo sapiens
atggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagag

SEQ ID NO: 253097 - DNA, 658 bp, Homo sapiens
ccagctcccccagcgcctgctgccgggtgcactgagggcagggattgaggctgtgctgctgagcttacacccgggcttccgtgtcggcttcaacagcctgggaggcttggcctcggtgaaccacctccacctgcatggctattacctggcccacagactgcccgtggagcaggcgccaagcgagcccctggaccctggaggccatttgcatctgctccaggacctcccagctcctggcttcctcttttacactcgtgggccagggcctgacttggagtccttgataagcagggtatgtcgggccactgattatctgactgaccatgagattgctcataacttgtttgtcacccggggagctccgccgggaaagacatcaccttcctcagccctcacaggggtccgagtaattctgtgggcccggaagtccagctttgggataaaggacggtgaagctttcaatgttgccctctgtgagctggctgggcacctccctgtcaaaacatcccaggacttcagcagcctgacagaggcagctgctgtggccctcattcaggactgtcggctgcccccatcccaggcagaagacgtacaggcagcactggtggccctgatgtcccaggaagagcaataatacttctggatgtatttatgttct

SEQ ID NO: 253098 - DNA, 462 bp, Homo sapiens
gcacaggctgcgctgtttacgtttggtgcctcatcagctgcctgggcacttccggtcacccttgccccctgtcccctgggcagctcggagaactctgtccagagggctgtttaagccccacagctggtgtggacgcaggattggtgtgggtaggcgggcacagggctccagaggctcaccctggcctccttctcctggcccagggcagcagcacggagcctccacaggcacagctccatcgttacaatggcctctttagacccagctcctgcctcccagccttctctccaggccctgaactttctgaagtcaacctcaccaggtccagctcatgcttctttgcagcctctccaggcccagctcctgcatcttggtggcccctccaggcccagcctctgcctcccgtcggcctctacagtcccaacatctgcctcatagcagattcttgaggcccagcatctg

SEQ ID NO: 253099 - DNA, 1407 bp, Homo sapiens
  misc_feature (384)..(384): n is a, c, g, or t
  misc_feature (679)..(679): n is a, c, g, or t
  misc_feature (707)..(707): n is a, c, g, or t
  misc_feature (747)..(747): n is a, c, g, or t
  misc_feature (948)..(948): n is a, c, g, or t
  misc_feature (1142)..(1142): n is a, c, g, or t
  misc_feature (1165)..(1165): n is a, c, g, or t
  misc_feature (1244)..(1244): n is a, c, g, or t
  misc_feature (1296)..(1296): n is a, c, g, or t
  misc_feature (1406)..(1406): n is a, c, g, or t
cgccaccaatgtggcccaggccaccagcccccgtgacactgcagccatcccctttgctccccgtcgtggcctcccgaccgagcagccagagtgaccccgaaagcctaaatcagcctgcggcgccctcacccgtcctccagctgccatcgcctcctgggtgaagaggacgcagctggtgacgcgcactgacgtcctgcaaggcccgctccaggtgcgccacctttgactggcatgctgaaaggacaaagggacggaggcattttaccggagaggacatccatggggcccagcaggtcaaattcctttctctaagtatgggagacatttttaaaaataatggagtcctccagggccggctgcgtgctgtggcctgtgctcctcacngctttggacccaggctgcgctgtctccaccacgaccaaggactcacagagctcgcctgggggacctggccccacagtcaccccgtccgtcatcagcctcaaatgccatcagcccgtgaatgctgctccatcgtctgcatggcagccaaggaggatggtgccaggtgatgtggcgatgagtgggcatcgcgtgggggccttggacgagcgtggacaccccaatccccagactggccattgccgtggaggcagcgtgagtgtgacatggagctcggtgtcgtgctgcagaggacgcntcgcggctgtacgcgtcatgatagccanggacccctccacatgtcacttagccaaaggatgcagcccngcctggggctttctaccccaggcccgaggacctgcagggacaaggacccctcagcgcagatgcagctctcatgaggcctgaaaccaagctggacttgcagaactgcgcacgctccctttctgaaagaaacacccgttaccgggtccagactgaatgtgggcgtaagaaagcgggaagggtcccccacagcaagagagagancctcccagtcacttggtcatctgagccttgagtgtgtccggccccagccaccagcctgtccccactatccctcttgtcagcacggctgaaaggagctgcctgggcacctgaggtggctgaggctcatctttgaggagcatggaactcgaggggagaagtcgcgcccccagggaagccagtacagacgggtttcnccctgttgcccaggctgctctcnaactcctggcctcatgtgatctgcccgcctcggcctcccaaggtgctgggattacaggcatgagccatcgggcctggcnggctagtgcaatttggacgatgagtttaaaactgcagaaccaaagtaacctnttccacaggcttcaagcacagtagctgaagataataaatccattataacaaaagagtagccaaaatgctgtggcattcttagaaatgaagaaagaactgaactgataagnc

SEQ ID NO: 253100 - DNA, 449 bp, Homo sapiens
  misc_feature (388)..(388): n is a, c, g, or t
  misc_feature (404)..(404): n is a, c, g, or t
  misc_feature (434)..(434): n is a, c, g, or t
  misc_feature (446)..(446): n is a, c, g, or t
gatggtatagcatttatatttataatcatacttatagttatattttgtaaatgaacttaggtaagatttccttttccatatttgtttaaaccagggccaccttttattattatgggtaagaaattaagaaaaattgttgacatttatgagtaacgtttattgataatgtttatgggttatattatgggtaagaaattaagaaaaattattgacatttcaaaatgaacaagtttattttatttacttacacacacacacacacacacacacacacacacatatattgagatagggtcttgcattgtagcccaggctggagtgcagtggcatgaacgtggctcagtgcagccttaacctcctgatcctcccaacggccccctcactgaanattcagtggacaatantattatccaccgggaatccggaacggtacngcaggcttacanctt

SEQ ID NO: 253101 - DNA, 437 bp, Homo sapiens
ctgcacatttcctgccatctaaggctgaccccccatctcccaattcttttttgcctgtttgtgattggagggcctactgtcctctcagactgaccaaagggttatgatttgcggtcatcgtcatcgtgagcagcacccaactactactcgagatacccaggcctagcttacaggaagcaggggacggagtcctgtattcaggcaccttggatgtgtgggttcccccagcagctgagcatcaccccagcctgctccttccaggtgacactaaggaagtgcaacccctcccagaagagcatgagcctggtgaagtcctcagtggaaccagaactgttcttctcgtcaagcagttatctatgttatctttcttggcacgattgtcttatggattagggagattaggggtaataaatgtctcgtttgagtgacaagctgga

SEQ ID NO: 253102 - DNA, 288 bp, Homo sapiens
tctttctgcttattttctgcagtttcaaaatagtcaatatgtaaggaggctgttacggctagaacctgctatgcattctgtactaaagtttatgcctccattttctaccattgttttcatcaccagtacccatgaaaataatttagattgtttcttaccaagcaagtttttagtgaattttttatagccatgaaaggcaaatgtttctttaaaaatacaaagtagaagtaaacatattaagatttcatcctgtttcctgattaaattaataaaagataaatttccatt

SEQ ID NO: 253103 - DNA, 441 bp, Homo sapiens
ttttctattgttgctggaaggaacagcaaagtctcaggtttctgggcacagatgctccagtgagagctcaggggaagtcaggagactgcccccgcctgctgcccaaggcacccccctctcccccaacacacacctcttctgcatagagttcctgttgccctcctccaactgggttagttttcaaggggcctagggtcacctttccccatgtgtggcccagggacaatggggtcaaagagattttaaaaaaagcgtcctagttcattaccctcaggagagtctgtgcgtcgtggcctctcctcccagagagctgaaggctctgagaactcctggaatccagcggcctgttgagccttgtctgatcagtgttccccaattgtatttgtttgtaaaatgcttttcttcatttaaaactaatgaacaccttgcagaacacatccc

SEQ ID NO: 253104 - DNA, 219 bp, Homo sapiens
gccagaaactgtgaaggaaggaccatgagggtcttggaggggaggaggatgttccttgggtggctagtgccaccgcctttggagagagctgaaggctctgagaactcctggaatccagcggcctgttgagccttgtctgatcagtgttccccaattgtatttgtttgtaaaatgcttttcttcatttaaaactaatgaacaccttgcagaacacatccc

SEQ ID NO: 253105 - DNA, 504 bp, Homo sapiens
  misc_feature (256)..(257): n is a, c, g, or t
tggaccatgagtccatgtttctggtactagctaagaccctaactctggtgtctattcataccaagacatgtccataaaacagccagcatttccgtaactctggcatctatttttctaaagctaaataatgaaacattgtatgaaactttgcttttaaattgtataaatgattctggattacaaaatggcatcttactttctgatagcaattaaaaataattgatattatggcccgtcacagtggctcacgcctgtnntcccagtactttgggaggctgaggtgggcggatcacctgaggtaggagttcgagaccagcctggccaacatagtgaaaccctgtcacaatacaaaaaattagccaggcatggtggcgggtgcctgtggtcccagctactctggaggctgaggcaggagaattgcttgaacctggaaggtggaggttgcagtgcagcgagatcacgccattgcactgcagcctggcgacaagagggaaatgctgtctg

SEQ ID NO: 253106 - DNA, 1047 bp, Homo sapiens
tcatttgtggaataaatcatgtgcccagtcacacggctccttacaggaaatggttggtgcatattagcttagcacaaaatacagtagtgagcttgtggtccccaacagtgagtcttcagttaacttctgctgtttttttttttttttttttaacataaagctttgaatgtttcatacagtatcaaatctctgcaggattttgcctgctgaaacagatgtgaaaatctgagtagcacagagtatgacattaaggccataacaataaacctattgttgctgcattctaaatttgatcaagatgtctgtttttgggaatccaaaatagttgcttcaaatttagcttttttcttttatgaagcagttttgttttgttttgttttgagacctctcatagcaagaaaaaacattacataaacttttttttgagacaaggtctcactttgttacccaggctggagtgcagtggcacgatcttggctcactgcagcctcgacctcctgggctcaagcagtcctcccaccttagtcccccacgtagctgggactacaggcacatgccaccacgcccggctaatttttgtatttttagtagagacagggtttcaccatgttgcccaggctggtctcgaactcctgagcacaagcgatctgcccgcctcggcctcccaaagtgctaagattataggcgtgagccaccatgcctggccacataaatataaacttaaaaatacacaggaaaacctttcagaacactttgaaacctattttggtcctattacgattgcactgaatgtcccccagcctaatgaagagcaattagatgtcatttggtggcattcttggtggagacagtaagctagggccgcaggagctgcttagtctcccagggtccagcattgtttcaggtaacgtgaacaggatgctcaagagctagtctaaataatgcttcatgtcttatttttcctgtttgttgataaggattcataaagatgtctttttctggtcatgtcaagggaaattcaaataaaaaacattgaattggtttgga

SEQ ID NO: 253107 - DNA, 675 bp, Homo sapiens
tgattatcattaatatcagttctttcaatattttcaataacataaaaagttgcttttagttataatttagtattttcaatactttcactaattgacatcataaatgttcaagatttttctttgcagggagagagaaggcatggagtctatccaaacgctaagtaagtggttggttattttacagactggctcttcaggacgtcactatggaccagacaggtggacttccaggccaacagcatggcaaggagcttcctggaatgccatgaaatccaaaagtcagaataaggtgagttttgcagcaacctgcagaacacatccacgcttcattgtgcctgagcctctgctccgctgcctccaccagcaccagcaatggcacagaaactgcatcaggagcaaggtggggtgcctcacagtctactgtaacttctgccggtgtggaccaggtggaattcctgggcttcccaggcaagatgaaaacactcaagctgcttccaagaatcccacagctttatccagatttggaaagttgggcaatccatggtgaataattgtttggccacattctttttcttcattttatgaaatattatggacctatgcacttcttgtggaaggagcaggtctttcagagaaagtgcctattttcttgaattacaacatcatgaagattta

SEQ ID NO: 253108 - DNA, 494 bp, Homo sapiens
atcacatgctcagaggcatcagatgaactttttcagtcgtgttctttttttcaataattattcaaccaactgccataggttatgtattggttgtttgtgagaaaattatatatttttttccagggacctctgtgaatggtgttagcacactcttaaatgcttatcgatgatcagtgaagagaccacagggatcccaaaaacccttacttccagctatcctgacttcccaaggtacatcttgaaatgctgttgcctccatgcagggagaggtgagggtgaatggactgggtgggtgggaaggcagcactgaaataaaagaaaaggcaccagagctgagcatctcctgctcccctggcctggaggcagcaagtaacagcagaaactgggggtagcacttcgtgtggacctggcagactccagaaagccagctttacatggcattaatgctcatggtaggggctgattgccacacattgggtatatcagagagatga

SEQ ID NO: 253109 - DNA, 2557 bp, Homo sapiens
tttttttttgagacagggtctctctctgtcacccaggatggagtgcagtgatgtgatctcagctcactgcaacctcaacctcctggctcaaatgatactcccgcctcagcctcccaagaaactgggaccacaggcgcgcaccacgatggctggctaatattttgtatattttgtagagatggagtttccccatgttgcccaggctggtctcaaactcctgagctcaggtgatccgcccaccttggcctcccaaagtgctgggattataggcatgagccactgcacccagcctttgtccatgattttgacagcatgacctgctaattctaccagagactccagtgggaacactcagcaaaataggctttgactcccacagtttccatccttttgcagataaataaggaagtaagtacacctttggctaaaactctggcactctgggcagttgatcctggcagagtccaagggtcagacccatggacctgtgaagtgggcaaccgtttccgggaactgtccatagcacttgctggggtgaccaggtcctgcctttcacgtcacctacttatccgactatttcctccatttgcttcttttctatttgccatcacctgtgacccgatggggccagacccctggttcatcccaaaccacatgacatgaacggactcttcctagggacagaggtttctccccagcagggatgccctcaccctcattcaatgtttatcgtctcttttcaattcctttagaacctcagccccacacatacatttattaaatgttcttttcttctcaaatatgaatggtaactctagtgagagcctacttgaacaggcttagggaaccatccctacaaacatgaagaagctgagatgcctcatgtaagtcacaagaagcagcagcatagaaatatgctcagaggggaatggggagttctggagggaacgccatgagtctggagactgtggctcttctgtgcggtggagcctgaccacgtgccccctgagttccttagaattcactaagtccatatcattcagaggttacaaaaccccagtttcaccaaagctacatgtccctggagctacaggaagcccacatgttgtgtagtgtgcagaaattctgttcttctccttcctgtaaactgtcagtgcactgtaaaatcaatagtagatggtgatgagtctggcctcaagaaaggaccctgaatagcactgggagccactttcaaagaatttaaatgtaagactaaagccaagcgagcttcctcatgaaaaccagcctatctgcaactgtattcagaaatgattaatgtcattttacatcaggtgcagaaaggtgtagcttaaaactatgtgttggtttttgttccacttgtaccaagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacaggtgagagatcacactgtgaaagtccaacatgtgagggttcacgcgataagcgtggagtacagagccagaacatgtgaacggtagctacacagtgatggacaaacacaacttattccacagctggtaaaatacttagaatatatctgaaattatctaaacacttgctattctgtcaaataagagagagagagaaaggaagagagataaacaattttcctttgaacagtgtggtacgaaacaaaaatgggattcttttgcaatgctaatttcaaaggtttgtttatattattaacaacatgaagatcctgtagtgagggagggtgtttttcccaagtcattgcaaaagactcattaaagaccagcttcgatgccatttagaaaccatttcccatcaattccagtgaaacattcttgaaatattagaatcctctttaccagggaaaataaaatgtccctttaagcttacaaactattagggaagaagactcaaaaataactaaaatgtgctacaaagtgaaaatgtttttttcttacaagaaactgatgagatgagttgaaatatctgatgatgaaaatccagccgaggaacaattggagaaccatccggctagatttcccctactgagtatggactttgagcatgtgcatatagacagaagactctgacatatgaggaatgagtgagaggcaacatgaagtccccactgcaaagaccctgaatgtcattaatccaaaataacttacagagcccacctgccatttcaatactgtgtcatctctgtaaatctgggtatatgagaatattttgaactcaacaatattcattattaaacatagaattcttctaacactttctgaaattgtttctttaaattagaaacaaagataagggtaaaatcacatatgctaataaaattctatgttccttagtccccctactatatttt

SEQ ID NO: 253110 - DNA, 2209 bp, Homo sapiens
tttttttttgagacagggtctctctctgtcacccaggatggagtgcagtgatgtgatctcagctcactgcaacctcaacctcctggctcaaatgatactcccgcctcagcctcccaagaaactgggaccacaggcgcgcaccacgatggctggctaatattttgtatattttgtagagatggagtttccccatgttgcccaggctggtctcaaactcctgagctcaggtgatccgcccaccttggcctcccaaagtgctgggattataggcatgagccactgcacccagcctttgtccatgattttgacagcatgacctgctaattctaccagagactccagtgggaacactcagcaaaataggctttgactcccacagtttccatccttttgcagataaataaggaagtaagtacacctttggctaaaactctggcactctgggcagttgatcctggcagagtccaagggtcagacccatggacctgtgaagtgggcaaccgtttccgggaactgtccatagcacttgctggggtgaccaggtcctgcctttcacgtcacctacttatccgactatttcctccatttgcttcttttctatttgccatcacctgtgacccgatggggccagacccctggttcatcccaaaccacatgacatgaacggactcttcctagggacagaggtttctccccagcagggatgccctcaccctcattcaatgtttatcgtctcttttcaattcctttagaacctcagccccacacatacatttattaaatgttcttttcttctcaaatatgaatggtaactctagtgagagcctacttgaacaggcttagggaaccatccctacaaacatgaagaagctgagatgcctcatgtaagtcacaagaagcagcagcatagaaatatgctcagaggggaatggggagttctggagggaacgccatgagtctggagactgtggctcttctgtgcggtggagcctgaccacgtgccccctgagttccttagaattcactaagtccatatcattcagaggttacaaaaccccagtttcaccaaagctacatgtccctggagctacaggaagcccacatgttgtgtagtgtgcagaaattctgttcttctccttcctgtaaactgtcagtgcactgtaaaatcaatagtagatggtgatgagtctggcctcaagaaaggaccctgaatagcactgggagccactttcaaagaatttaaatgtaagactaaagccaagcgagcttcctcatgaaaaccagcctatctgcaactgtattcagaaatgattaatgtcattttacatcaggtgcagaaaggtgtagcttaaaactatgtgttggtttttgttccacttgtaccaagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacagggacctctgtgaatggtgttagcacactcttaaatgcttatcgatgatcagtgaagagaccacagggatcccaaaaacccttacttccagctatcctgacttcccaagactggctcttcaggacgtcactatggaccagacaggtggacttccaggccaacagcatggcaaggagcttcctggaatgccatgaaatccaaaagtcagaataaggtgagttttgcagcaacctgcagaacacatccacgcttcattgtgcctgagcctctgctccgctgcctccaccagcaccagcaatggcacagaaactgcatcaggagcaaggtggggtgcctcacagtctactgtaacttctgccggtgtggaccaggtggaattcctgggcttcccaggcaagatgaaaacactcaagctgcttccaagaatcccacagctttatccagatttggaaagttgggcaatccatggtgaataattgtttggccacattctttttcttcattttatgaaatattatggacctatgcacttcttgtggaaggagcaggtctttcagagaaagtgcctattttcttgaattacaacatcatgaagattta

SEQ ID NO: 253111 - DNA, 2503 bp, Homo sapiens
tttttttttgagacagggtctctctctgtcacccaggatggagtgcagtgatgtgatctcagctcactgcaacctcaacctcctggctcaaatgatactcccgcctcagcctcccaagaaactgggaccacaggcgcgcaccacgatggctggctaatattttgtatattttgtagagatggagtttccccatgttgcccaggctggtctcaaactcctgagctcaggtgatccgcccacgtccatgattttgacagcatgacctgctaattctaccagagactccagtgggaacactcagcaaaataggctttgactcccacagtttccatccttttgcagataaataaggaagtaagtacacctttggctaaaactctggcactctgggcagttgatcctggcagagtccaagggtcagacccatggacctgtgaagtgggcaaccgtttccgggaactgtccatagcacttgctggggtgaccaggtcctgcctttcacgtcacctacttatccgactatttcctccatttgcttcttttctatttgccatcacctgtgacccgatggggccagacccctggttcatcccaaaccacatgacatgaacggactcttcctagggacagaggtttctccccagcagggatgccctcaccctcattcaatgtttatcgtctcttttcaattcctttagaacctcagccccacacatacatttattaaatgttcttttcttctcaaatatgaatggtaactctagtgagagcctacttgaacaggcttagggaaccatccctacaaacatgaagaagctgagatgcctcatgtaagtcacaagaagcagcagcatagaaatatgctcagaggggaatggggagttctggagggaacgccatgagtctggagactgtggctcttctgtgcggtggagcctgaccacgtgccccctgagttccttagaattcactaagtccatatcattcagaggttacaaaaccccagtttcaccaaagctacatgtccctggagctacaggaagcccacatgttgtgtagtgtgcagaaattctgttcttctccttcctgtaaactgtcagtgcactgtaaaatcaatagtagatggtgatgagtctggcctcaagaaaggaccctgaatagcactgggagccactttcaaagaatttaaatgtaagactaaagccaagcgagcttcctcatgaaaaccagcctatctgcaactgtattcagaaatgattaatgtcattttacatcaggtgcagaaaggtgtagcttaaaactatgtgttggtttttgttccacttgtaccaagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacaggtgagagatcacactgtgaaagtccaacatgtgagggttcacgcgataagcgtggagtacagagccagaacatgtgaacggtagctacacagtgatggacaaacacaacttattccacagctggtaaaatacttagaatatatctgaaattatctaaacacttgctattctgtcaaataagagagagagagaaaggaagagagataaacaattttcctttgaacagtgtggtacgaaacaaaaatgggattcttttgcaatgctaatttcaaaggtttgtttatattattaacaacatgaagatcctgtagtgagggagggtgtttttcccaagtcattgcaaaagactcattaaagaccagcttcgatgccatttagaaaccatttcccatcaattccagtgaaacattcttgaaatattagaatcctctttaccagggaaaataaaatgtccctttaagcttacaaactattagggaagaagactcaaaaataactaaaatgtgctacaaagtgaaaatgtttttttcttacaagaaactgatgagatgagttgaaatatctgatgatgaaaatccagccgaggaacaattggagaaccatccggctagatttcccctactgagtatggactttgagcatgtgcatatagacagaagactctgacatatgaggaatgagtgagaggcaacatgaagtccccactgcaaagaccctgaatgtcattaatccaaaataacttacagagcccacctgccatttcaatactgtgtcatctctgtaaatctgggtatatgagaatattttgaactcaacaatattcattattaaacatagaattcttctaacactttctgaaattgtttctttaaattagaaacaaagataagggtaaaatcacatatgctaataaaattctatgttccttagtccccctactatatttt

SEQ ID NO: 253112 - DNA, 2501 bp, Homo sapiens
tttttttttgagacagggtctctctctgtcacccaggatggagtgcagtgatgtgatctcagctcactgcaacctcaacctcctggctcaaatgatactcccgctttgtatattttgtagagatggagtttccccatgttgcccaggctggtctcaaactcctgagctcaggtgatccgcccaccttggcctcccaaagtgctgggattataggcatgagccactgcacccagcctttgtccatgattttgacagcatgacctgctaattctaccagagactccagtgggaacactcagcaaaataggctttgactcccacagtttccatccttttgcagataaataaggaagtaagtacacctttggctaaaactctggcactctgggcagttgatcctggcagagtccaagggtcagacccatggacctgtgaagtgggcaaccgtttccgggaactgtccatagcacttgctggggtgaccaggtcctgcctttcacgtcacctacttatccgactatttcctccatttgcttcttttctatttgccatcacctgtgacccgatggggccagacccctggttcatcccaaaccacatgacatgaacggactcttcctagggacagaggtttctccccagcagggatgccctcaccctcattcaatgtttatcgtctcttttcaattcctttagaacctcagccccacacatacatttattaaatgttcttttcttctcaaatatgaatggtaactctagtgagagcctacttgaacaggcttagggaaccatccctacaaacatgaagaagctgagatgcctcatgtaagtcacaagaagcagcagcatagaaatatgctcagaggggaatggggagttctggagggaacgccatgagtctggagactgtggctcttctgtgcggtggagcctgaccacgtgccccctgagttccttagaattcactaagtccatatcattcagaggttacaaaaccccagtttcaccaaagctacatgtccctggagctacaggaagcccacatgttgtgtagtgtgcagaaattctgttcttctccttcctgtaaactgtcagtgcactgtaaaatcaatagtagatggtgatgagtctggcctcaagaaaggaccctgaatagcactgggagccactttcaaagaatttaaatgtaagactaaagccaagcgagcttcctcatgaaaaccagcctatctgcaactgtattcagaaatgattaatgtcattttacatcaggtgcagaaaggtgtagcttaaaactatgtgttggtttttgttccacttgtaccaagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacaggtgagagatcacactgtgaaagtccaacatgtgagggttcacgcgataagcgtggagtacagagccagaacatgtgaacggtagctacacagtgatggacaaacacaacttattccacagctggtaaaatacttagaatatatctgaaattatctaaacacttgctattctgtcaaataagagagagagagaaaggaagagagataaacaattttcctttgaacagtgtggtacgaaacaaaaatgggattcttttgcaatgctaatttcaaaggtttgtttatattattaacaacatgaagatcctgtagtgagggagggtgtttttcccaagtcattgcaaaagactcattaaagaccagcttcgatgccatttagaaaccatttcccatcaattccagtgaaacattcttgaaatattagaatcctctttaccagggaaaataaaatgtccctttaagcttacaaactattagggaagaagactcaaaaataactaaaatgtgctacaaagtgaaaatgtttttttcttacaagaaactgatgagatgagttgaaatatctgatgatgaaaatccagccgaggaacaattggagaaccatccggctagatttcccctactgagtatggactttgagcatgtgcatatagacagaagactctgacatatgaggaatgagtgagaggcaacatgaagtccccactgcaaagaccctgaatgtcattaatccaaaataacttacagagcccacctgccatttcaatactgtgtcatctctgtaaatctgggtatatgagaatattttgaactcaacaatattcattattaaacatagaattcttctaacactttctgaaattgtttctttaaattagaaacaaagataagggtaaaatcacatatgctaataaaattctatgttccttagtccccctactatatttt

SEQ ID NO: 253113 - DNA, 2503 bp, Homo sapiens
tttttttttgagacagggtctctctctgtcacccaggatggagtgcagtgatgtgatctcagctcactgcaacctcaacctcctggctcaaatgatactcccgcctcagcctcccaagaaactgggaccacaggcgcgcaccacgatggctggctaatattttgtatattttgtagagatggagtttccccatgttgcccaggctggtctcaaactcctgagctcaggtgatccgcccaccttggcctcccaaagtgctgggattataggcatgagccactgcacccagcctttgtccatgattttgacagcatgacctgctaattctaccagagactccagtgggaacactcagcaaaataggctttgactcccacagtttccatccttttgcagataaataaggaagtaagtacacctttggctaaaactctggcactctgggcagttgatcctggcagagtccaagggtcagacccatggacctgtgaagtgggcaaccgtttccgggaactgtccatagcacttgctggggtgaccagtctatttgccatcacctgtgacccgatggggccagacccctggttcatcccaaaccacatgacatgaacggactcttcctagggacagaggtttctccccagcagggatgccctcaccctcattcaatgtttatcgtctcttttcaattcctttagaacctcagccccacacatacatttattaaatgttcttttcttctcaaatatgaatggtaactctagtgagagcctacttgaacaggcttagggaaccatccctacaaacatgaagaagctgagatgcctcatgtaagtcacaagaagcagcagcatagaaatatgctcagaggggaatggggagttctggagggaacgccatgagtctggagactgtggctcttctgtgcggtggagcctgaccacgtgccccctgagttccttagaattcactaagtccatatcattcagaggttacaaaaccccagtttcaccaaagctacatgtccctggagctacaggaagcccacatgttgtgtagtgtgcagaaattctgttcttctccttcctgtaaactgtcagtgcactgtaaaatcaatagtagatggtgatgagtctggcctcaagaaaggaccctgaatagcactgggagccactttcaaagaatttaaatgtaagactaaagccaagcgagcttcctcatgaaaaccagcctatctgcaactgtattcagaaatgattaatgtcattttacatcaggtgcagaaaggtgtagcttaaaactatgtgttggtttttgttccacttgtaccaagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacaggtgagagatcacactgtgaaagtccaacatgtgagggttcacgcgataagcgtggagtacagagccagaacatgtgaacggtagctacacagtgatggacaaacacaacttattccacagctggtaaaatacttagaatatatctgaaattatctaaacacttgctattctgtcaaataagagagagagagaaaggaagagagataaacaattttcctttgaacagtgtggtacgaaacaaaaatgggattcttttgcaatgctaatttcaaaggtttgtttatattattaacaacatgaagatcctgtagtgagggagggtgtttttcccaagtcattgcaaaagactcattaaagaccagcttcgatgccatttagaaaccatttcccatcaattccagtgaaacattcttgaaatattagaatcctctttaccagggaaaataaaatgtccctttaagcttacaaactattagggaagaagactcaaaaataactaaaatgtgctacaaagtgaaaatgtttttttcttacaagaaactgatgagatgagttgaaatatctgatgatgaaaatccagccgaggaacaattggagaaccatccggctagatttcccctactgagtatggactttgagcatgtgcatatagacagaagactctgacatatgaggaatgagtgagaggcaacatgaagtccccactgcaaagaccctgaatgtcattaatccaaaataacttacagagcccacctgccatttcaatactgtgtcatctctgtaaatctgggtatatgagaatattttgaactcaacaatattcattattaaacatagaattcttctaacactttctgaaattgtttctttaaattagaaacaaagataagggtaaaatcacatatgctaataaaattctatgttccttagtccccctactatatttt

SEQ ID NO: 253114 - DNA, 2503 bp, Homo sapiens
tttttttttgagacagggtctctctctgtcacccaggatggagtgcagtgatgtgatctcagctcactgcaacctcaacctcctggctcaaatgatactcccgcctcagcctcccaagaaactgggaccacaggcgcgcaccacgatggctggctaatattttgtatattttgtagagatggagtttccccatgttgcccaggctggtctcaaactcctgagctcaggtgatccgcccaccttggcctcccaaagtgctgggattataggcatgagccactgcacccagcctttgtccatgattttgacagcatgactcccacagtttccatccttttgcagataaataaggaagtaagtacacctttggctaaaactctggcactctgggcagttgatcctggcagagtccaagggtcagacccatggacctgtgaagtgggcaaccgtttccgggaactgtccatagcacttgctggggtgaccaggtcctgcctttcacgtcacctacttatccgactatttcctccatttgcttcttttctatttgccatcacctgtgacccgatggggccagacccctggttcatcccaaaccacatgacatgaacggactcttcctagggacagaggtttctccccagcagggatgccctcaccctcattcaatgtttatcgtctcttttcaattcctttagaacctcagccccacacatacatttattaaatgttcttttcttctcaaatatgaatggtaactctagtgagagcctacttgaacaggcttagggaaccatccctacaaacatgaagaagctgagatgcctcatgtaagtcacaagaagcagcagcatagaaatatgctcagaggggaatggggagttctggagggaacgccatgagtctggagactgtggctcttctgtgcggtggagcctgaccacgtgccccctgagttccttagaattcactaagtccatatcattcagaggttacaaaaccccagtttcaccaaagctacatgtccctggagctacaggaagcccacatgttgtgtagtgtgcagaaattctgttcttctccttcctgtaaactgtcagtgcactgtaaaatcaatagtagatggtgatgagtctggcctcaagaaaggaccctgaatagcactgggagccactttcaaagaatttaaatgtaagactaaagccaagcgagcttcctcatgaaaaccagcctatctgcaactgtattcagaaatgattaatgtcattttacatcaggtgcagaaaggtgtagcttaaaactatgtgttggtttttgttccacttgtaccaagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacaggtgagagatcacactgtgaaagtccaacatgtgagggttcacgcgataagcgtggagtacagagccagaacatgtgaacggtagctacacagtgatggacaaacacaacttattccacagctggtaaaatacttagaatatatctgaaattatctaaacacttgctattctgtcaaataagagagagagagaaaggaagagagataaacaattttcctttgaacagtgtggtacgaaacaaaaatgggattcttttgcaatgctaatttcaaaggtttgtttatattattaacaacatgaagatcctgtagtgagggagggtgtttttcccaagtcattgcaaaagactcattaaagaccagcttcgatgccatttagaaaccatttcccatcaattccagtgaaacattcttgaaatattagaatcctctttaccagggaaaataaaatgtccctttaagcttacaaactattagggaagaagactcaaaaataactaaaatgtgctacaaagtgaaaatgtttttttcttacaagaaactgatgagatgagttgaaatatctgatgatgaaaatccagccgaggaacaattggagaaccatccggctagatttcccctactgagtatggactttgagcatgtgcatatagacagaagactctgacatatgaggaatgagtgagaggcaacatgaagtccccactgcaaagaccctgaatgtcattaatccaaaataacttacagagcccacctgccatttcaatactgtgtcatctctgtaaatctgggtatatgagaatattttgaactcaacaatattcattattaaacatagaattcttctaacactttctgaaattgtttctttaaattagaaacaaagataagggtaaaatcacatatgctaataaaattctatgttccttagtccccctactatatttt

SEQ ID NO: 253115 - DNA, 7898 bp, Homo sapiens
gtcgctgtaagatcccgttttgggctgtcgtgctggtagacctgcgtcgtgtgattcatgattgcggaaacgcgtctccatcctctctctccttgcgttcatgattggaggcaccttgtcttgttcagtaatgtctccccatttcctagaagagggggtggcatatgcacccctgtggacacctgccttccccttgtagtgatgctgtcctggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctggctgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgcaagaacgatattggtgggcgcttcctgctggaagacacctggaccacattcatgaaggctcgcctgaactgctcccgtcctggggaagtccccttttactacaacgaattgcagagtactttcttcctgcctgagctggatttgatctatggcatctttaccaccaatgtgaacagcattgcggcctcagctgtgtgcgtcttcaacctgagcgccatcgcgcaggccttctctgggcccttcaagtaccaagaaaactcgcgctcggcctggctaccgtatcccaacccaaacccccacttccagtgtggcaccgtggaccagggcctgtacgtgaacctgaccgagagaaatctgcaggatgctcagaagttcattctggtgcatgaggtggtacagccagtgaccacagtgccctccttcatggaggacaatagccgcttttcccacgtggcagtcgacgtggtgcagggcagagaagcgctcgtccacatcatctatttggccacagattacggaaccattaagaaagtgcgggtacccctgaatcagacctcaagcagctgtttgctggaagagattgagctcttccctgagaggcggagggagcccatcaggagcctgcagatcctgcacagccagagtgtcctgttcgtggggctgcgggagcacgtggtcaagatccccctgaagaggtgccagttctaccgcacacgcagcacctgcattggggcccaggacccttactgtggctgggatgtggtaatgaagaaatgcacaagcctggaggagagcctgagcatgacgcagtgggaacagagcatctctgcgtgtccgaccaggaatctcaccgtggatgggcactttggtgtgtggtctccgtggacgccttgcacgcacacagatggcagcgccgtgggatcctgcctctgtcgaacccgctcctgcgacagcccggccccgcagtgtggtggctggcagtgcgagggccctggcatggagatcgccaactgttccaggaacggaggctggactccctggacctcgtggtctccctgcagcactacctgtgggatcggcttccaggtgcggcagcgctcctgcagcaaccccactcccaggcacgggggccgggtgtgcgtgggacagaaccgcgaggaaagatactgcaatgaacatttgctatgtcccccacacatgttctggacaggctggggtccttgggaacggtgcacagcccaatgcgggggtggcattcaagctcgccgcaggatctgtgagaatgggcctgactgtgcaggctgcaatgtggagtaccagtcttgcaacaccaacccgtgtcctgagctgaagaagaccacgccctggacaccctggacacctgtcaacatctctgacaacggcgaccactatgagcaacgattccgatacacatgcaaagcccgcctggctgatccgaatttgctggaagtgggaagacagagaatcgaaatgcggtactgttctagcgacggcaccagtggctgctccacagatgggctttctggggatttcctgcgtgctgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccaggaatgcaacactttgccctgcccagtggatggcgtgtggtcttgctggtccccctggacaaaatgttcagcaacatgcggcggtggacactatatgaggacccgctcttgctccaatccagccccggcctatggaggggacatctgcctggggctgcacacagaagaggcactctgcaacacgcagccctgcccagagagctggtcggagtggtcggactggtctgagtgtgaagcctctggcgtccaagtccgcgcccgccagtgcatcctcctgttccccatgggcagccagtgctccgggaacaccacggagagccggccgtgtgtgtttgactctaatttcatcccagaagtatctgtggcaagatccagtagcgtagaagagaaaaggtgtggagagttcaacatgttccacatgatcgccgtggggctgagcagctccatcctcggctgcctcctcaccctgctcgtctatacttactgccagcggtaccagcagcaatcccacgatgcgactgtcatccaccccgtctcacctgccccccttaataccagcataaccaaccacatcaacaaactggacaagtacgactcggtggaggccatcaaggcatttaacaaaaacaacttgatcctagaggaaagaaacaaatacttcaacccacatctcactgggaagacctattctaatgcctactttacagatctcaataattatgatgagtactaacagctttcatgttttgggcttcttgtaaatccccagttcctcaaggcctgtgccccatgactgcccatgtttctgaggcttcagagtcgaagtttggatacatttcaagtgcatttcaagccaccagagtgtcccattggtgccaaaaatacacgtctttaaaagcaacaaaaattgaaataagacatcgtgaaaatcttgaccattgttgattgagccagggtggtgaagtttttaattggtgttcatcctatttttctgacaagtccattggtttgttttttgagcattattttataaatgtgccacccacattggaaggagtctttctttagaactttggagtgtaaatcttcatgatgttgtaaattcaagaaaataggcactttctctgaaagacctgctccttccacaagaagtgcataggtccataatatttcataaaatgaagaaaaagaatgtggccaaacaattattcaccatggattgcccaactttccaaatctggataaagctgtgggattcttggaagcagcttgagtgttttcatcttgcctgggaagcccaggaattccacctggtccacaccggcagaagttacagtagactgtgaggcaccccaccttgctcctgatgcagtttctgtgccattgctggtgctggtggaggcagcggagcagaggctcaggcacaatgaagcgtggatgtgttctgcaggttgctgcaaaactcaccttattctgacttttggatttcatggcattccaggaagctccttgccatgctgttggcctggaagtccacctgtctggtccatagtgacgtcctgaagagccagtctgtaaaataaccaaccacttacttagcgtttggatagactccatgccttctctctccctgcaaagaaaaatcttgaacatttatgatgtcaattagtgaaagtattgaaaatactaaattataactaaaagcaactttttatgttattgaaaatattgaaagaactgatattaatgataatcattttatttttcatctctctgatatacccaatgtgtggcaatcagcccctaccatgagcattaatgccatgtaaagctggctttctggagtctgccaggtccacacgaagtgctacccccagtttctgctgttacttgctgcctccaggccaggggagcaggagatgctcagctctggtgccttttcttttatttcagtgctgccttcccacccacccagtccattcaccctcacctctccctgcatggaggcaacagcatttccaagatgtaccttgggaagtcaggatagctggaagtaagggtttttggggatccctgtggtctcttcactgatcatcgataagcatttaagagtgtgctaacaccattcacagaggtccctggaaaaaaatatataattttctcacaaacaaccaatacataacctatggcagttggttgaataattattgaaaaaaagaacacgactgaaaaagttcatctgatgcctctgagcatgtgataaagtcctgggtagacatggaaacgtgttcttacaaatgaaccttcggatctatgaaagaaaatatagtagggggactaaggaacatagaattttattagcatatgtgattttacccttatctttgtttctaatttaaagaaacaatttcagaaagtgttagaagaattctatgtttaataatgaatattgttgagttcaaaatattctcatatacccagatttacagagatgacacagtattgaaatggcaggtgggctctgtaagttatttggggattaatgaaatccagggtcttggcaggggggactcaatgtggccctctcactcatccctcatatgtcaagagtccttcctgtcttatatgcacatgctccaaggtccatactcagtagggggaaatctagccggatggttccccaattgttcctcggctggattttcatcatcagaaatttccaactcatctcatcagttttcttgtaagaaaaaaacatttttcactttgtagcacaattttagttatttttgagtcttcttccctaatagtttgtaagcttaaagggacaattttaattttcccctggttaaagagggattctaatatttccaagaatgttttccactggaattgatgggaaatggtttctaaatggcatcgaagctggtctttaatgatcttttgcaatgacttgggaaaaacaccctccctcactacaggatcttcatgttgttaataatataaacaaacctttgaaattagcattgcaaaagaatcccatttttgtttcgtaccacactgttcaaaggaaaattgtttatctctcttcctttctctctctctcttatttgacagaatagcaagtgtttagataatttcagatatattcctaagtattttaccagctgtggaataagttgtgtttgtccatcactgtgtagctaccgttcacatgttctggctctgtactccacgcttatcgcgtgaaccctcacatgttggactttcacagtgtgatctctcacctgtcttggaaactccttcataaagccgctcttccttaggcctgggctgtttggaagtcctggtgaaactttgcggttcacattttaaattcctgaatgaccttttcattctctctttctttatctttgtttttgtccttcattccctccttttgttcttccgtcctgcctttcacgtcacctacttatccgactatttcctccatttgcttcttttctatttgccatcacctgtgacccgatggggccagacccctggttcatcccaaaccacatgacatgaacggactcttcctagggacagaggtttctccccagcagggatgccctcaccctcattcaatgtttatcgtctcttttcaattcctttagaacctcagccccacacatacatttattaaatgttcttttcttctcaaatatgaatggtaactctagtgagagcctacttgaacaggcttagggaaccatccctacaaacatgaagaagctgagatgcctcatgtaagtcacaagaagcagcagcatagaaatatgctcagaggggaatggggagttctggagggaacgccatgagtctggagactgtggctcttctgtgcggtggagcctgaccacgtgccccctgagttccttagaattcactaagtccatatcattcagaggttacaaaaccccagtttcaccaaagctacatgtccctggagctacaggaagcccacatgttgtgtagtgtgcagaaattctgttcttctccttcctgtaaactgtcagtgcactgtaaaatcaatagtagatggtgatgagtctggcctcaagaaaggaccctgaatagcactgggagccactttcaaagaatttaaatgtaagactaaagccaagcgagcttcctcatgaaaaccagcctatctgcaactgtattcagaaatgattaatgtcattttacatcaggtgcagaaaggtgtagcttaaaactatgtgttggtttttgttccacttgtaccaagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacaggtgagagatcacactgtgaaagtccaacatgtgagggttcacgcgataagcgtggagtacagagccagaacatgtgaacggtagctacacagtgatggacaaacacaacttattccacagctggtaaaatacttagaatatatctgaaattatctaaacacttgctattctgtcaaataagagagagagagaaaggaagagagataaacaattttcctttgaacagtgtggtacgaaacaaaaatgggattcttttgcaatgctaatttcaaaggtttgtttatattattaacaacatgaagatcctgtagtgagggagggtgtttttcccaagtcattgcaaaagactcattaaagaccagcttcgatgccatttagaaaccatttcccatcaattccagtgaaacattcttgaaatattagaatcctctttaccagggaaaataaaatgtccctttaagcttacaaactattagggaagaagactcaaaaataactaaaatgtgctacaaagtgaaaatgtttttttcttacaagaaactgatgagatgagttgaaatatctgatgatgaaaatccagccgaggaacaattggagaaccatccggctagatttcccctactgagtatggactttgagcatgtgcatatagacagaagactctgacatatgaggaatgagtgagaggcaacatgaagtccccactgcaaagaccctgaatgtcattaatccaaaataacttacagagcccacctgccatttcaatactgtgtcatctctgtaaatctgggtatatgagaatattttgaactcaacaatattcattattaaacatagaattcttctaacactttctgaaattgtttctttaaattagaaacaaagataagggtaaaatcacatatgctaataaaattctatgttccttagtccccctactatatttt

SEQ ID NO: 253116 - DNA, 1165 bp, Homo sapiens
ctgctctccctgagcccgctcccgagcgctgctttcccgccgcgggtgggcttcgcagcctcaggccagccgcggcccttggcccgctgcagccccggccctccaccttccccgtgcaggggcggcccggccagtgtcgctcatcccgggacgctcccttctcccacccaggactgccccgcggagctggcttggacacccaactttgccacctcgagggtcgtctctgctgggcgcgaacctgcccacccaccggttggccgcgcgctcggggaccgtgctcgtggcccccaagccggtgcccccattctggaactcagcgagtagggggcggctctggggaagtggcagggggcggctgcagctgctgcctccacttccctagccaggtgctgaagaggatcctcggagccgctctggcccccaggcgctggatgactggcaccagcgctcctcgcacctgtgttggtgtgtgagacttgggctggagtgcccacgtggctgtggagtcagtgtgattcatgattgaggaaacgcgtcctccatcctctctctccttggcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggtggccctgtttgttccgtggatgtgatcctgatttgtccttccttagatgacagaccattcaaggaacattgcttcaaagcctggacacattccttcccccacagttacagcaatcatcgattatttagtttgatgcatccgggcatcaatttcttgtaaaacagctttgtttcctctttataatttatattaacataaatatgaatacttgggttaaaagctatctataacaaagaataaagggaaatagatcaaa

SEQ ID NO: 253117 - DNA, 8056 bp, Homo sapiens
ctgctctccctgagcccgctcccgagcgctgctttcccgccgcgggtgggcttcgcagcctcaggccagccgcggcccttggcccgctgcagccccggccctccaccttccccgtgcaggggcggcccggccagtgtcgctcatcccgggacgctcccttctcccacccaggactgccccgcggagctggcttggacacccaactttgccacctcgagggtcgtctctgctgggcgcgaacctgcccacccaccggttggccgcgcgctcggggaccgtgctcgtggcccccaagccggtgcccccattctggaactcagcgagtagggggcggctctggggaagtggcagggggcggctgcagctgctgcctccacttccctagccaggtgctgaagaggatcctcggagccgctctggcccccaggcgctggatgactggcaccagcgctcctcgcacctgtgttggtgtgtgagacttgggctggagtgcccacgtggctgtggagtcagtgtgattcatgattgaggaaacgcgtcctccatcctctctctccttggcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctggctgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgcaagaacgatattggtgggcgcttcctgctggaagacacctggaccacattcatgaaggctcgcctgaactgctcccgtcctggggaagtccccttttactacaacgaattgcagagtactttcttcctgcctgagctggatttgatctatggcatctttaccaccaatgtgaacagcattgcggcctcagctgtgtgcgtcttcaacctgagcgccatcgcgcaggccttctctgggcccttcaagtaccaagaaaactcgcgctcggcctggctaccgtatcccaacccaaacccccacttccagtgtggcaccgtggaccagggcctgtacgtgaacctgaccgagagaaatctgcaggatgctcagaagttcattctggtgcatgaggtggtacagccagtgaccacagtgccctccttcatggaggacaatagccgcttttcccacgtggcagtcgacgtggtgcagggcagagaagcgctcgtccacatcatctatttggccacagattacggaaccattaagaaagtgcgggtacccctgaatcagacctcaagcagctgtttgctggaagagattgagctcttccctgagaggcggagggagcccatcaggagcctgcagatcctgcacagccagagtgtcctgttcgtggggctgcgggagcacgtggtcaagatccccctgaagaggtgccagttctaccgcacacgcagcacctgcattggggcccaggacccttactgtggctgggatgtggtaatgaagaaatgcacaagcctggaggagagcctgagcatgacgcagtgggaacagagcatctctgcgtgtccgaccaggaatctcaccgtggatgggcactttggtgtgtggtctccgtggacgccttgcacgcacacagatggcagcgccgtgggatcctgcctctgtcgaacccgctcctgcgacagcccggccccgcagtgtggtggctggcagtgcgagggccctggcatggagatcgccaactgttccaggaacggaggctggactccctggacctcgtggtctccctgcagcactacctgtgggatcggcttccaggtgcggcagcgctcctgcagcaaccccactcccaggcacgggggccgggtgtgcgtgggacagaaccgcgaggaaagatactgcaatgaacatttgctatgtcccccacacatgttctggacaggctggggtccttgggaacggtgcacagcccaatgcgggggtggcattcaagctcgccgcaggatctgtgagaatgggcctgactgtgcaggctgcaatgtggagtaccagtcttgcaacaccaacccgtgtcctgagctgaagaagaccacgccctggacaccctggacacctgtcaacatctctgacaacggcgaccactatgagcaacgattccgatacacatgcaaagcccgcctggctgatccgaatttgctggaagtgggaagacagagaatcgaaatgcggtactgttctagcgacggcaccagtggctgctccacagatgggctttctggggatttcctgcgtgctgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccaggaatgcaacactttgccctgcccagtggatggcgtgtggtcttgctggtccccctggacaaaatgttcagcaacatgcggcggtggacactatatgaggacccgctcttgctccaatccagccccggcctatggaggggacatctgcctggggctgcacacagaagaggcactctgcaacacgcagccctgcccagagagctggtcggagtggtcggactggtctgagtgtgaagcctctggcgtccaagtccgcgcccgccagtgcatcctcctgttccccatgggcagccagtgctccgggaacaccacggagagccggccgtgtgtgtttgactctaatttcatcccagaagtatctgtggcaagatccagtagcgtagaagagaaaaggtgtggagagttcaacatgttccacatgatcgccgtggggctgagcagctccatcctcggctgcctcctcaccctgctcgtctatacttactgccagcggtaccagcagcaatcccacgatgcgactgtcatccaccccgtctcacctgccccccttaataccagcataaccaaccacatcaacaaactggacaagtacgactcggtggaggccatcaaggcatttaacaaaaacaacttgatcctagaggaaagaaacaaatacttcaacccacatctcactgggaagacctattctaatgcctactttacagatctcaataattatgatgagtactaacagctttcatgttttgggcttcttgtaaatccccagttcctcaaggcctgtgccccatgactgcccatgtttctgaggcttcagagtcgaagtttggatacatttcaagtgcatttcaagccaccagagtgtcccattggtgccaaaaatacacgtctttaaaagcaacaaaaattgaaataagacatcgtgaaaatcttgaccattgttgattgagccagggtggtgaagtttttaattggtgttcatcctatttttctgacaagtccattggtttgttttttgagcattattttataaatgtgccacccacattggaaggagtctttctttagaactttggagtgtaaatcttcatgatgttgtaaattcaagaaaataggcactttctctgaaagacctgctccttccacaagaagtgcataggtccataatatttcataaaatgaagaaaaagaatgtggccaaacaattattcaccatggattgcccaactttccaaatctggataaagctgtgggattcttggaagcagcttgagtgttttcatcttgcctgggaagcccaggaattccacctggtccacaccggcagaagttacagtagactgtgaggcaccccaccttgctcctgatgcagtttctgtgccattgctggtgctggtggaggcagcggagcagaggctcaggcacaatgaagcgtggatgtgttctgcaggttgctgcaaaactcaccttattctgacttttggatttcatggcattccaggaagctccttgccatgctgttggcctggaagtccacctgtctggtccatagtgacgtcctgaagagccagtctgtaaaataaccaaccacttacttagcgtttggatagactccatgccttctctctccctgcaaagaaaaatcttgaacatttatgatgtcaattagtgaaagtattgaaaatactaaattataactaaaagcaactttttatgttattgaaaatattgaaagaactgatattaatgataatcattttatttttcatctctctgatatacccaatgtgtggcaatcagcccctaccatgagcattaatgccatgtaaagctggctttctggagtctgccaggtccacacgaagtgctacccccagtttctgctgttacttgctgcctccaggccaggggagcaggagatgctcagctctggtgccttttcttttatttcagtgctgccttcccacccacccagtccattcaccctcacctctccctgcatggaggcaacagcatttccaagatgtaccttgggaagtcaggatagctggaagtaagggtttttggggatccctgtggtctcttcactgatcatcgataagcatttaagagtgtgctaacaccattcacagaggtccctggaaaaaaatatataattttctcacaaacaaccaatacataacctatggcagttggttgaataattattgaaaaaaagaacacgactgaaaaagttcatctgatgcctctgagcatgtgataaagtcctgggtagacatggaaacgtgttcttacaaatgaaccttcggatctatgaaagaaaatatagtagggggactaaggaacatagaattttattagcatatgtgattttacccttatctttgtttctaatttaaagaaacaatttcagaaagtgttagaagaattctatgtttaataatgaatattgttgagttcaaaatattctcatatacccagatttacagagatgacacagtattgaaatggcaggtgggctctgtaagttatttggggattaatgaaatccagggtcttggcaggggggactcaatgtggccctctcactcatccctcatatgtcaagagtccttcctgtcttatatgcacatgctccaaggtccatactcagtagggggaaatctagccggatggttccccaattgttcctcggctggattttcatcatcagaaatttccaactcatctcatcagttttcttgtaagaaaaaaacatttttcactttgtagcacaattttagttatttttgagtcttcttccctaatagtttgtaagcttaaagggacaattttaattttcccctggttaaagagggattctaatatttccaagaatgttttccactggaattgatgggaaatggtttctaaatggcatcgaagctggtctttaatgatcttttgcaatgacttgggaaaaacaccctccctcactacaggatcttcatgttgttaataatataaacaaacctttgaaattagcattgcaaaagaatcccatttttgtttcgtaccacactgttcaaaggaaaattgtttatctctcttcctttctctctctctcttatttgacagaatagcaagtgtttagataatttcagatatattcctaagtattttaccagctgtggaataagttgtgtttgtccatcactgtgtagctaccgttcacatgttctggctctgtactccacgcttatcgcgtgaaccctcacatgttggactttcacagtgtgatctctcacctgtcttggaaactccttcataaagccgctcttccttaggcctgggctgtttggaagtcctggtgaaactttgcggttcacattttaaattcctgaatgaccttttcattctctctttctttatctttgtttttgtccttcattccctccttttgttcttccgtcctgcctttcacgtcacctacttatccgactatttcctccatttgcttcttttctatttgccatcacctgtgacccgagtggaacaaaaaccaacacatagttttaagctacacctttctgcacctgatgtaaaatgacattaatccactatttaacttctaaaattatttctgaatacagttgcagataggctggttttcatgaggaagctcgcttggctttagtcttacatttaaattctttgaaagtggctcccagtgctattcagggtcctttcttgaggccagactcatcaccatctactattgattttacagtgcactgacagtttacaggaaggagaagaacagaatttctgcacactacacaacatgtgggcttcctgtagctccagggacatgtagctttggtgaaactggggttttgtaacctctgaatgatatggacttagtgaattctaaggaactcagggggcacgtggtcaggctccaccgcacagaagagccacagtctccagactcatggcgttccctccagaactccccattcccctctgagcatatttctatgctgctgcttcttgtgacttacatgaggcatctcagcttcttcatgtttgtagggatggttccctaagcctgttcaagtaggctctcactagagttaccattcatatttgagaagaaaagaacatttattaaatgtatgtgtggggctgaggttctaaaggaattgaaaagagacgataaacattgaatgagggtgagggcatccctgctggggagaaacctctgtcccctaggaagagtccgttcatgtcatgtggtttgggatgaaccaggggtctgcccccatcgggtcacaggtgatgccaaatagaaaagaagcaaatggaggaaatagtcggataagtaggtgacgtgaaaggcaggacctggtcaccccagcaagtgctatggacagttcccggaaacggttgcccacttcacaggtccatgggtctgacccttggactctgccaggatcaactgcccagagtgccagagttttagccaaaggtgtacttacttccttatttatctccaaaaggatggaaactgtgggagtcaaagcctattttgctgagtgttcccactggatcctctgtagaattagcaggtcatgctgtcaaaatcatggacaaaggctgggtgcagtggctcatgcctataatcccagcactttgggaggccaaggtgggcggatcacctgagctcaggagtttaagaccagcctgggcaacatggggaaactccatctctacaaaatatacaaaatattagccagccatcgtggtgcgtgcctgtggtcccagtttcttgggaggctgaggcgggagtatcatttgagccaggaggttgaggttgcagtgagctgagatcacatcactgcactccatcctgggtgacagagagagaccctgtctcaaaaaaaaa

SEQ ID NO: 253118 - DNA, 805 bp, Homo sapiens
acagggcttccgaggcgatcaggcagcgtcagtcttcagccactaaaccgagaagatctgagaaagagtcagtcagagagccttgggccagagttccaggggctctgggagtggcttccagaaaataggaagaaaggaagaattaaagaaagaagaaaggaaagaagaaaagaaggcaggaaggaagaacaaaaggagggaatgaaggacaaaaacaaagataaagaaagagagaatgaaaaggtcattcaggaatttaaaatgtgaaccgcaaagtttcaccaggacttccaaacagcccaggcctaaggaagagcggctttatgaaggagtttccaagacagggacctctgtgaatggtgttagcacactcttaaatgcttatcgatgatcagtgaagagaccacagggatcccaaaaacccttacttccagctatcctgacttcccaagactggctcttcaggacgtcactatggaccagacaggtggacttccaggccaacagcatggcaaggagcttcctggaatgccatgaaatccaaaagtcagaataagattatttgcctcatggaggacttgcctaattaccagaataaggttggcagtttgtgatatcttctggttaagttttcaactttagttatgaagttaccacgagaagcaggagttatgaatacaaagcattcagaaaatttgccagcatggacttatatctctaaaataggattggctcaagtgatttcaaggcaccataccaagacctgtgttatgtcggagaaaacaaaagacaacagatattcctt

SEQ ID NO: 253119 - DNA, 454 bp, Homo sapiens
agcacctcagagatacctcagcccagggcacagtgcaccctggggatcctttgctcccaaccaccccgaaggatgcatctggaatttctgcttattgggtgaccaaaaaaagggagaagagggtttgttttcatcattgccatttttattcacgagactgtcaactaggtcagtaattcttcaaaaccaatcctggcaaagcatgggaaggaaccttcgttctgcagaagcgtacacaccctgataaggtgtcaagaacctccgtttgagtacccctcgggttaagcctgactgggctgccggccacccttcaggcagagctgatgttctgtgatgaccttcacatcaagcatgaggtcgtgccccaagaagggtttcactgtgcccagggaggttcccctgagaaggacaagccattggcaaattcatgaatcagagttctgtttttagttct

SEQ ID NO: 253120 - DNA, 252 bp, Homo sapiens
tcacagctcactgcacctgggctcaagtgatcctcctgcctcagtctcccgagtagctgagactacaggcgtgcaccaccacatctggctaatttttttttttgggttgagatggagtttaaccatgttgcccaggtgggtcttgaacccctgagctcaagcgattcactcatcttggcctctcaaagaaggccaagaaacacatttttacaattggtgtttttattttcagaacccagagacaattgttag

SEQ ID NO: 253121 - DNA, 409 bp, Homo sapiens
gacatataataattgatcttcctgggagtgctgtaatgtaaaaacaattcaggctgttggaagtatattttacaagtatgcgttgggccttggggatgttatattgaaaaacccaattgtacagttaccatgggaacccaattaaaatagattggttgatttttttttttgtctttcatcttgaccaaaaatctaatgtattttaaatgttttcatatggaattgtagtcatatactgacttgctgtgccaaagtattctgctcgttttttccaactttaagctaaaatagtgaaaagttctcgagtggatccttatgagaacgtctcccaaagagaatcagtcatgtttttgtggaaaagtttgtgtgagtgatgatggtagagtggaggtggtggaaagcttttatg

SEQ ID NO: 253122 - DNA, 415 bp, Homo sapiens
agaaatcttcctcgttaagtcattgatcccgtccttccgaagggatcttggctctctgtggtgaaaatccttcaaaccctgtcctgctttggtccaaggtcattccacttctaggaatctttcctgaaggatctaccagcaatgggaacaacagctgcagcttaagtggttgcatcatggcatcatttctaatgtcagaaaactggaaataacacgaagggctgacatggggaggactggtcagataaattcagggcacagctgtccaccggcctggcagaaccttgaaatcacatcattaaaagcctatttaatgatgagagaaattgctcaacggaggctaaaaacaggatacataaaactgtatactcacagttttttaaagtatgtctgcatgactgtacatgcaaagaaa

SEQ ID NO: 253123 - DNA, 1057 bp, Homo sapiens
ggaaacctggtgatatagaaatgctatgcaggagttccacaggtcttctcatctctttgcatttgggggtgagatatttcttcattgtataggacagggttcagcaagctctgactcctacaagccaaatcttgtccacaacctgttcttgtgtctgtttttaaatagttgaaaaaaatcaacagaattgtattttgtgacatgagaaaattatatgaaatccaaattttagtgtccataaataaaatgttattgaagcacagtcatgcttaaattttaacgtagtatttgtagttgttttcccattacaaacaaaattgagtagttgcagcagagaccctatagcctgctaagactaaagtactatctcctttacagaaaaagtttgttgaccctagggtgtaggctactgaaagcattgtgtttcgcctactcagttcccactccctagatgtcactagcatcttccactacagtgacagaaaaaaatgcccagctaggtttgcaaatggccccttggggtgtgggagtgagtagggagggtggtgagatgtacctctcccatttgagaaccaacacataatatgtggtatctcctttgttagtctttataggagtccataaggaatttctcttaggtctctatattaagaaatgttatgtttctcctggtgtgaatctcataactgattgtgtttccttttgttgagacttttggaaaaagagcccagatggttggaaacagcctgcctgtagtagctgtgtgaaaatttatgtgatctcctatcctatatatagatgttacccttgactatggtttattttccctatctttattttcatttacctgctttttacatcttttttaatataccactctattaggtgcattctttaaaaaaattattttattttatttttagagacatggtttttattactgtgctgcccaggctggtcttcagctcctgaactcaagcagagtcatcctgtctcagcctcccaagtagctgggatgtagatgtattcttaagttgaactgtaaatcctatttgga

SEQ ID NO: 253124 - DNA, 688 bp, Homo sapiens
agcgaagggaggccgggccgaggtcgcgccccaggcccaggcccgccctcacttggagaattgcgcctgcacggcggccaggcccaggctggccgggaccaggtgcgggaacttgcacacggcgcaggtgcagaggccggggccgcctgcgccgccgccggggagagcgaactggccgcacggcggctcgtccagcgccagcgacagatgaagagaaaactgagccataggatgaagagaaaactgaagcacaagatgactgcatgcttttggccatagacacagggacgaaaagtcgcactcacttgacactctctgggatataagaagtgctaccatttcttgaaaggagattaggaagcagccctgggaaaccctggtacctctgtggaaatcggcactctccatttccctgctgaactgtcagtgttgccgtgctgttggtggtcttggaccaccgagatcatattaataccaacaacaagccagcaactcagagggctgccatttgcttctccaaacccattcttcacttacctctgctctgttctgtgtcctttatctgcatgggttatagcaacaggttccctactctctggctcctggctatgtctgaccaatggcagaatgaccaatgatttagagaatcaacctgggacagggccatataagactataaaacaggctg

SEQ ID NO: 253125 - DNA, 433 bp, Homo sapiens
aaaagaacaaaaagataaagaactaaagattcagcctcaagaaaggaggaaattctgtcatatgctacaacgtggacaaacactgaaattatgctaagtgaaataagacaaccagagaaatactactcaatactccacttacaagatgtctctaaacagttaaactcagaaacagaaagtaaaatggtagttgccaaggattgactggagggggaaatagggagtgctgttcaaaggatacagaggttcagttgtgcaacacgaaaaactctagagatctgctttaccacactgttcttacatttaacaataccggattatacacttaaaattttgttaacagaattaaagaagtacagccatgttaacaaaaaggctttggatcagtttgtaaatttctctgagcagaaagaaaagttaataaagcgacaag

SEQ ID NO: 253126 - DNA, 578 bp, Homo sapiens
acgaactggaaatctgaatttttaaatttagatctttaaatcaaattatttttatgcatattttcatttaatatagagtataccaatcgattgaagcctttcacaagtagtgcgctgagcttttcttattgaagagagtgaattagtttctgagaagtcaatctattgtgaaaagtttcagatgagattattttcttttagtctttttaaatatcactatatgtatttaaatagaagcaataaactagagagagtgtttcttgaaaagacaatgttttatttgccaccaggcagaacagaatgagcattggtagagaaggctccctcttggtatgttactgataaacttgtacttcctcatacttgtttgtggttctactgacttatttccaaacttaagagtaatgtacttcgaaaacaacttggttattctttaaatttcaggtaaaaccccttttcctaacactcatcttatttccactgtcttatttcctctcagatgttcatatttcacatgttcaaaatgaagcgtactatttcccctccaataaacgaagtctcctgccaacttcactgtc

SEQ ID NO: 253127 - DNA, 493 bp, Homo sapiens
atccgtataaattcttcattgcttaaaatgacagactgaaagcaaagccacatgttgcttgcttcattgcctgttgtggcagcttttaaatccctgccttcctaggaagtgacctcataagaaaatcttataagactgtcctgtggggaaatcctcataacatttgggttaatgcgcttacactgcaggagaggtcaccaggaacatccaatcatcagaaagtcctacagggacgtgatgttacctgggtcatggaaggatctctctcaacacacatctggggtgttttgtggcatattctatagcaggccatgtggcttaatagttaaaatatggggctgaaagttacgagggttgggggatcatatggcagctgagctattgcctgacacgctgaccctacacaactcatgagttcgtggtacttcagtcagcttagctgtaaaattgggcacaaaggccagactttaccaaaaccagatgttggactcca

SEQ ID NO: 253128 - DNA, 375 bp, Homo sapiens
ggaaatggcagatgcttataaaaccatcagatctcatgagaacttactatcatgagaacagcatgggggaaactgcccccatgattcaattacccccacctggttccttcctcaacacctggggattatggggattacaattcaagatgagatttgggcagggttcagaaagcctaaccatatcagatgggaaggacatgagggttgacaaaatatgtattgggtacaatgttcactgtttgagtgatgggtccactagaagcccaaacttcaccattatgcaatgtaccatatatacgcaatgtaacaaacctgtacatgtaccccttcaatctgaaataaaagttgttttttttttttagatgcgaagttctg

SEQ ID NO: 253129 - DNA, 473 bp, Homo sapiens
gctgtgcattaaacactgtccgcagggaacttggttttggtgaacttcagttgcataaggaggtcttaccattcatcctctaaaattttggcattaaaattatgagtgcaaaatcattttgctgataaagcttatatgttattgttgaatattagcacattggatactagaatgaaatattagataactaaatgcattgtcctgagtacactttacaaatatgtatacatatatgtgggtgtgtatacgggtgtgtgcatcttatacatgtatacctgtgtgttcataccccatgaacttttcccttttctccatgttgtcacattttaaagcagttaaagcatttaaagcattttaaagcagttaagcatttaaagcagtttaggtcagccaaaccttgaggtggaggttgcagtgagctgagattgtgccactgcgctccaccctgggtgacagagcaagactctgtctcc

SEQ ID NO: 253130 - DNA, 603 bp, Homo sapiens
ttcattatcatatgttctcttaccttattctcttagcactcttaagggtttacaggcaagaattgcaacaaataaggaaactgagatccgagaaagctaagagaatcacatgagatgagagaattattaagtgactagtcttgagccaaattagggtcctgatttgccaaggatcgttctagttcacacgtattacctcaacataattattaaatgattccccttaactctcaaaaaagaatttgactgattccttggtcactctaagtagaacacacatttccttagccccagtcctgtgccctttccactgcatgaagctgggcttaaatgtatctgctccttcagaaaactaacatcctgtttcagtccgtgtctcactacttttgctgcttcagagcagagtggagataaaccgtaggtgtagtcaatgccatctctgcactaataaagcttctgtttcccggtcagcttcctgcagggcaagagctccttttcaaattacgatcaagagcattaatttatcagacatcatgctgaatatgccctgaagtttggtttgttttttctatcattacatctccccagagttgcagtcaagaa

SEQ ID NO: 253131 - DNA, 182 bp, Homo sapiens
caggagaaagggttagctgcctggaaaccactggtggtttctgcattggcagtttcgagtcattttatcctcactccgtgtatgaatcatacttattgtatattggttggattctacctagatgtagaggattatgagtgaaacagattggtttctgtaattatttgagactatgatgctat

SEQ ID NO: 253132 - DNA, 688 bp, Homo sapiens
aggtgtttctctggcttctgctgcagagaaaatgttgcagagggagtggaaagtagcaggtgccggtaacccccaaccagctcccagatacttggtaaggcagatctcacatctgcagtattctgctagcagcagtgagttaagttccaggtcattttcgattagaactcaaaactgcctcaggccataagccttcctcagggaagtagctatcccagctttcaggccacacccctcccagtctaaccacaaagctggggcaccccagctcttgcactcatggctgcagcacacttccactcacactacccctgattcagttctggccaagggacttcatccccccttgaggtcatattgcaaaattcaggtgggagtttcttttaacctatgaccactgcctgagttagttggtagaattctgtgaagtcccctgtgacacagaataagaaatggcttcccttgatccatgctggagactgggaatgcacacaaggctcttctcactgctgtttctccttttatattcctcaccactgcctatatcattgccagcactgggtaagattaagggccttcccctgtgacttggatttctaggttccccaatggagaggtgtatatcctggaggcagtctctcccaactcacactctgaggacttacagttttttgcctggctcatggtg

SEQ ID NO: 253133 - DNA, 443 bp, Homo sapiens
tattttttggccagcctgcttccttccccctttcccctccctccctgcctgccatcatctgcctggtgagtttgcatcactcctagggcccaggggtccaattaggggactcccccagggaagctgactgaggcaatccatgccccaagggggcctccctgagctgaagttttaattagccatcactgctctccctgaaactctgacctgcccatagctctaccatcccaggctggccttgtggcaggaggcagaaggcaggactggcgttcaacccagctgcgcagcagaagctgccctggcagagcagagagatgtggccaggcttccctcccacacagctctctgtatccacctcagcatcacctcatttagtccagtaaatggattacaaaataaatggactaagcgacttcatccattaaatagattaaatacattaa

SEQ ID NO: 253134 - DNA, 508 bp, Homo sapiens
ccactcattcactctttaacaagtattttgaagtatatatgtttgaattatgtgttcttctttttgacaatttgactatatgttgatagtgcaataattgtgcagtttaagccttcaataaagaggtagaatgtgatgaaaattggaaggaaacctgagggggcattcttagtgcttggttaaacagaaagcttaacagttcatgaaggctggtctaagaaaggaattataagcatgggtgacccacctggtgtagagagtgtatccccagatatataacattgcattttagaagtctaatatttggtatataatttttgaaatagtcctttatgtgatgtttccattagcaaacagcaaattgcatctgtaccaagagatttcacttccttttttgtttaaatatgcattttggacattgttcaaaacctatgacctaaggcttttccaagagccctttgcccataaagagaatgaataaattagaggccagagtcaaaaaaaaaaa

SEQ ID NO: 253135 - DNA, 747 bp, Homo sapiens
ttgacctacaggtttctctgaaatagtcctgctaccttgagggtcactcctaggattctgaaatcccccaggccttccaaagaccatagcctgatgtgggacacagatggttatgcatttactcagcaaatattaactgtttaaaatccttcccaagggccaagtgtcaagtgtcatgcacacatctgggtattggggattcagtggtgaccaacgggcaaagcatgtgcccgtagatcttatgttgtaggggagttgatgatgttggggagaggatggtgtatagtaggtaaacaaataaagtgcctggtcatttccgattgagatacaagtactgaaaacagtaaagcagggtgattttcagaatgatggccattggtttagattgggtgcccaggaaagccaatgggaagatctcacttgaactgagacctggagagataaaccatgtcggctgggcgcggtggctcatacctgtaatcccatcattttgggaggccgaaatgggataactgcttgagcctaggagttcaggaccggcctgggcaatatggcaaaactctgtctctacaaaaaatacaaaaattacccgggtgtggtggcacacgctgtggtcccagctactcaggaagctaaggcagaaggatcgcttgagcctgggaagcggaggttgcagtcagccgagattgcgccaccgtactccagtgcgggtaacagagtgagattatgcctcaagaaaaaaaaaaa

SEQ ID NO: 253136 - DNA, 200 bp, Homo sapiens
ggcccagcggagacactggaagaagggacagctcaggccacagggctgcttctagcggacagcacccagcaactcacagacaccgcatcaaagccttgaaaaatgaccatcgccagcctcccgtccatagacaggatgacactgtcagctcttctgtggggctcgccggccccctgcccatcactgtcagacacagcacc

SEQ ID NO: 253137 - DNA, 439 bp, Homo sapiens
agcatagcttgggttatgttttataagccaagtaacaacagacagaacatcccagcagaagaccctctttggaaacagcacaagatgtgccagcgaggtgctgtctaaggcactgcctggaacacctggccaggtgcagaatgggaggagtcagtcctgtgccactcaagatcctttggccctgcgctgtcctggacggaagctgcttatcacaggtggttgttgggtccttgcaatggagcaagtgacagagctgagatatgccgtgagcatcttacacactggatttcctataccttacacactggatttccaatactttgaatagaaaaaaagaatgtaaactgcctcgctaataacttttcatgttaattacatgtggaaatgatagtattttggatcccttggttctgataaaatacatccctaaattgaattt

SEQ ID NO: 253138 - DNA, 334 bp, Homo sapiens
cacctggctaattttttgtatttttaggagagacggagtttcaccatgttggccaggctggtcttgaactcctgacctcaggtgatccacctgcctcggcctcccaaagtgctgagattacagatgtgagccaccgtgcctggcctagtccccactttctaataccaccatcatggggatggaatttcaaacataaatttgggggatgggacacagattcagaccatagcacatcactttcttcttcctaacagatcttcaattttgttcaactatccacccatccatggattgactttaatcagtccattccaatgaatatttggcctttctc

SEQ ID NO: 253139 - DNA, 590 bp, Homo sapiens
ttgctgatgctgctggtgtcagagcaacatgatgaaaactactgatttgtttaatgaagacagttgatgccaaggacatagtcatgattatttaccccaaagagtttgtttactccttcatctggtggtctccttatcccccaatgggcagatttcccacttcatttacttcattttgtgctccattttagccttttttttttttttaaaccattgtctaccatattggctgtattattgtcagtattcaattagggtcttttggactgtaacaacagaaaagagaactcaaactggtttagaaagttattaaatggatttatgtctaataaacagaatttactagctcataaagagaaagtccaggatagggtagccttcagtgctgtttgatgatgtcatcaaggacccatgtgattcacttctgtttttttgctctgcaagccacagttttggcttcactttaagactggttccgcttgtggttttaggacagctgctggtagcaatcaagtttacaagttgcttgcttacaacccttggaaaagtaacttcctggggctttcttcagaataaagagaagttttcca

SEQ ID NO: 253140 - DNA, 195 bp, Homo sapiens
ttgggtggcagctaaccatctgcagctcccagacaagggccctgaccccctttcattccacagcactgttgtacttacaaaaagaatccacagcatactcaactagggagaagggaataaaagactcactgattgaatagaacatactgtttttggagtaggaagctagatattagaaaaaattttgggccaggc

SEQ ID NO: 253141 - DNA, 457 bp, Homo sapiens
tccccaacagccaaccttacttgagtaataggtttcagggaggccaaacgtgtgatttttggccttcttacttgtaagtgacagaaattcacaagagttagtataagcaagacatttattttaatgatacaggggtgtccccaggaaagcagagatgaaatgtaactaggccttcttaaaggtttctctctcagtgtttctcagctctgctctagtgcacacagttggaaacatggtgctgtcccccaccctaaaagttctggagctttattcttcacagtctatcacacagagagtcacttctctttctcaggcctgactgcaaaactctccattattcttggcctcacttaggtgctcacccactgtgtccagggatcaggattacatgtatgaaggttgggcgcatacgactataccccttcctccccaggagtacattgaaaagatgataaaa

SEQ ID NO: 253142 - DNA, 3858 bp, Homo sapiens
ctactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaagaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgattttttctggagaattgtaaaataaagttttctatttttccttaaaaaaaaaaccggaattccgggcttgggaggctgaggcaggagactcgcttgaacccgggaggcagaggttgcagtgagccaagattgcgccattgcactccagagcctgggtgacagagcaagactacatctcaaaaaataaataaataaaataaaagtaacaataaaaataaaaagaacagcagagagaatgagcaaggagaaatgtcacaaactattgcaaaatactgttacactgggttggctctccaagaagatactggaatctcttcagccatttgcttttcagaagtagaaaccagcaaaccacctctaagcggagaacatacgattctttattaagtagctctggggaaggaaagaataaaagttgatagctccctgattgggaaaaaatgcacaattaataaagaatgaagatgaaagaaagcatgcttatgttgtaacacaaaaaaaattcacaaacgttggtggaaggaaaacagtatagaaaacattactttaactaaaagctggaaaaattttcagttgggatgcgactgacaaaaagaacgggatttccaggcataaagttggcgtgagctacagagggcaccatgtggctcagtggaagacccttcaagattcaaagttccatttgacagagcaaaggcacttcgcaaggagaagggtttaaattatgggtccaaaagccaagtggtaaagcgagcaatttgcagcataactgcttctcctagacagggctgagtgggcaaaatacgacagtacacacagtgactattagccactgccagaaacaggctgaacagccctgggagacaagggaaggcaggtggtgggagttgttcatggagagaaaggagagttttagaaccagcacatccactggagatgctgggccaccagacccctcccagtcaataaagtctggtgcctcatttgatctcagcctcatcatgaccctggagagaccctgataccatctgccagtccccgacagcttaggcactccttgccatcaacctgaccccccgagtggttctccaggctccctgccccacccattcaggccggaattc

SEQ ID NO: 253143 - DNA, 459 bp, Homo sapiens
gtttctggaatcaccctccccgccacgtatatgagacatatccttgattgtccgtgaaatcaggtggtccagggccaggttggtccatagagatgttgacaaaacaatgtaaaagttcatctagagaactgagtacttaaggaactatcacaaaagaagaatgagagggaatgtccactgccagacaccaaaatgtgttctaaggtgaaagtgttaaaacagcatgttgctagtgccactccaggcaaaatcctcaagtgctctaagggcttgggcaagtaccttgctctaagatagccctgactttgtgagctgcctaaaggcatgaaaattcacaatattcaaacacacttctgacaaaaaccaaaacaagatcaaaaacacatctggagccctgaaatggggtacagggacccagtttatgatccttgacacaataaacagaatagaaaatccaaa

SEQ ID NO: 253144 - DNA, 488 bp, Homo sapiens
aatagacttacaaaatgtctaaatgatggttcagtatggtaaagctgtaaattccatccaaatgaatttaggaatttaatgcgattgcaatcaaaatttcagagagtttttttccccatagatgttgacaaaacaatgtaaaagttcatctagagaactgagtacttaaggaactatcacaaaagaagaatgagagggaatgtccactgccagacaccaaaatgtgttctaaggtgaaagtgttaaaacagcatgttgctagtgccactccaggcaaaatcctcaagtgctctaagggcttgggcaagtaccttgctctaagatagccctgactttgtgagctgcctaaaggcatgaaaattcacaatattcaaacacacttctgacaaaaaccaaaacaagatcaaaaacacatctggagccctgaaatggggtacagggacccagtttatgatccttgacacaataaacagaatagaaaatccaaa

SEQ ID NO: 253145 - DNA, 557 bp, Homo sapiens
gctaaactagacgctggggtaacaaagctgagttagataccctctcctctgaggcagctaaagagaaggaaagtctggtggctgacaagtaaaccaacagttatgttcttcagagaggagatctcagactctctaagcaaaagaaactaatagctgtatgacaacagccaaagagtaaatatcctttcaagtccaatcctgcctaagatgtcaaaatcaagaatgaagaggttatgtgctgaaacagaatgaccttcacaagatgcagcctctggatcttggacttccccagcctccagaactggcatcaaggtacatcttggtgttgaatgaagttgttccatatgggctcatttctcaggttgtttgcaaaaaagaaataatgtaatacagtgcaccaactgtatttcaaagatgcaggccaactcgacatttcatgtgctgaaaacaggtattaaatatactttataatctgatatctgatatgttattgcatttgggtaccactctctaagtatatttaatgttggaataaaaactgaattgaaaagtttttt

SEQ ID NO: 253146 - DNA, 502 bp, Homo sapiens
tttgcttccattacagctgagcagagccccataaatgagaagccacgaagactgaggttacacagtgatccacagttgccacaaaactgagcaggcatcaaggtacatcttggtgttgaatgaagttgttccatatgggctcatttctcaggaagcccgatcgggttaaaagagaaggcaaattccttttagctgcaattattatttgtggaatatctaatcacatgatgctgtgaagtgcacacaatacacagaagacaccaacattaactttgaggaatttatcttctgtatgtgaggatttgggttgtttgcaaaaaagaaataatgtaatacagtgcaccaactgtatttcaaagatgcaggccaactcgacatttcatgtgctgaaaacaggtattaaatatactttataatctgatatctgatatgttattgcatttgggtaccactctctaagtatatttaatgttggaataaaaactgaattgaaaagtttttt

SEQ ID NO: 253147 - DNA, 346 bp, Homo sapiens
aattcctaactcttaggctggagttcttcctgttatgtgaagccaaagtagggaatcattaggtccaagaataggaattacatttatattttaatgaaaaggtgcagtaaaatttaaaggaagagagagggttgcagatgacagaatacaaagaatgttgagagagatgaagcaagatgagtccatagaatcagaggcttagaagtaattcctatttatgaaagggagtgagaacaatgtggtgaggtgtatagagctatgtgaaagtgcttgtcaataacatggctgcagaatgctgatggtggtaattgaaaaggaagtaaaatataaaaacatttgcagaata

SEQ ID NO: 253148 - DNA, 225 bp, Homo sapiens
tgcctaacatagcagccgctatccacgtatggctatttaacataaatctattaaaattaaataaaattaaaaatctgtccctcagttgcactggccacattcaggagcacacgtagctagcgactttcatactgggcagtacagatatagaacatttcttttaccacaaataattttcctggacagcatcaacttgcaggatgcaagaatctgaaaggggctaag

SEQ ID NO: 253149 - DNA, 441 bp, Homo sapiens
tcttctatttttaatcctctttcctctgctttccctctcatgatccccctatcactccttagtttagagcctcatcagagctcacctatttgctaacgagggaagaaatgacctcctaaaggttcttcctgcctctagccttatatgctccatcatctttcatactgtggccagcattatctttcaaaaatacaaattaaattaatatttcaatgagaaatttatagatgtattgcactttccctggtaggttttttgtcactttccctctgagctcttgcctttccttctagtctttttgttgttgttgttgccaggctgggaggtggaggttgcagtgagccgagattgcaccattgcactccagcctgggcaaaaagagtgaaattccgtctcaaaaaaaaatatcattaagttatcttcttgaatcttaaaaaaaaa

SEQ ID NO: 253150 - DNA, 290 bp, Homo sapiens
gtcaggtggaccagctgctcctgtcctccctgtgggcaaacatacatagcaagcaaaataatcagaaggcagttcaatgagattagaagcagaacaagggaagaatgttatttaattttaatttttaatagctttgggccatgaaagcctgataattcatattccaaataaagatacaccttctacttggaccaactgtgcctgcccttgcattggggaactctctgtcctatccaagaacctcttccttacacagatagcttagcctacttctccagtgaggaggatta

SEQ ID NO: 253151 - DNA, 313 bp, Homo sapiens
attcctgagctgaatcttgaaggattaataggaagtggcagatgaatgaggcagaggtattcaggaactgtaagaataaggggggtactgctgccatctcggcacactgcagcctccctgcctgattctcctgcctcagcctgcggagtgcctgcgattgcaggcgcgcgccaccacgcctgactggttttcgtatttttttggtggagacggggtttcgctgtgttggccgggctggtctccagctcctaactgcgagtgatccgccagcctcggcctcccgaggtgccgggattgcagacggagtctggtt
